United States Patent 12,576,115 (BACTERIAL COMPOSITIONS FOR TREATING AND PREVENTING HALITOSIS) - sequence listing, part 25

SEQ ID NO: 42 - DNA, 2865278 bp, unidentified (residues 1-1,432,639 of 2,865,278)
  source 1..2865278: mol_type = genomic DNA; note = Enterococcus lactis
tagctatttttcttgcaccttttacttgactaatcgtaggaaagaggctgggacagaagcgtttaactccaaggaataagctgaaattcacgaaaattgcttttcaaatttttgtgaatttcagctatttcctaaggatttgcttctacttccgccgtttatacgtgtttagagcgtgggacaaaagtgttctttacttttgtcccacgctctttttagtgagatccgttgcatcgtttgaccaaattattttccgacagcaattggactgttcggaatcgtgaacccagaagctgtcaattctttgacataggagctcaaaaactcttcttttaaggcatattgttttccgttcaatgcgtagcagaccgtacgaatagcaaaattactattaccaagatccactaaaccaaatatggaaggttcagtttgaagctcttcttggtatttttcagctaatgtatgatttactcgatcaatgatctcatagattttgtcatatccttcttcaggaacgatccggatatctaaaagtacttgcatatttgcacgagaaagattgctgatcgtggtgatgtttcgattcgggatgaaatggacagtaccatccgttgcttttagctgaagggtacggataccaacagatacgacggttccttcaatcgttaagtttgctaacttgatgtagtctccaacatccatctgttgttccatgataataaaaaatccggtaataacatcactcatgaacccttgggcaccaagaccgatcgccacacctgcaattccggcaccagccaaaagtgatccgatcggtacaccgatagcagataaaattgcatagataaagaagaaaccaagggtataatgaaaaatagtatttaaaagactatgtaaagtctttaagcggctctcgtttagaatggcttttttagaatactgattaaaagacttatcaatcagatattttcccacacggtgaagaatccaaaaaaggatgatcaaaaaaaccagatataaacttttttggataaaggcagccaaaatagcgtcccaatcaatcccgtcccaaaaccgctgaaacgcatttactttgctgacagcttgatctgtcaatgtctcgccagaagagtctgtcgtaccggcagttgctaataatgaaaacataaaatcctcttttctaaaatttgattctttctgtattgtaccaagaagttttcaaaaaaggaaatagcaaaaataactataatgaaggaaaaaagctgaaaataaaatgacaaacaatatggataatgataaaatgtggagaaaataacgaaggtggtaaatatatgcaaatcgattggaataatttaggattttcttatatcaaaactccttggcgtttcattgccaaatggaaagacggacaatgggaagaaggggaattgacagaagataattacctgacgattcatgaaggctctccagcgcttcattatggtcagcaatgttttgaaggtctaaaagcttatcgtcgaaaagacgggaaggtcaatctctttcgacctgaacaaaatagtcgtcggatgaatcaaagtgctagacgcttgctgatgccgatggtccctgaaaaaatgttcgttgatgctgttaagcaagtggtaaaagcaaatgaagctttcgtgcctccgtatggaacaggcgctacattatacttgcgtcctttactgattggggtcggtgaaaacatcggtgtccatcctgctccagaatacttatttgttgtcttctgtacgccagtaggagcgtatttcaaaggtgggctaaaaccaacgaactttattgtatctgattacgatcgtgctgctcctaagggaactggcgcagcaaaagtcggcggaaattacgcagcaagtttacttccaggaacagaagcaaaagaactggattactcagattgtgtttatcttgatccagccacacacacgaaaatcgaagaagtaggggcagcaaatttctttgggattacgaaagacggaaaattcatcaccccgcaatcgccatctatcttaccaagtatcacgaaatattctttgctgcaattagctgaagaacgactaggacttcaagcaatagaaggagatattttcattgatgatctagatcaatttgcagaagctggtgcatgtggtacagcggctgttatttctccaatcggcgggatttatcacaataacaacctgcatgtattttatagcgaaacggaagtaggaccagtaaccaagcggttgtatgatgaattgacaggtattcaattcggggacatagaagcaccagaaggctggattgaagtcgtggaataatttcaaagtaataagttgaaaaaacgtaaaaaagaaaaaatcaggaagagactttaaaaagttttttcctgatttttatatgttttactttaaagaatgcaacaaaagggttatgaaagatggacacctttgtcaacgtagataatatcaccgatgattccgctggaaagaggactaatcaagaaagcacaaacattaccgacttcttcgatcgttacaccttgctgatcaggcgtacgagattcagataactggatcagtttttgatagtctttaacccctgtaacagctaatgttttgattgctccagctgaaataccattgactcggatgcctttaggtgaaaattcagctgccaaataacggatagctgcttcaagagaagctttcgcgatacccatcatgttataattcgggattgcgcgctctgaacctagataagtcatgctaacgattccgctatttggtgcaagaaacggttgtgcgtattttgatacagcaatcaaagagtagctactgatatcttgagctaattgatagccgtctctggaaatatcagacacatttccagacaattcttctttgttggcgtaagcaactgcatggacaaggccgtggatctctccagcatattcaccgatggcattcattgctttttcgatgctttcgtcgctagaaacatcacattctacagtgaatgcttcttcgccgaccaatttgactaatgattttttcattcgttcattttggtaagtatagataatctctgccccttgtttcaacattgcttcagcgcacccccaagcaatgctttttttgttagcgacgcccatgatgacgattttttttccttctagaaatgacataatgactctcctttgtttctgataaaaatttgatagtcgtaaaaaatagaaaataatagctaaaataacttcttgatttcttaattattagtcaaaatgttttgattgtcaaactattttttcttaaattaaaaaaagattgctaaatatttaggaatatgatactttgatagtcaaagtaatgaaaatggcaattgcctgaaagaaggagtttagttatgtcttacgtattatctgctactgaagtaatggacttgatccctaatcgttatcctatttgttatattgattatgtagatacattagaaccaggaaaaaagatcgtggcgacaaaaaatgtaacgatcaatgaagattttttccaaggtcactttcctgacaatccagtgatgccgggtgcgttgatcctagaaacactggcacaagcaggttcgattcttatcctaaaatcagaagagttcctaggaaaacgagcttatataggtggaatcaataaggccaaattccgtcaaaaagttgttccaggagatgtactgaaatgtcattttgaaatcaccaaaatgaaggggtcagtcggtacagcgttatctgcagcatatgtagatgataaaaaagtctgtgagtgtgaattcacgttcatcgtcaaccaaaatgcttgatcataaaaaagttgttatagaaaaatagaaggatgcttacctgcttttttatgtaaaaagaagacgtctgaatctagcacattttgtcatatttgctagattcagacgttatttttatgttctgtttattttgcttcttgcagtatattgattttatcaatttttacttcttcttttggtttgtctgaactatctgtttcgacatttgcaatagcatccacgacatccattccttcaatcacttgaccgaagacagtgtactgaccatcaagggaaggataaccgccgtttttataagcatcgataatcgcttgagggtaatcatcttttaaaagaccatcatgcatgtcatctgaattttgaacgataaagaactggctgccgttactattaggatcttgtgagcgagccatagataacgcacctcttatattgtaaaggtggttgttaatctctgtctcaaatccttctccccaaatgctttcgcctccagtgccatcgcctttaggatcgccgccttggatcatgaaatctttgatgacgcggtgaaaagtcaagccattatagtaaccatcttttgcgtgtgtcataaagttttcaactgctttaggtgcatattcagggaataatttgattttgattgtgcctttatttgtcaccatttcgaccaaatcttcattttcagctacatctttcgtcaattgtggcaattccaatgcattcaaatcgacactactggcagttgtactttccgcagtggatgtactctttgaactttcagcggatgaactaggagaagtcgtactgtttgcggaacaaccagcaaacaataatgctgcagctaaactaatacttaaaataactttatttttcttcataactattcctttccaatttactattttgttatctttaatgataacaaaatagaggagaaatacctacttaaattattggaatttatcatttattttaaaagaaaaagaaaaggtgtagaccatttgtcttgtctttgctataatgtaagtggatacaaaaacgaaaagatgcaggaggaaatggtaatatgggaaaattaggaatctcgatttatccagaacgatcaacatttgaaaagaacaaagcgtacttggatttagctcataagtatgggtataaacgggtttttaccagtttactgcaaatcaacgacgacaaagaaaaagttctttcagaatttaaagaagtagttgattatgcgaatagcctaggcatggaagtaatggtggatatcaatccagcgttatttgaacagttggagatttcttacgatgacttatcttttttccataagatgggtgcctatggagttcgcttagatatcgggttcaccggagcagaagaagcaaaaatgacgcgtaatcctttcggtatcaaaatcgagatcaatatgagttcgggcacgaattatgttgacaacatcatgagttattcgccaaacacggataatttattaggttctcataatttttatcctcatcgatattctggtttaggctacgaccattttgttttttgttcagaaaaatttagaaaatataatttgaatacgatggcgttcgtcaattcgcaatccgctgagtttggcccttggcctacacaagatggcttgtgcacactagaagaccaccgagaccttgagattgctacacaagtgaagcatttgatccttacagggctgattgatgatatttctattggaaatgcgtatgcaagcgaagaagaattgaaagaaatggcagaagcttttaatgcagattatccaacattgaaagtagatacggaagaagggattacagaaaacgaacgaatctgcttatttgacaacctccacagttatcgaggagatcgctcagagtatatccttcgttcgacgatgactcgtgtatattataaagaaaaagattttccacctcataatacgcgagatatgcatcatggtgatgtgctgattgataatgatgggtatggtcaatataagggagaaacacaaatcgccttgaaggacatgaaaaatgacggacgggtcaatgttgtaggaagaatttctgatgacgaactgttcctccttgactttttgaaaccttggtcaagctttaaattaattgaaaataaaaaatagataatgagttgctgcagaaataatccgctagaaatagccaattatttctgcttttttattttgtttttttataggttataaaaatgaacattgcatagtagagattctttgattatactaattcaaggttagatgaaaaaagagaaatgagatggataatttatgaaactttggatgaaaatccttctaggcgttgccctagttctaatcgttgcgctattgtttgcagggaattatttttataattatgctgtcgtgccgtctgagaaagactttttagatgaagatacaccaggtacaacacagacctccaaagaaacggatgcacataagtggtttagttcaaaagagaaccgaagaaattggacaatcacttcgaaagacggtccgaaattatcagcgatttatcttcctgctgaaacgaaaagtgaaaaaacagctctagttgctcatggctacatgggagatgctgaaacaatgaccaattatgcaaagatgttccatgatatgggctacaatgtccttgttcctgatgcaagagggcatggaaaaagcgaaggggattatattggatttggatggccagagcgcaaagactatgtgcagtggatcaacaaagtgttagaagaaaatggaaactcgcaagaaatcgttctgtatggtgtcagcatgggggcagcaactgtcatgatgactagtggagaaaaattaccaaataacgtaaaagcaattattgaagattgcggttattcttctgtccatgatgagcttgcgtatcagctagacgatatgtttagtcttccagcatttccgcttatgcaagtaacgagtctagtgacaaaagtccgtgccggctactttttcggtgaggcaagtgcagtggatcaattgaagaaaaaccagcgtccaatgctatttatacatggagacgcagacacatttgtaccatttgaaatgttggataaggtctatcgtgcaacgaagggaccaaaagaaaagtatgttgtaaaaggagccgagcatgcggaagcatacaagacagatcctgaaaagtatcagcaagtagtccaacagtttttaagccaatatgttcattgaactagtttaaatgcaagaggataaaaagaaacaagcctttgactggacccagtcaaaggcttgttttattgtttgatttattaaattacaagttagcgaatttttctagtaagcgaatcatttggcaagtgaatccgtactcattgtcataccatgcaacagttttgacaagttggaaatcgccagcagttgttacttctgtttgggttgggtcaaagatcgatccttgagttgtgccaatgacatcgctagaaacgatttgacggtcatcatacccaaatgaaggattgtcaactgtgtgttttttgattgcttcatttacttgatcagcagttactttggttttcaatactgaaactaattcagttaatgaaccatcaacgactggaacacgttgcgcatgtccttgtaattttccttgtaactcagggataactaagccgattgcttttgcagcaccagtagaatgtggaatagtgttgtcagcagctgaacgagcagcacgtaaattaccgcctcttactggtccatctaacagcatttgggttgaagtgtaggcatggactgttgtcattgtaccaacttcgatcccaaattcattattcaagaaataagccataggtgctaaacagtttgttgtacatgaacctgctgagatgattcggtcgttttcatctaatgtatcatcattgacgttatagacgatggttttcattgcaccagctggggcagaaataactactcgtttgacaccagcatctaaatgtgcttttgctttttcttcagatgtataaaaaccagtacattctagtacgatatctacaccgttttcttttacccaagggattttgcttgcgtcgggttctgcataaacacgcgttgcttcgccatccactacgattgagtcttctgttgcagtaactgtgccaggataagtaccgtgagtagagtcaaattgcaataattgtgccaacatagttggacttgttaagtcgttgattgctactacttcaatatcatctgatacttctttgatgcggcggaaagccagacggccgatacgcccaaatccgttaatacctacttttactgtcatatcaaaagttcctcctttattaggggtgctatgaaacggcatcctcaattaatacaattaatacactgttattctgctacgcaaagcatattttgtcaaaaaattatactcgatagcagaaaaatggttggaaaccttaccaaataataaaaaaagaagaaggcaatcaatctttttgctgaaatgatagacaaaaacagatttcaccgataaaataaggaagacttttgtttattgtggaaattcaggcagtcaaataaataaattgaataataggaggacttaattatgtccatgtttttagatcaagtaacgatcgatgtgaaagctggcaagggcggagacggaatggttgcatttcgtcgcgaaaaatacgttcctgacggcggaccggctggtggagacggtggtcgtggcggtgatgtcatcttggtcgtcgatgaaggtttgcgtacattgatggactttcgttttaatcgccatttcaaagcgcagccaggtgaaaatggaatgagtaaagggatgcacggccgtggttcagaagatacctatgtgaaagtaccgcaaggaaccactgtccgagatgcagagactggtgctcttttaggagacttaattgaaaatggtcaaacactagttgtggcgaaagggggacgtggcggacgaggaaatattcggtttgcctctcctcggaaccctgcaccggaaattgctgaaaacggggaaccaggacaagaacgaaaaatcgaactggaattgaaagtattggcagacgttgggcttgtaggctttccatctgttggaaaatcgactttgctatctgtgatttcatctgctcgtccaaagatcggcgcttatcatttcacgacactagtccctaacttgggaatggttactacaagtgatggcagaagttttgccgcagcagacttgccagggttgattgaaggagcttcgcaaggtgttgggctaggtacacaattccttcgtcatatcgaaagaacgcgagttattttacatgtgatcgatatgagtgggatggaaggacgagatccttacgaagactatcttgccatcaacaaagaattatctacttacaacttacgcttgttagagcgtccgcaaatcatcgtggctaacaaaatggatatgccggatgcacaggaaaacctagtgaaattcaaagaacagctgaacaaggaaaaagaagacgaattcgctgatgatatcccagtatttccaatttctggagtgactcgacaaggattggatgcgttattgaatgctacagcagacttgttagaagtaacgccagaattcccattgtacgaggaagaactggaagaagaaactgtacactatggattcaatccagaaggtcctgagttccagatcaatcgtgattcagatgcaacgtggatcttatccggtgagaagatcgaaaaattattccaaatgacgaatttcgatcatgatgaaacggtaatgcgttttgctcgtcaattacgtggtatgggtgtggatgaggcacttcgagcacgtggggcgaaagatggcgaccttgtccgtatcggtgaatttgaatttgaatttgtcgaataggcaaacaaataaaaacaaataccaaaaaatatagattcaaatctaaggggagtatggctgaggccattctccttttttattaggtagaaaagagtgcttttcttttcttattttacaattaaaggtaaaataaataacaagaaggtatgaagggggcgttttcaatgagcaagcgagtaatcattttaaattttcaagtagaaagccaagcatatcaggcattttcagaaatcaaaaaactccatgctgttcgttcgatcaaaggagaacagatggccgttgtcagccatgatcccaatggaacccatcaattcaaaatagaagattttatcgactttactggtaataacaaatcttctactggtgggttgattggtatgttggttggcgtattaggtgggccgctagggattctattaggatggtttgctggagggatgatcggtgcgacacaagatgcaaaagaaataaaagatgctcagactgtgttcgactttgtaggaaataaaatcggtgaaggagctacaggactgattttgattgcggatgaagaagacaatcgtccattgaatcaattagtgatgatggaattaggcggagaaatcacccgtttggattatgaagatgtcgaaaaagatgtgcatgatgcgaaggaagccgaaaagcaggcgaaagaagctgcccaaaagacttgggaggacaaacatccgcaatcttccgatgacaatgagagttccgaatcttcaaattaataaaaacagcagagaatctcaaaaggattcgctgctgtttttacaatggagtttaaaggagtttaaagaaaacgttatcacagaagaacattatttttatttgaagcctttctcgacttacggttgattatcctatctttttcccctaaaattaaagaggaacttaaagaaagtcaggtagattatggaattacaatttttaggaacaggcgcaggtgttcctgcaaaacatagaaatgtgacaagcatagcattgaaacttttagacgaacgtaatgaagtttggttattcgactgtggtgaaggcacgcaaatgcagattttgcgaacgactatccgtccgagaaaaatcggaaaaattttcattacacatttacacggcgatcatatttttgggcttcccggactcatcagcagccgttcatttcaaggtggggatacgccattagagatttacgggccaaaagggatagaggaatacataaaagtctctttaggcatttcgcaaacacggttaagttatccgctgaaattcatcgagttaaatgaaacagacccgatttttactgatcagcaattttctgtttatgcaaaaaaactaaatcatggaatcgacagtttcggttatcgtgtggttgaacatgatcataaaggagaattgcaggtggatcgtctgaaagaattaggcattcccgctggaccactgtacggcaagctaaagcaaggggaaacgatccaactagaagatggtcggacgatcaatggaaaagatttcgtaggcccaaataaaaaggggcggatcgtgactattttgggggacacgagaaaaacacataattctgttgtgcttgcggaaaacagtgatattctggtacatgaaagcacatttaataaagatgaagcaagaatggcgcataactatttccattccacgactcatcaagctgctgaagtagcaaaagaagcgcaggcaaaacggttgttgcttactcatatcagtgcaagatatttaggaaaagcagctctagagcttgaaaaagaagcaaaagaagtgtttgaaaacacaacgatcatgaaagattttgatagcattgagataccatttcgtgaggaggatgaggcatgaatttagaagataaagttgttttagtaacaggtagttcaggtggtctaggcgcgcaaatctgttatgaagcagcaaagcaaggagcaatcgttataagttgcgcacgaagaatggcatttgtagaaggtgtcagagacgagtgcagacgcttgagtggcaaagaggcttatgctttcaaagtagacgtcagcgatccttatagtgtggatgaactatatgaaaaagtaatggaagaagttggacgtgtcgatattctggtaaacaatgctggttttggtattttcgaggaattccttacattcgatctcggaaaagcgtacgatatgtttgaagtcaatatcttaggaatgatggttttgacacaaaaatttgcgatcaatatggcagaaagaagacaaggacatattattaatatcgcctcaatggctgggaaaatggcaactgcaaaatcaacggtttattctgccacgaaatttgcagtccttggcttttccaacgccttgcgattagaattgaaaccacttggtgtagctgttacgacagtaaatccaggtccaatcgagacagatttctttgacaaggctgatccaagcggaagctatttggaaaaagtcgggcaaatcgttttagaacctactaagttggcaaaaatgattgtccgcaatatgagacatccaaaacgggaaatcaatcaaccgtttattttagaagttgcatcaaaattttatacgctgtttccaacgattggtgattatttagccagcggaatttttaacaaaaagtaggtggaggaattgaaaaagcaaagcaatgtgattcttggatttatcttagttttgattattgttctttttgctgtattgaacaataaaaatgtccctgtaagttttggcttcacttccttttctgcaccgttgatcttagtgatcatcggttctgcgctgattggtgcactgatcgtattcttgactgcttcggcaacactatggcagcaaaaaaagcaaatcaagcagctgactcaggaaatatcagaataccaaacagatctgcaaaagaaaattgaagaagcaaaagaagaacagcaacgcgagtttagaaacgaacgcgcggagttggaagctgcttaccaggcggaattacaagcgaaaacaacacaaatcagtcaattgaaagcgccggaagaacaaaaaacgcaagtaccaaaacaaagcttcaattattttgactaatagggatatttcataaatggtcgtataaaagatcgggtcctgctgaacatcagtctagcggatctgatctatttttattctttctttctgcttttttttgctgatttcctttgctataataactaagttaggagtgagaaagtgagacaagcaaattttgattggaagttaagcgagacagagccttctgaatcctttctccaaatgatccgtgaactgaaattatctccatttgtcggtaagttactgtggcaaagaggttaccatgaggaagaggatatcaaccgatttttacatccaaaggaacaagaactacatgatccgtatctgatgcacgatatggataaagcaatcagtcgaatacaagaagctgtaatcagtggagaaaaaatcctcgtttatggtgattatgatgcagacggaatcaccagtgcaacggtaatgaaagaaacactggaattacttggcgcagaagtagaagtatttttgccaaatcgatttgagcacgggtatggaccaaatcgatcggtataccaagaaaagatcgaaaaaggcatccagttgatcatcactgttgataacggggtagcaggaaatgatgcagtagcatatgcacagcaagctggtgtagacgtgatcattacagaccatcacgaactacctgagaaattaccagacgcctatgcgattgttcatcctcgtcatccagcggggcaatatccatttccagatctggcaggagtcggagtagcattcaaagtagcttctgcattgttggaagaaccacctgcagaatttttggatttagtagcgataggaacaatcgccgatttagtttcattgactgatgagaatcgaatccttgtttcattaggaatcgatgccatccatcattcagaacggataggacttcaggcgctgtttgaagaaagcggcataaaaatgagggatgcagacgaaacaacgatcggcttttcgattgcgcccagactaaatgccattggtcgaatgggcgacccgcgacctgccgtttcattgcttgcaacgtttgacgaagaagaggcatccattcaagcaaaaaaattgaatgaaatcaatgaagaaagaaaagcaatcgtagagcagataacagaagaagcattagcaatggtcaataaggagaatcatatccatctattggtaaaccgaggatggcatgaaggtgttttaggtattgttgcaggaaaaataatgaacgaaactggtaaaccaacgcttgttcttactttaaaagaagacggatcagctaaaggttctggacgtagtgttgaagccttgaacctttttgaaatgcttgaccagatgcgggatctatttacttattttggaggacatcatgcagcagtcgggttaacgatgccaagtgaaaatgtcacaatactacaggagaagatgaaccaatatatagtcgatcgtcaaatcgatttgacaagaggacctgaattaagaattgatgaagtgctacttccgaatgaagtaacagtagagcgtattgatgaactaaaattattagcgccatttggtacagataatcctttacctcaatttttatttcggcaagtccaagtagcgaatgtcaaaaaaatcggagcaaaccaacagcatctgaaatttgtcctttccgatgaatctagtcagcttgatgcggtcgcttttggttttggaactcaagaagaagaactgctgaataatctagtagatgtagtaggaaagctttcgatcaatgaatggaatggacgtaagaaaccacaactgatggtatctgattttgcagtaggtggtctgcaggtatttgattggcgggcaaaacgtttccgtgaacagagccgaacatctgaagacagtctttatttagcttttgattcttcgacgttgaaattcgtgccggagcgcatccaagaaacggcgattgttttcgaaggaatggactttatacaagcagtaattgaaaaaagaaaaccgaaatctctggttattatggattgtccagatgatttagcaaagctgaaagaagtctttgggtcttattcattcaatcgtgtttatctgatggggatttcacctgatgaggcttatttgaatggggtaggcacaagagaacagtacgcaaaattgtttaaattgatccattctcaagaacgaatagatatacgtcataaaataaaagcagtagctcaatatttgagtatccctgaaaaattattaatttttatgatacaggtgttttttgaattgaaatttgttacaatagagaacggtgttttacaaaaagtcgccagcccagaaagtcatcctttgactgagagcaaattataccagcggcggctaaataaaatcaaagttgaggaatttttgcttttgagcgatattcctaccataaagaaatggttaacaacctaggaggaaacaaagagtggatttaaaagattatattgccagtattcccgactatccgtcaaaaggaattgtgttcagagatatttccccgctgatggcagatggtgatgcttatcgggaagctacgaagcaaatcgtaaattatgcaaaagaaaaacgaattgatatggtagttggaccagaagcacgtgggttcatcgtaggatgtcctgttgcttatgagttaggagtcggttttgcaccagtccgcaaaaaaggaaaattacctcgagaaaccatcgaagtgacttatggattagaatatggaacagatacattgacattgcataaggatgccattaaaccaggtcagcgtgtgctgatttgtgacgatttgctggctacaggtggaacgatcaaagcgacaatcgaactgatcgaacaattaggtggtgtagtcgtaggctgcgcatttttaatcgaattgatggatctccatggacgcgacaaaatcaaaggatacgacattattacattaatggaatattaagcagaaaaagcgatttatgatttataatttataaagaagcgattttgaagcgaccctcaaaagtcagataggcactctgacgcttgagggtcgctatttttttataaatggagccagtcaaagtccagtaaaagttcgaaaaaaaggatgtgaccgttttttgtcacaccctcgtaaaagtttaactttttgtcttttgaacaattagcagtcaatcctcattatgattgcctggatctgtagtagggttcatgatagaaatgatcttcatgaattctgcgccgctcagattgacggtacttcttttcatcccacaacatgaaccacaaagtaaataacggaacaaacacaagtaaagctggacgtatgccgaaattaccaataataatacctaaaaacaaaacagttaatactaagccaagacgtctcattgatttcatgaattctcacctcgttaatttatgcgaacaattgttcgtatatttagtatacgaatatttgttcggtttgtaaagagggaagcgataaaaatttgaaagaagaagaacttggacgaaaaaagagtttgagacaatggtctcaaactcggttttaaaaaatttcttttttagtactaattaatagatatgactacgataaagccctactactcgtcctaatatagatacttgatctaaaattattggttcgagtaagtcgttttcaggttgaagacggaagtagtttttttctttatagaatcgtttgcaagtcgcttcatcctctgcagtcattgcaatgacgatatcaccgttttgtgcagtttcctgcttccgaacgatcacgttgtcgccatccaaaattccagcattgatcatactatctccacgaatcgtcagcataaagagactgccttcttcagaagaaagattaggagggatcggaaagaagtccgaagcatcctctactgctaaaattggttctccagctgttactacgccaagtactggaatagttgttggacgaatcccaatcttttctaaaccttgttttgtcaactcgattgcacgaggtttcgtcggatctctttggataaacccttttttttcaagccgtgcaagatgaccgtgaacagtagaagtagaagaaagctgaacagcttccccgatttcacggacagttggcgggtatcctttttgggttacttgttcatggatataacgtaagacttcaatttgtcttgattcagtttgtcgggccacaaggtacaccttctttcacttgataaataaatagtaccatataaaaagcgctaaatcaaacgaatgttcgtattttatttagtttatctagttgtttttttttcagtttttatataatatgaaggagagtaaaaggagggctgagcatgctgtcacctgaaaaaatagagcggatcaatgaacttgcacgtaaaaagaaggaaaatggtctctcgaaagccgaagaacaagaacaaatcaacttgcgcaaagagtatttggaagcttttcgttccggtatgcgtcatcatatcgaaggaatgaaaatcgtcgatcctgagggcaatgacgtgaccccggaaaaattaaaagaaatccaaaagaaaaaaggcttacacaaccgaaatgacaacttttagtaaaaaatactgaaaatgattgctttttcgtttgacatcttatagaatgagagtgtaagaaataaaggtaaaaaaaacctaaattaataggaggggttattttgtttgacaaaattgaccaacttggcgttaacacaattcgtacattaagtattgaagcagtccaaaaagcaaactcaggacatcctggattgccgatgggcgcagcacctatggcatatgcgttatggacaaaacacctgaaagtaaatccaacgacatcgaaaaattgggctgatcgcgaccgtttcattctttcagcaggacatgggtcagcaatgttatatagtttacttcatttagctggctatcaagtgacaattgatgatttgaaacaattccgtcaatgggattctaagacaccgggacatcctgaagtccatcatacagatggtgtagaagctactacaggcccattaggccaaggaattgcaatggctgttggtatggcgatggcagaagcacatcttgcagccacttataacaaagaaaacttcaacgtaatggatcactatacgtatgcaatttgtggggatggagacttgatggaaggagtctctcaagaagcaagttcgatggcaggtcatatgaagttaggtaaattaatcgttttatatgattcaaacgatatttcattagatggtccaacttcaaaagcgttcacagaaaatgttggtgctcgttatgaagcatatggctggcaacatatcttagtgaaagacggaaatgacctagaagcaatctctaaagcgattgaagaagcaaaagctgaaacagataaaccaacgttgatcgaagtaaaaacagtcatcggctacggtgctcctaaagaaggaacatctgctgttcatggtgctcctcttggtgaagatggtatcaagatggctaaagaagtttacggatgggattatccagacttcactgttcccgaagaagtagctgcccgcttccatcaaacaatgatagaagaaggacaaaaagctgaagatgcgtggaatgaaatgtttgccaattataaaaaagcttatcctgaattagcacaacaatttgaagatgcctttgatggaaaactgccagaaaactgggatgcagaattgccaacttatgaagtgggaagcagtcaagcaagccgtgtttcaagtaaagaagtcatccaagaattatcgaaagctataccaagtttctggggtggttcagcagatttatcaggttccaataatacaatggtagctgctgataaagattttactcctgaacattatgaaggacgtaacatctggtttggcgttcgcgaatttgcgatggcttcggctatgaatggtatccaacttcatggcggaactcgtatctatggcggaacattctttgtctttgtcgattacctaagaccagctgttcgtttagcagcgattcaacatacgcctgttgtttacgttttgacacatgactccgttgctgtcggagaagacggaccaacacacgaaccgattgaacaattagcttctgttcgttgcatgcctggtgtccaagtgattcgtccagcagacggaaatgaaacacgtgctgcttggaaagtggcgatggagactactgatgcgcctactatccttgtattgagccgccaaaaccttcctgtattgccttctacaaaagaagtagcagatgaaatggtcaaaaaaggcgcatacgttctttctccagctaaaggagaaacaccagaaggtattttgattgcaactggctctgaagttgatttagccgtgaaagctcaaaaagaattggcagaaaacgggaaagatgtttctgttgtctctatgccaagcttcgacctgtttgaaaaacaatcttctgaatacaaagaaagcgtacttcctaaagcagtgaagaaacgcgtggcgatcgaagctgctgcatcattcggatgggaacgctatgtgggtacagaaggaacaacgattaccatcgatcatttcggtgcatctgctcctggtgctaaaattttagaagagtttggatttacagtagaaaatgttgtgaatacgtacaatcaattatcatagacaccaatcattgtttgaatgataaagacagctgtctgcaagttggaggcagctgttttttatgtggtggtaagaataaatcaatgttacttttcgttttcttttatattacatttaaatgacaaaacaaagaattcttcggattagtttgtgtttcttgagaattaaaagtataatttaattaattaagtttgttttaagaagagaactttttagtaagtttttttattttgaggaggaatttgaatgcaagagctgaagacccgcagtgcccgacaccatagacctaaaagaaacatggtgatcaataaaaaagcgattgctcctttaattggaacgagtcttttagttgggccgatgatggttacagcggtaccgcaaagtgttcatgcagatgaacaaggatctcaaacagttgctgatcctcaagcgtttatcgatcaaatcggctggtctgcatcagaagttgctgcaagtaatgacttgtatgcttcagtcatgatcgctcaagcgttgttggaaagtgcatatggtacttccggattagctagtgcgcccaattataatttgttcggtgtaaaaggaagctataacggacaggtcgtttatatggcaaccaaagaatatgtaaacggacaatgggtaacgatgaatgaaccattccgaaaatattcttcttattgggaatccttccaagaccacgcaaatgttcttcgttcaaccagtttttcaacaggcgattatcattatgctggtgtatggaaaagcaatacaacaagtttttatgatgcaacagcgtacttgacaggtcgttacgctactgatccagattatggaaccaaattgaactcattgattaatacttataatttaacccgttttgatacaccatcaactggttcggcgacaacaacaactacaagtacaacaacaacaactactacgacgacttcaacgtcatcatcatcgtcgacaacaggtacggatacaaatagtagtcaaacatatacagttgtatcaggagatacgctatgggatattgcacaaaaatttggcatgtctgttgatgatctaatggcgaaaaacggcatgtccatgtccagttattctttattagtcggacaagaattaaacgtgtgatttagataaaaaggcaaagaaacgaccatatctggtatatctttgtctttttttttactagtcaaagacgaatcactcgccagaaatgaacagattgtattatgataagtagggaagagcaaagacaaggaggaattgaagatgacagctatctataactcagtcaccgaattgattggtaaaacgccaatcgtcaaattaaataaactcgtaccagaagattcagcagatgtatttgtgaaacttgagttttttaatccaggaggaagtgtaaaggaccggattgctctaagtatgatagaaaaagcggaacatgatggattactgaaaccaggagatactatcattgaacctacctccggaaatacaggaatcggattgtcgatggtaggagtcgcgaaaggatataaagtcattatcgtgatgcctgagacgatgagtatcgaaagacgtttattgatgaaaggatacggcgcagagttgattctgacgcctggtgtggatggtatttctggatccattagagaagcagaacgtttggcaaaagaaaatggctactttttaccattacaatttgaaaatgaagcaaatcctcttgtacatgaaaaaacgactggtccagagattcatcaagcctttggagtaaatggattggacgcttttgtcgcaggtatcgggacaggtgggacaatcactggcgctggccgagaattaaaacgtgtgtatccaaaaatcgaattagtaggggtagaaccggcagaatctgccattttagaaggaaaagaagcgggtcctcacaagatccaaggaatcggtacaggatttgtccctaaaacactggatacctctgtatatgataaagtcctttccgtgactggtaacgaagcgatggaaacagctagagaagtcggacgaaaagaagggattttagttggtatctcatctggtgctgcaattgctgccgcattaaaagtcgcaaaagaactagggaaaggcaaaaaggtattagcagtcgttcccgacaatggtgaacgttatttatctacagccctttaccaagaaatgtaagtaaacttgtttctctataaataggtttatgtggaaggcttttacagatgaaaagagaaaacacaaaaatctatgataagaaaagagttagttgaatagagacgtagaatggtgaacatgactgttttacgtctttttttcattaaaatacaataaaattgaattttcttttcatgttaagtggattttaaaatgtaaaaatagtatgataagacgagaataacaacgtggggtgtttacatggaaaataagttagtcgaagaggttatcgaaaagttaaaaaaagagaacattcgaatcacacctcaacggtatgcggttttagaatatttgattgaacatcattcccatccaacagctgatgagatttataaagcacttgaacatcgtttcccaaacatgagtgttgcgaccgtttacaacaatcttcgtctgtttacttcgattggatttgttcaagaaatgaagtacggcgatgcttctagtcgctttgatttcagctcaaagcgtcactatcatgtgatttgcgaaaactgcggtaagatcgttgattttcattacccagggttagaagatatagaaatggctgcgagtaggctgactgattttgagattaacgaacatcggttggaattgtatggactttgtccagactgtaaagaatcagcaaaaaaggcacaaatgtaaaacagtttctacaagtgttacacctgaaaaagctggctacgtaaaaaaacgctagctttttttatttttttgtcttttattcacaaggacaaacgttaaagtgaatgttatcacaataagaatcttgctaacaatggatttctatgattgtaaatgagtaaaactacaaataaacctttgtgaattcacaagcattaaactgttgtatccgttttatttctgttatagtaattttgtcgaaggacaaaatgttaatcggagggaccataaatgaaagtagtagtaattggctgtactcatgcaggtactgcagctgtaaaaagtattttaaaaaatcatccagaagcagaagtgacagtgtatgaaagaaatgacaatatttctttcttatcttgcggtatcgcactttatgtcggcggagtagtaaaagacccagcaggcttgttctactcaaaccctgaagaattatcttcattaggagcaacagttaaaatggaacacgatgtaacagacgtcgatacagaaaacaaaacagtgacggcaaaagatctgaaaacaggagaaacagaaacggtttcttatgataaattagtaatgacaactggttcatggcctatcatcccaccgattagtggaattgatgcaaaaaatgtactcctatgcaaaaactacaaccaagcaaatgaaatcattgcacaagcgaaagaagcaaaacgtgtagtaatcgttggtggtgggtatatcggtattgaattagtcgaagcttttgtcgaatctggaaaacaagtaacattgattgatgggttagatcgcatcttgaacaaatatctagataaaccattcacagatatcctagaaaaagaattgacagaccgtggtgtcactcttgcattaggtgaaaatgttactgaattcatcacagatgaagaaggaaaagtgaaacaagtagctacaccaacagatacatttgatacagatatggtcattttatgtgtgggcttccgtccaaatacaaaactgatcgaaggaaaagtagagacactgccaaacggggcaatcaaagtaaatgaatacatgcaaacaagtgatccagatatttttgccgctggagattcagcagtagtcaactacaatccaagtggcacacaaaactatattcctctggcaacaaatgccgtgcgccaaggattgcttgtaggaaataacttgacagagcataaaatggcgtatcgtgggactcaaggaacttcaggactttatctctttggctggacgattggctcgacaggagtgaccaaagaaagcgcaacattgaacgatctagaagtccaagcaacggtatttgaagacaattatcgtccagagttcatgccgactaccgaaaaagtaatgatggagttagtttatgaaaaaggcacaaatcgtatcgttggtgctcagttcatgtctaaatacgacattacgcaatcagcaaatactatgtctttagctgttcaaaataaaatgactgtagaagatcttgctctttcagacttcttcttccaaccacattttgaccgtccttggaattacttgaacctacttgcacaagcagcgctaggcgaaatcgaaacagcacaataaagaaagacagacgagagcggttaggaaaaagctgtttagttttgactaaataccgtttattttggaaaaagggttgtgacgtattttttgtcacgaccctctgtctttttgtgaaaagtacaattagttgtctttcttcgcattttttgtcacaataagcaacaaagataaagctgttacgtaaaagaacaagcagttttacttgaacttgaaaagaaaggtgagaaagaaaatgaataaagaatattttgtccaacaagatgcatttttagaagattataaaaatgttgcgaaggagtcgacgatcaatatagacgagttggcggagcaagtgctctctcaattgaatgaaacacaagaggaatattatacgatgccagcagaagatgcgaaagataatgcttctcatcgttttcctttcagtcggcgtatctactcagatgaaaatgacggcacattgaatacggagtacacatatgaaggacagccgtatgaactagaaacagaagatgatgtttaaacaccgtttattcggaaaaaggggttatgacatttttgtcaaaccccttttttcttgatttcattctcttttttactacaaaaatccttttaactttgttgtttaggaaacaaaaaaataatataatgaaagaaaaagaaggtgtagaaatggataaaagacagctgctaatagaagaatatctggaattagctaatgagattattcatcgtaataaaccagaaatggaaaaagaatttgcaggatttacgctaaatgaactagaagtgattgaacatatcgggaaaatccctgatcctaacgtgacaaaattagcgaatgctagttatatgactagaggagccatcagtaagctaacaaaaaaactgatagccagagggatcataaacacttatcaaagcgaagagaataaaaaagaaatctattttcaattgacgccaatcggacaaaaaataaagaatagacacgagcaactacatcaaaaatgggtccagcgagatgctgctgtatttgaaaatatgtcaaaagaagaatttgacacagtatttcgttttatcggtcgatacagagaatttatacgaagaagcaaatgaaactaatgttttatattgtaataataataggcaaagattataagcaaaaatccgaataccgtcggaagaactggtgctgcggcataaagctgtcctgcgattagcgggccgatgacgcgcgatagagattgtatactttgggtaccgcccattacaagaccttgctggttttctgaaacagaattggatagttggccattgaatacaggagtaaaaatagaatcgccgaaaccataacagataatcccaaataaaaacaaaaccggcagtagaagaattccagataatgtgatgaatagataggcgaggatttcactgcacattcctattcttgtgatctgctgttctgaaaattttttgagcaatcgaggcataatgaataattgcgagacaatatccaagattccaatcaaagagaagcttaaaccaaccaaccccgctttccactgaaaggtgtcaatcgaaaattgagaaaagatagattgcagagagccagccgctaaccaaacagcaaaaccgactgtcaataaaggaataacggatgaaatcttgaataattgttgtaattggtgaaaaggtcttacatgggagaaacttaaatctactgaacgtttttttattggaaggctttcttgcataaatgtgtagccataaacggcatttaagaaagtaaagagtgctccaataaatataggaacagaatttcccaattcagctaatagaccacttataataggaccaagcgttgttcctataccgactaaagcacccatccatccaaaaactttggttctttcattaggttccgtgatgtcggcaaagtaagcatataaggtggagatttctcctgctgtcaatccttcaatgatacgaccaaggaacaacatccatatcgaatttcctaaaccaaaaatcaaatatccaatacttgatcctaataaactgataataaggatcggacgacgcccgaaatgatcacttaagctaccgagaatgggggcagataagaaggcagctagagcataaacagacatgagcaaagtgatatagaaagcttgctgatgtgcggagtgggaataaggaagcactaaaaaaggaagtacaggactgacgatagtaaatcctaatccagtgaataagacagaaatatatccaaaaactttagaatgtttatttgtgaaactgaacatttaaaaaactcctttatacaataatgttaactcggaaacaaaaaaagtttacagtaattttgtttccttgtcaacattatgaggagcagcgaaatctacttgacttatttattccgaaaagtgaaaatgcacatcaaaaatataaacaaacaaaaatcaagtagacgacactataaatctgaccgatcagtgaagcaatagaaaagaaacctgttcttgcttcccatgttttttttacgtatactgtgattgagcggaggagaaatcatgttgaatttagaaaaatacttaagcgctggacaaacagtcatatctaatcttttacttaaaaattatcataggatcggtctgcaatctgaagaatttttatttgttctacagttgcacatggcacagcttgaaggagatactttccctgatttgcagatgattgctatagatatgggaatcaaacaagaccagatttttcaaatactggatcgtctcgtaacaaatggatttatcaagatagaaacgacgattgtcaatggtaaaaaagcagatcgatataatctttaccctatttatgatcaattaggtgagtatttaataacacaagaaaaaaaatacgaagaaaaaatacaagaaaaagaaatccagtcagtgtatcaattatttgaacaagaatttggacgcccgctttcttcgatcgagttccagcggattggtcaatggctagaagaagaccattatcagccggaaattttgaagctagcactacgggaagccgtattgaatcaggcttatagttttaattacattgaccgcattttgctatcgtgggaaagaaaaaatctacgtacaaaacagcaagtagaagaagaccaaaaacgaaggaaacagcaacttcttcaaagagaagtagaacagccgactcaacaagaagaattgccaaaagtttcgctgaaaaattggttggaggagtagcagaatatgttaagcaaacaaaagacgatggaagctctagaaacgatgtatgaaatgttcccagaagcacacggagaactgaaacacaataatccatttgagttattgattgcagtgatcttaagtgcccaagcgacagatgtatcagtaaataaagcaacgccagatttgtttgcctccttcccgacacctgatgcattagcagatgcttcaatcgatgaaatcatcctcaaaataaaaacgattggtttgtatcgtaacaaagcaaaaaatatcaaagcgtgtgcgcagcagctgattgaacgtttcgacggacaagtaccaacgacaagagaagaattgatgtctcttcctggcgtgggcagaaaaacggcaaatgtcgtattaggagatgcattcgggataccagcaatcgcagtagatacccatgttgagcgtgtttcaaaacgactgaggatctgcaaactagatgcctcggtcatggaagtagaagaaacactgatgcggaaagtgccgcaagaattatgggtaaagacacatcatacactgatttttttcggtagatatcattgtacagcaagaaatcctaagtgtgaggtgtgtcctttgctatcaatatgtcaagatgggaaaaatcggatgcgcctaaaagaaaagacgctaaaaaagaaaccacgcctgtagacgtggtttcttttttctatctgtttccagaagctgaggtgctactggatggtgtatggtcatttgcagcatccgcttcgctagttgctggttcactggaagaaggaagagtagatgaagacggcgtcgagctttcttcagatgaagaagaaggaaccgtcgttgatgacgctggctcacttgtctctgctgtcgtgctttctgttgaggactcagcggttgattcactttgactagtagagctagtttgagtcgtcgtctctgttgttgagctttcaggagcctggacatagctggaagaaggaatagttgttgatggcgcaactgtatttgatttcactgtatattgatccttatagtacagttcaccgcccacacgaatcaaaccgcttggcatctcccagtctgtatttgtcacgttagctgaaacatattgcataagctcgcgataaacatcagaggccacgtgtgacgattctgaagtgacaggtgtcattttcttgttgtaacctgtccacacggaaatcgaataatttggtgtatagcccgcaaataggatatctggatatacaccagaagaaataccaagtttcgcatattcatcatctgtataatttgatgttccggtcttaccggcttgatataacccagcgatttgcgcattcgtaccagtaccttcagtgattgtatcttttaaaatgtctgtgatcatataagctgtttctggagacatggctgtttttccatcaggttcataagtttcttctgtaccgtcttggaagacgattttattaacatattgaggtttgtaataggttcctccattggcgaaagccgcataggctgctgccatttttaaggaagaagctccgtattttgtcccatcttgttcttccgtattactagagatcgcattcgattgatggatcgtgctgtattcgatcccaagattttttaagaaagaagccactttatctgaaccgacttcattgaataatttgactgctggaacattacgggataagtaaagtgcttggcgtaaagtaatggtgcccatatattgattatcccagtttcctacaggagtagaagtgccttcatagttatacggcgcatcagtgatagtttttccagtagaatatttcaaatattcaaaagctggtccgtaatctgtgacaggtttcatcgtagaaccaaaatcacgggaagtattcactgctaagttgttgcctaaagtcacgtcttctgcgatgtgacgcccgccaatctgggctttgactttcccagtatttgtgtcgataagcgtggaggcaacttgcatctcgtcgtctggataagagacatactgatccgtattgacgatatcatatagtttcttttgagcatccagatccaaattcgtataaatctctaaaccgtctgtgtagacattcttatctgttttttcttgtacttcattgatgacttctttgacataattatcgacgatcttagtgttgtcatcagattgagttagctcttgcaaaccatccgttaccggtacattgacagcttgatcatattctgtttgagagattttttcgttttgaagcatcgtatacaaaacagtatctcgtcttttcttcgcctgatcgggataaacataaggatcataggcagaaggggcttgcggcattccagcaagcaatgctgtttgtggtaaagaaagttctgatagtttcttaccaaagtacatctcagaagctgtctccatcccgtacaaaccatttgacatgtacactttatttacgtagtaggtcaaaatttcttgtttcgattttttctgttccaatcttacagccatccacgcttcttgagccttacgtttcagggtctgatcctcggcgctggtggagaagaaggacagtttgatcaattgttgtgtcaaagtacttccgccttgtagaccgccagaggtgaaattagaaagggcagaaccgatgatccgaatagggtcaaccccgatatgtttataaaaacgccgatcctctactgacacgatcgcatcttccaatgttttcggtaattcatttgcagaaatcttttctcgcttttccgcacctagatcttcgaataattcgccatcttgtgtatataatttggaagatacggtagcgtccaattttttatctgtcaattcgggtgcatcttttgcgtaataccagaacagtcctacacctgctaaaaagaggatacagaaaaacgagaggatgcctaaaaggattttaataaataatccttttttatgtggtccagaagtcttcccagaacctttgccagaattcttcttcacactctttttaggagtaggctgtttctgtcgtctagagcttctagtttgttcatttgccattcttgctttctccttcaatagataatgttgataaatagaagtcaaccgcgtccaaataaggaatccgcggagaaataccagttttgatctctattcctagttcttcgatcaatgataaaggcagtgatttgcgtcctttttccttttgagcatcccagtaagcaatcaaatgaacactattcaaataaaaacagcgtttcaatgtcgaaaaccataataagacaaagcagactcctttttgttcgaggcatgctttcatgtgttcgatttgatgggcatggaagtttttaaagggaaacgatgttttgttcttggtttcttttgcttcaaagtccaagtaaaagcctcgatagacgccattatagtctgtggttgaggcttgggtaaagtaggcttctttgattacagcagcgcttctcttaggatagtctactttcacgatttggataggggtaggctttttatggataactgccaacccgcgggaaagataatactcattactttcattgattgcttcttcaaagcgcatcccccgattgccgaattcggtgatttgttttcttttttcttgaattttttcgacgggagaggcattcttataataaggttggccgtttggatagcgcaataccatctttaatcacactcctaggccacattatagcaaaaaagcagatagaaagaaaaggaatctgagatggataagtcaaaagtaatctatgtgtctgggtatcgaagtttcgaactcggtgtttttaaagaaaatgaccctaaaatccaagttgttaaaaatgttttaaaaagggaactccgccagttagcagaagaaggggtggaatgggtacttgtcagtgggaatttgggcgttgaactatggaccgtgcaaacagtagcggaattgaaagaagaatatccggaactttccattggtattttgtatccttttgctgattttggtaataactggaatgaagggaaccaagagaaaaaacaattagcagagcaattagcagattatgtcgaagctgttagccatcaaccctaccaatcacctagtcagctaaagaatcatactcgttttatacttgaacatacagtaggctgtctgctgatctatgatgaagaattccctgggaaaacgaagtatttttttgaagatgcacagaattaccaagcggatcatccctacgaaattcggctgatcagcatggacgatcttcaaaattttagtgaataatcgatattgtgtttgatttatcaacttttttcctatacaatgaaaaaggtagaaatgttattacgtaaatgaaaactagaggtgtaaatatggcgaatttggtttatagtcctaaagacattttacaacaagaattcaaaacaaaaatgcgcggctatgatcccgttgaagttgatgaattcttagacaatatcatcaaagattatgaaacttacagcaaagaactccttgctttacaagaagaaaacgatcgattgagtgcaaaagtagctcaattatctaaaactcaaggagcagctcaaacacgtgtgcagcaaacagaagtaccgaagagcgcagcagtaaccaatttcgatatcttaaaacgcttgtcaaaccttgaacgtgaagtatttggtaaaaagcttgatcaacaagcaagtgcagttaaaccagcacaacctaatccaaataactacacaaatgcagatacaagcttagatgataatgaaaaaacacgtcaattttaatttttgactaatgaatttgcggttttcgggtaatcgcggtctgacttgatcaggctgaggaaagtccatgctcgcacaggctgtgatgcctgtagtgttcgtgcttagcgaaaacataagctaaggtactctttggagtaacggcaggaaaacaagctaaggcttcggctatgcttaagtattcttgaaagtgccacagtgacgaagcggctggggaaacccatccggtggaacgcggtaaacccctcgagcgagcaacccaaacaatggtaggggcgctttttgtttggaagaagaacaagacaaaaaggcagtacaactgcagatagatggttaccactttgctttttctccctggaaaagcaaagtacagaacatggcttatagaaaaccgcaaacatcagggaataaggtcgtgacaaaagtattttgttcttattacaaaacagacttttgtgtcaccggttattcggagtttgagtaaaagcgtggggtaggactgactgatgtcccacccccctttttttataaataaggagattatgtatggaaaaaaacaggaaattcaacctcgtcgcaactgcggcaagcggtctcgaagcactggttggtaaagaattaagagatcttggaattgaatgccaagttgagaacggacgtgcacgatttgaaggaacaatggaaacaatcgctacagctaatttatggttacgtacagcagatcgagtaaaaatcgtggttggggaattcgatgcgtatacgtttgatgaattgtttgaaaacgtaaaagcattgccttgggaagattttcttccactagatgcagctttccctgtagctggaaaatcaatcaagtcgaaactatatagtacgcctgattgccaggcaatcacaaaaaaagcaatcgttgaacgtcttcgcacgtattatcatcgtccagcttctgttccgctgacggaaacaggcgcacatttccaattggaagtagctttgctgaaagaccatgtgatgctaactttggatacgacaggaccaagtttattcaaacgtggttatcgcttagaaaaaggtggtgcaccattgaaagaaaacatggcggccgcgcttgtgatgctgacaaattggcggaaagatcgtccattttatgatcctgtatgtggttcaggtacgctttgtattgaagcagccttaataggccataatatcgcaccaggattcaatcgtgagtttgcttgcgaatcttgggactggttcagtcaggaaatcatggaaaatgttcgatcagctgcagaagaaaaagcagattatgatattgtattagatattactggttcagatatcaatggacgaatgattgaaattgccaaagccaatgctgaagaaatcggactaggctcttcgattgtctttaaacaacaagcagtgaaagacttcaagacagataaagaatatggggtcatcgttgctaatccgccatacggagaacgactaggagaagaagaaaccgttcgaaaattatataaagaaatgggcgatgtattccgtccattaaaaacatggagtaaatatatcttgactagcgacttagcgtttgaggaattttacggacaaaaagcaaccaaaaaaagaaaattgtataatggtgctttgcgtacggatctgttccagtattggggaactcgtccgcctagaaaaaaagagaaagacgaataatctgactaattgattcattcaattggatgtttggaggaatagggaatgaaagaaaaagagtttttacaagaagtaaaagaaatcaatcttctacaacaagctttaggaatcctcgattgggatacacaaacaggtatgccagaaaaagctagtgaataccggagtgaagtagatagctatctttacagtatttatttttcaaaaaagatcggtccaaaaattaaagaagccattcgctatttttctgaacatccggaagaattatcggaagtcggaacgtccgtttttgacaaagtaaaagaagagtatgatttagaacatcgcgtaccggaagatctcatgagaaaatatacagctgctgtttcttccgctcatggtcaatggcaaaaagctagagaaacacaacagttttctgattttcaagaatcattgaaccaaaatatcgaattgacaaaacaattgataccttattggaaaaaagaagaaaagacagattatgatgttctacttaaccaatatgaacctgggatgactgttgaaatcctcgataaggtatttgatcaactcaaagaaggaattcttacgatccgccgtgcgctccaagaaaaagggacggaacctgaaacagacttcttaaatcggagaatgacaaaggaacaacagaagagatttgtagtaaaagtgatcgaacaacttggttatgattttagtcgtggtcgtctagatgacactgtccacccatttatgactggaatcaatccaaatgatgcacggatcacgacacgctggaacgaaacagatttcaaaatggctgtttttggagtgatccacgaggctggtcatggaatgtatgaacaagacatcgatgataaatatgcttatacaccggtttatcaaggcacatcaatgggtattcatgaatcacaatcgttgtttaatgagatcattgtgggaagtagtcgcagcttctggaaaaagcaatatcctttcttccaggaatgtgcagaaggaacattcgatgatattccttttgacaagttttatcgttcattgaaacatacacaatcaagtttggttcgtatcgaggcagacagtttgacttaccctctccatatcatcattcgttatgaaatcgaaaaaatgattttcaatgaaggcgtaggtgttgctgaattacctgaaatatggaatcaaaaatatgaagagtatctgggaatacgaccaacaaatgatgtggaaggtatcctacaagacgttcattggtcaggtgcaagctttggttattttccatcttatgcattggggtacatgtatgcggcacaattacttcattctttgcagcaagaaatagatgtggaaaatgttctagcgtcagatgattactctccaatcaaaaattggatgtcagagcatatccatcaatatggtgcatctagaaagccaaatcaattgattatggatgcaacgcatgaaccacttaatccgcaatatctgatcgattacatgagagagctatatttcaatgtatatcaagtaaaataaaacctatttataaagatagctggaattcatctaatcgattagatgttttcagctatttacttaagaaagaagtggactggatggataaattacaagtaatcgctgattatagcatggaaaaattagcacatgatcaaacgggacatggaagcgatcataccaaaagagtcgtcaagctagcagagagaattttggatacggaaccgcaggcagaccgttttgtgacgcttgcagcagcttacttgcatgatacgattgatgataaagtcgttaaagatgagaacgaagcaaagcaacagcttcgtgtatttcttcgctctttgccaatcacagaggaacagatttcaatgatttttgccattatcgaaaatatgtccttttctaaaaatctctctgaagcagtcgaactatctttggaagggaagatcgttcaagatgctgatcgtatcgaagcgttaggagcaatcggcattttgcgaactgcttatttcggtggaggacatggacacccgatttttgattctgaactgtatccacaaacattcaaggataaaaaaaattaccgaaaaggcacgacagtgatcaatcatttttatgaaaaactgttcttgttacctgataaaatgaacactgattacggatacaaagaagccaaacgtagagaaggctttatgcgtgaatttttagaagaattttttctagagtggtctattgacgatccatctttcacaccagaaaattggatcaaaaataacaaaaaatgatggagattgtgaccgaggagttggcaggagaacaccgtttattcggaagaagggactgtgataagacatttatcacagtcttttttcaaattcaatataaatattttgtgaaaaaatgatcagataataagattaaaaattgctgataaataaagatgaaagctttttgcttatttttttattttttattggtctatgcgataaatagtttaaaaattcagaatatactagattttatctagctagcttccaacaatggttttgttgtgttttctttctaggtaaatcaatataccaccattatttaaaagttaacttttcatactatccaagttcttggaaagtaaaaagatgcagtaaataaaaaatatggttaaataactctcataattaatgtaagcgttaccaaccgtgtggcatacttgcttcgtagatgaatgacaagatatatgtttgggatgttctgcaagacagatgaatatggaggtggagaccatgtcttccaaagagttaatgacgtatttggagagagaattggagcaactgaaagaaaagggattgtacaacacgatcgatatactagaaagcgaaaatggtgcttgtatcatcgtagacggaaaaaagatgatcaatctggcatccaacaattatctcgggtttgccaatcacaaagaattgaagaaagcatgtattgaagcaactgaaacttatggcgtaggagcaggtgcagtccgaacaatcaatggctcgctgaagatccatcaacaattagaagaaaaaatcgcagaattcaaagggacagaagctgcaatcgcctttcaatctggattcaactgtaatatgggcgctatctctgcagtaatgacaaaagaagatgctatcttatcggatgaattaaaccatgcatctatcattgatggatgtcgtttatccggagcaacaatcatccgagtcaaacatcaagatatggaagaccttgagaataaagcaaaggaagccgtagaaagtaagaaatataaaaaaatcatgtatatcacagatggggttttctccatggatggagacattgcacgattgccggaaatcatcccaatcgccgaaaaatatggactcatcacctatgtagatgatgcgcacggctcaggtgtaactggaaaaggtgcaggaaccgtcaaacattttggattaagcgacaaaattgatatgcaaatgggtacgttatcgaaagctgtaggtgttgttgggggttatgtagctggttcaaaaacactgattgactggttgaaagccagaagccggccatttctattttctacctcgctaactcctggagcagctgcatctgcgttggcttcgatctctttgatgcaagaacatccggaacttgtcgaaaaagtttgggaaaatgctaattattttaaagaagaattgaaaaaagtcggctataacatcggtgtgtctgaaacacctatcactccagttattttaggagatgaaaaagtgactcagactttctctaagaaactgatcgaacatgggatttatgctaaaccaatcgtttatccaactgttcctctggggacaggtagaatcagaaatatgccgactgcggaacatacaaaggaaatgcttgatgaagcagtagcgatttatcaaaaaataggaaaagaaatggaaattatttaactaatttatttttttcgcatatttaaaattagagaacatgttcacgcatatattgttaatcatctgaagatagtagtaaaaaaaggtcagggaggatcatcatgaaaaaagtattggtgacaggatgtttaggacaaattggttcagagttgatcacgcggctacgtcaagaactaggcagtgaaaatgtcattgcgacagatatacgcatgcctgaagtcattgggaaaaacgatatctttgagatcctagatgtaatggattacgaaaaaatgcgcagcatagcagaacaatatcaagtggacacattgatccatttggctgctcttttgtcagctgttgcagaagcaaaaccacagttagcatgggatttgaacatgactgggctggtcaatgcattggaagtcgctagagaattccagctgaaattttttacgccaagttcaatcggcgcgtttggtccaaatactccaaaagatcataccccacaagacactcttcagcgccctacaaccatgtacggggtaacggaggtagctggagaactactatgtgattattattatgtgaaatatggcgtagatactcgtggtgtccgtttccctggattgatttcttatgcgaccttgccaggaggcggtacgacagactacgcagtcgatatttattattcagcaatcaaagaaggaaagtacactagttttattgatcaaggtacatcaatggatatgatgtatatgccagatgcgatcgatgccattataaagctcatgaacgcagaccctaatcgactagttcaccgaaacgcctttaatatatcggcaatgtcttttgagcctgaagaaatcaaagcatctattcaaaaaatcataccagattttgaaatggattacgatgtcgatcctgtgcgtcaatcgatagcagaatcttggccaaactcactagatgtttcttgtgcgcaagaggaatgggacttttcaccaaaatacgatttagatgcaatgacaaaggatatgttggaaaaactgagagaaaaattagcagagacggtataaaacaagaactatagccaaaaaggtttctatattttttggctatggtatgtaaggaggtaagtaatggaagaatatcaagccacgccaataaaggaagtaaaaacggaaaatgaattgaagcgtacgatgggttttttcactgctttatcgactgttatgggcacagtgatcggtgcaggggtgtttttcaaagccgcaagcgtagcagaagtaacaggtaccgtcagtttgcatatgttttcctggtttctaggtggtgtgatttctgtttgtgcaggactgacaggagctgaattggcagcggctattcctgaaacaggcgggatgatcaaatatatcgaacggatttatggaaatacagcagcatttttacttggctgggctcaagtcgtgatttattttccagcaaatgtagcagccttgtcgatcattttcggtacacagttcgtcaatttatttgatctttcccagtcgatgattgttcctgtagctgttacagctgctgtatcgatcatgctgatcaattttttaggttctaaagctggaggagcttttcagtcgattacgcttgtctgcaaactcattcctttgtttgtgatcgttatttttggtttattcagacaagaaggagtagacttccaactgtttccgatccaagcaggagaaaacctttcatttttctctgctttgggagctggcttactagcaacgatgttcgcatacgacggttggatacacgtaggaaatatttcgggagaattgaaaaagccggcgaaagatttgccaaaagccatttctttaggaatcatcggaatcatgatcgtttatttattagtaaatgcggttttcttaaaaactgcgtctatcgacggagtcgtaggaaacagcaatgcggcaagtgatgttgcaaaaatgatttttggcggctttggtggaagactagtcacagttggtatcttgatttctgtttatggaactatcaatggctatactcttactggaatgcgtcttccttacgttatggcaaaagaaaacaacctgccttttagcaagctttttgctaaacttcatgataaaactaaagttcctgtagccgcgggtatcttagagctagtcatcgctattggcatgatgatggtcggtggttttgatacactaacagatatgctgatctttgtcatttggattttttatacgatggtctttgttggtgtcatccttcttcgtaaaaaagaacctgatctgattcgaccatataaagttccaatgtatccgtttatcccattagtagcaatcattggaggaacctttattgtatcaagcacacttatcactcaaacttttttagcttcgatggggattgcattgacacttgctggtgtcccgttttacctttatttgaaacgtagatagcaaaaaatgattttgaaattcattggaaacaaacttttgaccataaatacccgttaagaaattaagtcatttctaccaaggaggatcttatggaaataaactggttgcaagaagcacaaaagagaaaagagatgttgctagaggatttaagtgaattgctacgcatcaatagtgtaagggatatcgaacatcagacagatgaatatccactaggtgctggtcctgctttagcattgaaaaaagtactgtcatttggggaaagagatggcttcagagttaaaaacattgataatctagccggacatatagaatatggggaagaaacagcagaagcacttggtatcttaggacatgtagatgtcgtaccgccaggagaagggtggacaactgatccgttcgaaccaatcgtcaaagaagggaaattgttcgcaagaggttcaagtgatgacaaaggtccttgtattgctgcctattatgggatgaaaattatcaaagaactgcaattatcaacatcgaaaaaaattcgattcattttcggaacagatgaagagagtgagtggataggtatccatcattatatggaaaaagaagaaatgccagcatttggattttcgccagatgccaatttcccaatcattaatggtgaaaaagggattttatctttcgagctgagtttttctttgaaggaagaaaaggcagacaaaatgcaactgaaaagattctcttctggtttgcgtgcaaatatggtaccaagcgaggcaatagccgtcttggaaattcctgatttggaaaagttatcttctttagaagctggatatacaaaatatctagatgacaaaaaattgaaagggacttttgaatataaggaaggagaagcatccttcgttctgtatggaaaagctgcacatgcccaagaaccaaaatttggtatcaatgcgggaacttatctcgccgactttttgcatcaatatccattagacagctcaggatctgcttatctttctgtcattgccaattatctgcatgaagactttaatgggcatcggttaatggtcgattatgaagatgacgtgatgggaaaagtgacttcaagtgctaatgtattcatttatcagcaagaaggagagaaaaagatcattcttaatattcgtcatccaaaagggattacaaaagaaaaaattcaagaatccttgctgactgtccttcaaaatgaatcagtatcaatttcgataattggagatatcaagactccgcattatgtttcaggagatgatccattcatccaaacattattgtctgtttacgaaaaacatactggggaaaaaggttatgaacaaacaattggtggaggtacgtatggacgaatcttggaaaaaggatgtgcgtacggtagtttatttcctggtagagaaaatgtaatgcatcagccaaatgaatatatgtacgtagaagatatcttgaaagcaacagctatttacgctgaagcaatctaccgtttggttaaataaacgtattcatagaaaaaacgttaccaatcagtcgtaactattttcacactcgtaacgtttgtatccttcagtaaaaaagaatattcatgaaagtttgaaagattgcagagaataagacggcaatttccttgaagtaaagaagcttctaaaaataaaaatgaaccagatgatagaaaaagcttgtttttctttcatctggtttgaaaaaggaggagaatagatgccaaaagaaaaacattctagattagataaagtgttagatacagtagaaaaactagggaacaaggtgccccatccagctattatattcttaattttgatcgttattgtaggagtactgtctcatattttttatctaatgggtcaacacgttacgtttgatgctattaatgctgaaacaggagcactagagcttactactacacatgtaaaaagtttgttgagtggtgaagggatccgttttatgttgacttcgatcgtctcaaatttgatgagctttcaggctcttggagtcactttagtggcgatggcaggcgtaggatttgcagaagaggttggcttaatcggtgcgatgattcgaaagctggtaaaggtagtaccaaaatctagtctgacagcggtactagtacttcttggcgtaatgtcgagtattgcctctgatgctgggtatctagtattgattccattaggtgcagcagtattttataaagtcgggcgacatcctttagcaggtttatctgcggcctttgcaggtgtttcaggaggatttggtgtcaacttagttattacgccagtggatggaatgcttaccgaaatattaaatgatgcagtacatatcattaatccatcctattctgttgatttaatggcaaatttttatttttcgattgcatcaaccatcttagtagtgattgtttccactatcattaacgaaaaactcattgaacctcgcttaggaactttccaagaaaaaggaatgattgctaacgatgagattaccgatgaatcgaaaggcttacattgggctttttggggatttacagtggtgctggcatttatcctgttgattacgataccaagtggtgccccacttcgccatcctgaaactgatgaattgattggttctacaccttttatggatagtttaatcgctttgatcttgatttcatttttgattccagggatatgttttggaaaggcagttggaaaagtcaaatccagtttggatgtagtaaatccgattattaaagtattcagcaacttaggcgggatgattttcttattgttaatcattagccaattcatttcatatttcaattttactaatttaggtactgtttgggcagtcaattcagccacgattattgaagatatgaatttgagcagcttagccttgttacttagtttcttagcactagcacttattcttgattttattttagtgggagcgataccaaaatttgctattttaaccccaatatttgttccattactctatcagttgggagtagctccagaagctgttttagctgcttatcgagtagctgattctcctgtcaatattatcacgccactgatgccgtattttgctttgatcgttacatttgccacgaaatatcaaaagaaaaccggtgtcggaacgattatttccataatgctaccacatgctgtaagtctaactatcacatggatcattttatttattctctattatgtattccagctaccgctaggaccagggatcggtacgcatttgaattgagaaaacaggcagaaaccgggttcaaccgatttctgcctgttattttgctttgcgtaagagaaatattcggcgtacaccgcgataaatatttaataaaaccaagcaaccagaaatgaaaatgggaagccaaatcagatagacagggtagccaatcattttagacaaagcatgtggagtcattttatccatttcaaaaagcgcttgctgccaagtctgaaggttgaagacaagcatgaaacctgaaataatcaggagaataaatcctaaataatgaatcgtagttctttttcttacataagcaattgttgcataaaggaacagtaaaaaaataggtacgccaaaaacaaagtacatattcagcatctcgacaccccctttgagtttatcttactttactttgaaagaaatgagaaataatagcctcgttacttgcttgaaacagcaaaggactgctaagataagggagatacaaagaatcaaggaggagtcacatggcaagttatatcgaaccgattcgttttgcgctggttgtttttccatttttagccttagcgatttcatctgttttttttatttatgaatatcgaaagtatggaacatttctagtaacaagggcagttattttgtattcctttgttttctatttattgtgtgcatactttctggtaatcttaccacttccggcaaaggagacggttgcccaaatgacaggaccaaagatggagctgcatttatttgcttcatggcaacatttcagagacaacacggtattggtattatctgaacctagtacctatctgccggcgatgaagcagagtgtgtttttggaaccagcttttaatgttttattactcataccatttggcatttatttaagatattatttccggctttcctttatgaaaacgatgattgctagtttctgtctatcactattttttgagctgacgcagctaagtggcctttattttatctacccaagaccataccgcttatttgatgtgaatgatttagtgacaaatacattgggtggaatcattggttttgttgttacgccgttatttacatttatgcttcctacgagaagacggatggatgaactttcttatgaaaaaggaaaaactgtctcgttgacacgacgtttggtcgcttatttgatcgactggacatttttatctattgtcaattttatcgcagcgattttctttaaacttgcgttcgattcagggacagttacttctcatatctggtggcttttattggaagtagggctatactttatgattgtaccgtttataaccaatggatggacacttgggaaaaaaattgtacgcatccgcttggtggagcaagaccgcgagcgaatttctttgaaagcattgatcatccgctatgggtatctatattttcttttttatggtttaagctggttggggcagttgcttcagcaaatcatgaattcgacaacgaatacggtgttgcagatgagtgcagtattcatttctctcggtgtcttgctactgcaaggtatttttattttaaatatcttgctatcatttttgagaaaaaaacggattctgttttatgaaaaagctagtcacacatataccgttagcacgattgctcaaacaaaggatgatgattctcgaaattagctgagcaaaaatactttgtctatgttataatgccaaagtcgtgataatttaaagagaagaggtgcacgaatgaataattttgatatatttcgcttcaaaccatttatcaatgaagcgttagccgcaaagggcttcaaacagcccacagaggtccaggaacgtttgattcctttaattgcaaaaggaaaaaatatcattgggcaatctcaaactggtacaggaaaaacacatacgtttttgttgccattgtttgaaaaaatcaatgcagataaagaggaagtacaagttgttattacagctccaagtagagaactggctgcacaaatttatgaagcagctacacaaatcgctaaattttctacaccggagatccgtgtttcgaattttgtcggggggacagacaaacagcgtcagttaaaccgtctgcaccatcagcagccacaggtcgtagtaggcacgccaggtagaatattagacatgatgaatgaacaagcgttgaagattcacacagcatttgcatttgttgttgatgaagcggatatgacattggatatgggttttttaaatgaagtagaccaaattgcaagtcggttaccagaaaaattgcagttcttagtcttttctgccactattccagaaaaactgcgtccattcttgcgaaaatatatggagaatccaatcattgaagaaatcaagccgaaagcagttatttctgaagatatcgaaaattggctgatctcaacaaaaggtaaagatgagaatcaaatgatttatcaactgctgacgattggtcatccttatttagcaatcgtatttgccaatacaaaacagcatgtggatgaaattgctgattatttgaaaaaccaaggattgaaagtagcaaagattcacggggacatcacaccaagagagagaaaacgagtgatgcgacaagtacagaatctggagtatcaatatgttgtagcgactgatttagctgctagaggaatcgatatcgaaggtgtttctcatgttatcaatgcagaaatcccggaagatctggacttctttatccatcgtgtcggacgtactggacgtaatggtttaaaaggaacggccattacgttgtattcaccaaacgatgaacaagccattgatgcgatcgagaaattaggcgtctcatttgaaccgaaagaaatcaaaaatggtgaaatcgttaaaacatatgatcgtaatagacgtaccaaacgagaaaaatcaaaggatgtattagacccaactctgattggacttgtgaagaagaaaaagaaaaagatcaagcctggttataagaaaaaaatcgattgggcaattgcagaaaaaaataaaaaagaacgcaaaatcgaacgcagacagcaaagtcgtattgctcgtaaaaataagaaaaattcgcataaataaaaaacaagagattgtgacacgccttttgtcacaatctcttgtttttaagcgagacttttttccattccgatacaaagtacttcatcttcaataaaaggtttcgtgcaagtatgatacccttgtttttcataaaaatctacagccgtcatttcagctactacataactagtctgacaaccttctgacatcgcccgtttttctgcagcttcaagcaactgaccgcctaacccttttcctcggtattcttttgctacgcaaaagcgttctggcttgaagcaagtaggtgttttcttttcataacgcaatgtggctactggtctttttttatcaagaaatagataatagttttgttgcgggatatcttttccgtcgaattctagttctgcaggaattccttgttctaatacaaaaacttgatatctcaaaaagcagctagctgcgcggatccattcatctgcgccaactatttttttcatcatattcctccttatcatgaataacagagatgtattgatttctttatccttatcgtaccaaaaaatatggaatatgaccaaaaggaaataaaaataggtaattgagatattgacagtgattgacagaatgcgtatacttattaaagtacgaaaaggacatgatttgtttttttaagactcacagaaaattctttcttggctgaaaaaagaatagtcactaatcaaattgctccctttttctattttggtagaaataccgacgcagctcagcgttatcgagtttaagaggtaatgattacacatcattgcaatcaaggtggtaccgcgagttttcgtccttggctgtaatggtgtttttttgtatttaatttatagaaagcaggtaatgatatgaaacaattaagtagtgcacaagttcgacaaatgtttcttgatttcttccaatctaaaggacatacaattgaacctagtgcgtctttgatccccgtgaacgatccaaccttattatggatcaactctggtgttgcaacattgaaaaaatattttgatggttcagttgtaccagaaaatccaagaatcacaaatgcccaaaagtctattcgaacaaatgatatcgaaaatgtcggtaaaacagcacgtcaccatacgatgtttgagatgctgggcaatttttctattggtgactatttcaaaaatgaagccatccactgggcatgggaatttttgactgatccaaaatggatggcattcgatccagaaaaactttatgtaacagtttatccaaaagatacagaagcaaaacgcatctggcatgaagaagtcggtctaccgttagatcacattattgatgtagaagacaacttctgggatatcggtgcaggcccatgtggaccagatacagaaattttctatgaccgaggagaagcttataacgatttagcagaagatgatcctgaaaactatccaggaggagaaaatgaacgttatttagaaatctggaacttggtattttcagaattcaaccataaacctgataatacatttgaaccacttcctcataaaaacattgatacgggcatgggattggaacgtatggtctcaatcgttcaagatgcgcccacgaactttgagacagatttgtttatgcctattatccacgccgtagaaaagctaagcaaacaagtaaaatatggtgaaaacccagtaacagatatctcttacaaagtaatcgcagatcatattcgggccctttcatttgctattggcgatggtgcattaccatcgaatgaaggaagagggtatgtcttacgccgtttgcttcgtcgcgcggtcatgcatgggaaaaaattaggtattgaacaagcattcttatatcgtttagtccctgtcgttggggaaatcatggtaagttattatcctgaagtacttcaacaaaaagaatttattgaaaaagttatccgtacagaagaagaacgtttcaatgaaacaatcaatgaaggattggaaatcttgaatcaagtgatccaagaagtgaaaaacgaaaacggtacgactctatcaggaaaagacatcttcaaattatacgacacatatggcttcccagtagaattaacggaagaagtggcagaagatgaaggactgaaagttgatcatgctggttttgaaaaagaaatggacgcacaacgtgaacgtgctcgctctgcccgtagtacagaaaaatcaatgggtgtacaatctgctttattgacagatatcaaagtagaaagtaaattcatcggatacacggagcaagaatcagatagtcaattattggtcatcgtaaaaggcgaatctcttctgaatgaaatcgcagaaggtgaagctcaaatgatctttgaccaaacacctttttatgcagaaatgggtggccaagtagcagaccaaggttggatcatggatgaagcaggagaaatcgttgcagttgttacagatgttcaaaaagcgcctaatgctcaatttatgcacacagtagaagtaaaagcaccaatgagcgaaggacaaacttatcatctattgatcgatcaatcgatgcgcaaccgtatcatcaaaaaccatacagcaacccatttactgcacaaagcattgaaagaagtacttggcgagcatgcaaatcaagctggttctttagtcgctcctggacatttacgattcgactttacccattttggtcaaatcacttcagatgaattagctgaaatggaaagaatcgtcaacgaaaaaatctgggaagctatcccagttgaaacaattgaaacagatatcgatacagccaaaaatatgggtgcaatggctttgtttggtgaaaaatacggacatgacgttcgcgtagtcaatattggcggttggtcaatcgaactgtgcggaggcacacatgtagcaaacacagaaaacatcggaatcttcaaaatcgtttctgaatcaggaattggtgcaggcgtgcgacgaatcgaggctgtaacaagcaaagaagcgtatgaactacttgaagaagaagaaaaacaactaaaacaagtagcaacaattgttaaatcacctcaattgaaggaagttgtttcaaaagcggaacaattgcaacagcaagtaagagagctacaaaaggaaaatgaacaattggctagcaagttagcgaatcaacaagccggtgatgtattcaagaatccagaaaggatcaatggaaaaacaatcattgcagcacaagtaaaagtgaaagacatgaatcagctgcgtcaattagctgaccaatggaaacaaaaaaatatttcagacattcttgttttagcaaacgaacaagaaggaaaagtcagtctgctagcggcaatgacgaaagaatcaaatgaagctggactaaaagctggcgacttgattaaagcaatcgcaccgaaagtaggcggtggcggtggtggacgtccagatatggcacaagctggtgggaaaaatcctgctggtattccagatgcacttaaagctgcgaaagaatggcttgcgcaacaatagaccgtttatgtttgatagaaaaaaacaactgttcaatcattgaacgaaacacgatcatgggggcgaagacaaatagtcttgccctcatacttttttcgatggaatagaagagcgcatctaatcaaatggtcgatttcggatggtctttagttgacgaaagtgacagaaatttttacgattagtataaataaaaggggtgaaaaaaatgaatagcagaaataaaacctttcgactagtcttacgtgctatcttattagcaatcatcatcgtacaagctatggtaccttggcttggctttattccattagggttcattagtttaacgattattcatattacagtaattattgccgcagtagtattgggtccaaaagatgggatggtaattggcctgttttggggaattgctacaattgtccgtgcctacgccatgccgacaacgccatttgatacattggtattcacgaacccgattatttcggtagttcccagagtgcttgttggcttagtagctggtttggttttccactggatttatcaaaaaaataaatcaataacgatcagctcggtctttgcaggggtattaggttcattggtcaatacagtcttagtgttaggattcatgggattattttatacaggtgcaacggcagatgcctatggtgtagattctgctcttttatttaaaaccttagcaggagttgcagcaatcaatgggatacctgaagcaataggagcgggaatcataacaccattactagcaaaagcgttatttgcagcaacgccattaaaaccagaataacggccatctttgaatgaatagtaggacgcatgatagatggaaaaaggaagagaggagaggaaaagaattgtcctctccatctttttacctgagcaacaagcaaactagaaggggtaaaaaacttggttaagaaacaagaagaaaaaaagaaacaaataccgcaacagcggacaaaaaaaggagtactagctggcatgttaggattggttacgaatctaatcttgtttgtctctaagctaatgatcgggcttttttcagggagtgtctccattatggctgatgcagtgaatagtctatcagacactgcttcatctatattgactttgattggatttaaaattgctgcaaagccagcggatcaggaacatccttatggacatgaacgtttcgaatatatcagtgggttatttgtttcgatcatcattacttatgtaggatttcaatttttagagtcatccgttgaaaaaatcatccatccagaaaatgtctctttagcacccatcgtcttttttgtcctgatcatttccatctttttgaaatttgcacaaggaaaaatgtaccaggttattgcacgatccattgattctgaaacattgagagctacagcaacagatagttataatgatgtctttactacactggctgtattgctttcagcagcaatcgaatgggtaactggatggcgtatcgatggatatatcggttttgctttagcattatatatcctttatagtggtttaacgatgcttcggaattttgtatatgagctattaggtagtcgcccaacgtcagcagagattgaagaaatggaagaacacttgaatgcctgcgacgatatacttggctatcatgatttgctggtgcataactatggacccaataaacgctttgcatcagtccacatcgaagtagatgaatcaatgaatttgaatgaagcacataagattattgacctgatagaaaaagacttcaaaaagtctttagacgtagaacttgtctgtcacttggacccaatgcctgttgataacgaaaaatactataatatcttgcatcaattaaagcaaattctttttgaaacaggtagagggctcgatatacatgattttagagtcatccatcaagggaaaacattgcagtttgacgtagttgttcctgaaaaattccaatttgatgatacagaactcgaaagaattttacgtattcaaatagaagaaaaaatcggagattatcatttggaaatcacttttgatcacaattatcttttgtattaaagacaagatactaaaaagactctttaaagttttttcttcgaagagtctatttttcttttaattgtttttgtagggcttgtcgtgcgaggttatctgcccctttgtttttgttttcgggcaaccattgtaggattaacaaggaaaagtcgggcagaagttctttgattttttggagatagggaaggaaaagctcgtttttcgttgtgtttttatcgactgtagaaaccagtgttttgctgtctgaaaaacagaaaatcgtttcattctgtaaacccttattctttagaaattctaaagtttttaaaaagacttcgaactctgcttgatggtttgtccctacagaaaggggaatagatagctgttcttgtttaccttgatagacaatcaagatccctcctccgctaggtccagggttgccttttgtagaggcatcaatgtatacttttaacataaaaagagattctcctttttgttcaaattaatgttatggtaagattatatcattactgaatcggtgagaggttagagaatgaaaaaaaatattcgatggcagcctgaattggcacatacgatcatctattggtcattgaccttgatcattctgttttttagtctgattctttctttagaaaacacaggtccgtattggaaaagcaatattgttttaggtgtttttcttgtttttctatttctaggatggcggcgttcttttattttaaaatccaactcggtaatcatacgctatgctgctttttggaaagaccgggaaataactgtcggacagattcgatctttgacaccgactaatacaggagtacaaatgacattgcaaaatgagaaagccccatctgtttttatgatgcgaaaaaaagatcaagtggttctttttgatcatcttgaaaaaagtgggcctaaagtaggaccatcttctcaacagcaaagaaataataccccatatacgaaaaatagaaaaagttaattttaaaaaataggccctgaagaaatgaatctttgtaggaaaagaaaagagtgagacgtacggatcaacccgttaaacgtctcactctatttgattatctaaatcaatgtatactggattcggaagtgtgaacactgcctttcttgacatgggcagcttgtgttcctcgattcccctcgatgatctcaaattcgaccacttgattttcttccaaagttttgaatccctcttcttcaatcgcagtaaaatgtacaaaaatttcttctgtgtcatcataactgataaagccgtatccttttttgttgtcaaaccattttacaattcctgtggtcaaagcactcacgacctttctaaagtctgatcatagccttcattataaagagtatttataagtacgtcaaataaattaaaaacccgtaatttaatgttttttttctgaataaaacaaggtataattggcatatcttaacaaaaaaggtattttttttaataaagttcgtgaaaaggggtaatcaaatgaagagtgatctgcaaatttcacaagaaacagatctagaaccgattattgaagtagctagtaaattagatcttaaggaagacgatttggaactgtatgggaaatataaggcgaaaatcaatttttctggaatcaatcgatcaaaggataacgctgaagggcatttgatcttagttacttccatcaatccaacaccagctggcgaaggaaagtcaacaatcactgtagggttaggagacgcgctcaataaaatcaataaaaaatctgttattgcattgcgagaaccctcacttggtcctgtgatgggaatcaaaggtggtgctgcaggcggaggatatgcacaggtattgcctatggaagatatcaacttgcattttactggtgacatgcatgctatcacaacagctaataatgcattatctgctcttttagataatcatattcatcaaggaaatgaattgaacatcgatgctcgccgagtgatttggaaacgggtagttgatctcaatgatcgtgaactgcgtaaagtaatcgttggcttgggtgggccaatccaaggtgtcccaagagaagatgggtttgatatcacagttgctagcgaaatcatggctatcttgtgtcttgcggcagacctcgaagatttaaaggctcgtcttgcaagaatcgttgtcggctatacatttgaccgtcagcctgtgactgctggagacttgaaagcagaaggcgctctggcattactgctgaaagatgccatcaagccgaatcttgtacaaacaatttacggaacaccagcttttgtccacgggggaccgtttgccaatatcgcccatggctgcaatagtattttagctaccaagacagcattgagattagcagattacgttgtcacagaggcaggatttggtgcagatcttggcggagagaaatttttagatatcaaagtacctaacttgaaaaaagcgccggatgcagtggtgatcgtcgcaacaatccgcgcattgaaaatgcatggcggaatgaaaaaagatgaacttaaaaatgagaatcttgacgctttgaaaataggttttgcaaatttaaaacgtcatatacgtaacatggaacaataccaactccctgtgatcgttgcaatcaatgaattcgtaacagatacagatagtgaacttacactgctggagcacttgtgcgaagatcagggaatccttgctaaaagagcaagtgtatgggcaaatggagcagaaggtggcgttgatttagcagaagctgtggtacgattgattgatagaaaagaagctgattacaagccattgtatctcctagaagaaacgatacaagaaaagactgaaacaatcgtcaagaaaatctacggaggaaatggtgttgtttttagtaaaaaggcgcaaaaacaaatagaagaatttacgaaaaatggatgggataatttgccgatttgtatggcgaaaacccaatattcattctctgatgatccttcattgctaggcgcacctgaagatttcaccatcaccatccgagaaatcatcccaaaagtaggggcaggatttttagtagccttaactggggatgttatgacgatgcctggtttgcctaaaaaacctgctgcattaaatatggacgtgacaaacgacggagaagtatttggtttgttttaagcttgattataatctaccgtatactaaatgactttcattaaacataagaggagctgtattttgactacagcttctttttttgaaggtgtcaagagattaattgtgtttgcactaggatcattctttttctttattgtattttgagctatactaaagcataataggagggtacgatgaaaacgacatttataagaaaaaccggtttttacggtatgggcagctcgattcaattaagaatcaataatgaaaaacgcagttttctcaatcatgaacaaaagataacgcttgatctggaagttccctttacgatgcaggtcaccttttattggctaaaaagccccgtttatacagtgaaagaagcaaagcctgtttatgtgatcacaatgaatagtttgattcttcaaatctacccgttcttatttctggcaactgggttgggggccgttttcctacaaaatctatttttcagtttttttgcagttgtcgtgatgtttgcgttctttttctatataaaaaaccgggcatatttgatcaaggaggaaaattatggcaaactctgatctttttttaatcagtttcaatcgaatcgaaaaatggatgagagacgagatgggaaatgcacgaaacatgggatttaccgaacttgtcagacgcctagctcaaagaaaacaattgatgatcagaaaatatgaagatgatcttttacagcttgctcagttaaggaatgcaatcgtccatgaccgaatcgccgtcgattttgtcattgcagaaccaaatgattggacagtcaagcgaatccagctgatcgaacaagaactgatacgcccagaaaccgtactacctcgatttgcaaaacgtgtaaccggttttgagcaagatcttccgctacttgaactgttaaagatagtagcagaaaaaaggtattcacagtttccgttatataataaaggaaaatttgtcgcattgattactttacggaatatcggattttggctagcaaaagaaagccaaaaaggtcctgttgatttaacaaataaacgagcattggatttgattatccaaaatgggaagtacacaaattatcattttgttccagctaaaacacatatttacgaggttgaagcgatgtttcgtgagcaaggaactttggaagccgtacttatcactaaagatggtaatcccgatggtaatctgcttgggatcatacgacctcgcgatatttataaacaaatagaaaaggattgattttttgttaattatttattggatattcagcgctctgctagtgggagtggatcagctggtcaaatggtggatcactgataatttagcgcttggagagacgaaaagtcttataccaggtatattgtcactgaatcatattcgaaacactggagccgcatggagtatgctagaagggaagatgtggttctttactatagtgacactcattgcagtcgttgtgattctcacattgatgattaaaaatcgtgaaaaaggtaatcgctggttcatgattggattgagcctgattctagctggtgcgataggtaactttattgatcgtctccgacttggctatgtagtagatatgtttcaaacagactttatgaactttccaattttcaatgtagcagatgtgacacttgtatgcggagtgatctgtatattaatttatattattttagatgaaaaggatcaaagaaaaaaatgacagaacttaaaacaacgatttatcatgaatctggtaggatcgataaagtattgactaatctattcagtaattacagccgttcgcaaattcaattgtggctgaaagaacgtgcggtttctgtcaatggagaaccagtcaaagcaaattacaaagtaaaacaaggagacgagatcactgtcttgatccctgaaccagaaacattagatgttgtcccagagaacatcccgttgaccattgtttacgaagatgaagatgtcgcggtaatcaataaaccccaaggaatggtcgttcatccttcagcaggtcatacgcatggtacaatggtcaatgcgctgatgtatcatgtcaaggatctttctacgatcaacggagttatccgaccgggtatcgtccaccgaatcgacaaagatacttcaggtttgctgatggttgccaaaaatgaccaggcacacgaatcattagctaagcaattaaaagataagacttctttacgtaaatatgttgctttagtccatggagagattcctcacgaaaaaggcacgatcaatgcgccaatcggccgttcgaaagaaaaccgaaaaatgcaggcgataagagaagatggaaagccagctgtcacgcattttactgtattggaacgttttgaaggatttactctagttgaattaaaactggaaactggaagaacacatcagatccgcgtgcatatgaagtatatcggttatccgttagctggagatccagtatacggaccgaagaaaactttgaaaggcaatggtcagtttctccatgcgcaaatgttaggttttacgcacccgactacaaacgaaaagatgatctttgaagcacctcttccagaagtttttgaaaaaactttagaaaaattaagaaaaaacattgcattttaatttagataacggtatagtaattaacaacgaaagcataaaacttaatagaattcctttaagtttagtcccgtgaggctaagaagggtgggagcaaggatacgtatggtgcgccataaagtaaattgctcattgacatagtatagctatcagtgtatcagtatacgctcagtctaaacattcctcctgtcctcttagggcaggagtttttttatgcaaaaaagtagggggaatgaaaatgcaagcaaaagaagtagtagatcaggtaacgatgaagcgagcattgactcgaattacttatgagattatcgagagaaaccatagtatccaagatatcgtattggtaggtatcaaaacacgaggaatctacattgcatcaagaatcgctgaacgtctgaagcagctagaagatatcgatattcctgtaggagaactagatatcactttataccgagatgacaaaaaagaaaatccagaagaaccggaacttcattcttctgacatcccagtttccttagaaggaaaagaagttattttgattgatgatgttttgtatacaggacgaacgattcgagcggcaatggacgcagtaatggattttggcagaccaagaaaaatttcattagcagtcctagtagatcgtgggcatcgagaattgccaatccgtgcagattatgttgggaagaacattccaacatctcgggcggaagagattttagtagagatgcaagagcttgatggacaagatcgcatcatgattttgaaagaggaagattagaggagagagaaacatgtcggagaaaaaaggatttcataatgatgacgtggtgttagatatccacgatcgcccaaccccaggacattgggttggattaagtttacaacacttgttcacgatgttcggagcaaccgtgttagtacctatcttagtagggatcgatccaggtatcgcactagtcagttcaggactaggtacattggtgtacttatttactactaaaggaaagatacctgcgtacttaggaagcagcttcgctttcattgcagcgatgcagcttttgatgaaaacagatggttatccagcgattgcacaaggagcagtcacaactggattagtctacttgattgttgcgctgatcatcaaaaagatcggttcagcatggctagataaaatcttgcctccgatcgtcgtcggcccagtcatcatggttatcgggttgggacttgcggcaaatgcagcaacaaatgctatgtataatcaaggcacatatgatttcaagtatattgccgtagcactgatcacattaggattgaccatcttcttcaacatgtggctaagaggttttctcggattgattccgattttactaggtattattagcgggtacatcgtagccttgctgtttggaatcgtggatactaagccaatcgtagacgctgcctggtttgctgttcctaactttgagattccatttttacaatatgaaccaaagctatatcttggagcaatcacaacaatggcgcccatcgcttttgtgacgatgacagagcatatcggccatcttatggtattgaataaactaactaaacgtaatttctttgaagaaccgggtcttcataagacgttgacaggtgatggcttagcacaaatcgtagcagccttcgttggtggacctcctgtaacaagttacggcgaaaacattggtgttctggctatcacacgcgtccatagcgtgtttgtgattgggggagctgcagtttttgcagtcgttttgggattcgtaggaaaattaagcgctttgattttaagtatccctggaccagtcatctcaggaatcagtttcatcttgtttggtgtcattgcagcaagcggaatgaagattttgatcgagaacaaaatcgattttgacaaaaagaaaaatctgttgattgcttcagttatactagtagtaggaattggcggacttgtctttgaagtaggcacatttacattgtcggcaatggcgttagcaactgtacttggcatcgttttaaatcttatcttaccagaaacttcacgaagcgaagaaaactaaggaggaaacattatgatcatcaaatcagaacgtatcagtttaaagcatttattgaccgttgaggcacttactgaccaagaagttatgggcttgattcgcagagggcaagaattcaagcaaggggctaattggactccgcaaaagcgccagtactttgctacaaacctctttttcgaaaatagtacccgcacacataaaagttttgatgtagcggagaaaaaactagggcttgaagtgattgaatttgaagcaagtacaagctctgtccaaaaaggagaaacgttatacgatacagtactgacgatgtctgcattaggtgtagatgtagcggtcatccgtcatggtgatgaaaactattatgacgaactgatacaaagcaaaaccatccagtgctcgattattaatgggggagacggaagcggacagcatccaacccaatgcttgcttgatttgatgaccatttatgaagaatttggacactttgaaggactgaaagttgccattgtaggggacatcacccactctcgggtagcgaaatccaatatgcagatgttgaaacgcttaggtgcacaagtattcttctcaggtcctagagaatggtacgacgatgaattcgaagtatacggacattatatgccattggacgaactactagatcaagttgatgtcatgatgatgcttcgagtgcaacacgaacgccatgatggaaaagaaagcttctcaaaagaaggctaccatcaggaatatggtttaacagttgaacgtgcgaagaagctgcaaaaacatgcaatcattatgcacccagcaccagttaaccgcgatgtggaattagctgattcattagtggaaggattacagtcacgaatcgttcaacaaatgagcaatggtgtctttgtcagaatggcaatcttagaagcagtgctaaatggaaaagcgtaattataggaggatggaaaaatgaaaacactcattaaaaacggtcagatcaatacacgaaaaaatatgacgacaccagcagaaatttggatagaagatgggcgaatcaaagcaatcggtacaggattctcagaagccgaatttgatgaagtgtttgatgcaaagggacaattgatcacacctggtttagtggacgtccatgtccatttgagagagccaggatttacatacaaggagacgatcgaagctggaactcgctcagctgcacgtggtggttttactactgtatgcgcgatgccgaatttaaatcctgtacctgataaggcagaaaagctgaaacaagtatatgacatcattagaaaagattcagttgtgaaggtattacagtatgcgccaatcacagaaaatctgcgaagtgagaaattagttgatcaagaagcactgattgaagaaggtgcttttgctttcacaaatgacggtgtaggtgtccaaacggctggaacgatgtatctggctatgaaagaagctgcgaaaaacaataaagcactagtagcccatacagaagacgaatctttattatttggcggtgttatgcatgctggcaagaaggcagaagaactgggtcttcccgggatcttaagtgtaaccgagtcttctcaaatcgccagagatctgttgctagctgaagcaactggtgttcattaccatgtgtgccacgtatctactaaagagagtgtccgagtaatcagagacgcaaaaaaagcaggaatccacgtaacagcggaagtttcgccccatcatcttattttgatcgatgaagatattcccgaagatttcggcttttggaaaatgaatccaccgctaagaggacggaaggacagggaagccttgatcgaaggtttgcttgacggcacgatcgattgtatcgctacagatcatgccccacatggattagaagaaaaaagccaaagcttcatgaaatcgccatttggcatagtaggaagcgaaacagcattccaactgatctacactcattttgtagaaactggacaattcacattggaacaagtaatcaattggctggcagttaaaccggctgagatttttggtttgaatgcaggaacgctgacagtcggcgcacccgctgatgtagcaatttttgatattacaaaaacttgcacgatcgataaagaagactttttatcaaaaggggaaaatacaccttttatcggctggaaagtaaaaggtgaaacacaaatgacttttgtcaacggaaaacttgtgtggcagaagggagaataaaaatatggaacgtttgcttatattagaagatggaacagttttcgaaggaaaagcttttggcgcggatgcaaatgtcttcggagaaatcgtttttacaacaagtatgactggttatcaagaaaccatcaccgatcaaagtttcaacggtcaaatcattacatttacctatcctatggtgggcaattatggggtaaatagagatgattatgaatcgatttctccaacatgcaaaggagtagtagtaaaagagcacgcgcgtgtagcttcaaactggcgaaaccaaatgacgctagattcatttttgaaacaaaaagggattcctggaatatcaggtatcgatacgcgcgcccttactcgtaaaatccgtgaagtcggaacgatgaaagcaagtatcgttgatgctggagattccttcgaacatgcatttgatcagctgaaagcaaccgttctagcaaccaatcaagtgcagcaagtctccactaacaaaccttatccaagtccaggaacaggacggaaagttatcgtcattgacttcggcttgaaacatagtattttacgagaattgagtaaaagaaactgtaacctcacagtacttccctataacacagatgccgagacgattttagcgttatcaccagacggagtcatgctgacgaatggacctggtgatccaaaagatgtgccagaagcaatcgaaatgatcaaaaaaatccaaggaaaagtaccgatttttggtatttgtcttggtcaccagttatttgctttagccaacggtgcagatacctataaaatgaaattcggacatcgaggattaaatcacccggtacgagaagtagcgaccggaagaattgattttacttctcaaaatcatggctatgcagtcgatgaagccacgattgatccagaaaaactcatcgtaacccatgtagaagtaaatgacggaacagtagaaggagtcaaacacagagattatcctgctttcagtgtgcagtttcatccagatgctgctcctggtccgcacgatgcactacatttatttgatgaatttatggaaatgatggatgcaggaaaggagcagtaaacagatgccgaaacgtacagatatcaagaaaattatggtgattggatctggtccgatcatcattggtcaagccgcagaatttgactacgcaggaacacaagcttgccttgctttaaaagaagagggatatgaagtggttttagtaaattctaatcctgcgacgatcatgacggacaaagaagtggcagatcaagtatatatcgaaccgatcacacttgaatttgtatcaaggattcttcgaaaagagcgtccagatgctctccttccaactttaggcggacaaacaggcctcaatatggcaatggagctggcagcatcaggtattttagaagaattgaacatagaacttctaggaacgaagctttctgcgatcgatcaagcagaagaccgtgatttattcaaacagttgatgaaagaattgaatcagccaatccccgagtctgaaatcgtcaatacagtagaagaagctgtagcgtttgcaaataaaatcggctatcccgtcatcgttcgtccagcctttactttaggcgggactggtgggggcatgtgtgaaaatgaagaagaattacgaatagtctcagaaaatggattaagtctttccccagctacccaatgtttaattgaacgaagtattgcgggttttaaagaaattgaatatgaagtgatgagagattcggctgataatgcaatcgttgtctgcaacatggaaaattttgacccagtgggtatccatacaggtgattctatcgtgtttgctcctagccagacattgtctgaccatgaatatcaaatgcttcgtgatgcttctctttcgattattcgagcacttaagatcgaaggaggctgtaacgtccaacttgctcttgatccatatagctttaattattatgtgattgaagtcaatccgcgtgtttctcgttcatcggcgttagcaagtaaggcgactggctatccgatcgctaagctagctgctaaaatagcgcttggattaacattagacgaaatgaaaaatcctgtaacaggaacgacttttgcagaatttgaacctgcattagattatgttgtagctaaaattcctcgctggccgtttgataagtttgaaaacggagaacggcttttaggtacgcagatgaaagcaactggtgaagtgatggctatcggtcggaatatcgaagagtctttattgaaagctgtgcgttctttagaaatcggtacacaccatatcgaacttcctgagttggcagacatcacggacgatgacctaatccaaaaagtggttcgagcacaagatgatcgcctgttttatgtagctgaagctattagacgagggtacaccatagaagaattggcagatttgacaaaaatcgatttattttttttagataaactgttgcatatcgtagaaatcgaacagcagttgaaacagcagccgttggatgacaggatattgaaaacagcgaaacaaaacggttttacagacaaaaaagtggcggagctgtgggaaataagcgaagaagccgttcgccagatgagaaaagaaaatgacttgattcctgtatataaaatggttgacacttgtgcagcggaattcgaatcaaaaacaccttatttttatagttcctatgaatatgaaaatgaaagttcacgatcagaaaagccctcagttctagtactgggatctggtcctatccgtatcggacaaggagttgaatttgactatgcgactgtgcattctgtcaaagccatccagcaggcaggatacgaggcaatcatcatgaacagcaatccggaaacagtttctactgacttttctatttcggataaattatattttgagccgttgaccttcgaagatgtgatgaatgtgatcgagctagaacagccgataggagtaatcgttcaattcggtggtcagacagcaatcaacttagccgaacctttgactactgctggtgtaaaaatcttagggacaacgattgaagacttggatcgtgcggaaaatcgtgatttattcgagcaagcgctgaaagagttggatattcctcaacctttaggggatactgctacaagtaaagaagaagccgtggttatcgcttcgagaattggttatccagttcttgttcgtccaagctatgtattaggcgggcgtgcgatggaaatcgttgaaaatcagcgagatttagaagactacatgaaacatgctgtgaaagcttctccagaacatccagtactagtggaccgctatttgcttggtggcgaatgcgaagtggatgcgatttgtgacggtgaaacagtactcatcccagggatcatggaacatattgagcgtgccggtgtccattcaggggattcaatggctgtgtatccacctcaaacattatctgaatcaatcaagaaaacgatcgaagactacacgatccgtttagcattaggtttgaactgtgtcgggatgatgaatatccagttcgtcatccatgaaaatgaggtttatgtgatcgaagtcaatcctcgagcaagtcggactgttccattcttaagtaaggtgacaggaattccaatggcacaaattgcgacgaaagctattttgggagagaaattaaaggcacttggttatgaaaacggactttataaggaaacaaaagaagtccatgttaaagcgcccgtcttttcttttactaaattgcagaaagtcgatacttacttagggcctgaaatgaaatcgactggagaagtaatggggtctgacagacaattagacaaagctttgtacaaggcattcgaagcttctggattacacttgcctgaatatggagccgtattgtttacgattgcggatgaaacaaaagaagaagcactagagttggctaaacgttttacagaaatcggctatagtctgataggaacgaaacatacagctgcctatttcgaaaaacatggtttggttgttgaaacagttgcgaaaatttctgaggaagcagcagaaaaaaatgtagtcgacttaatacgagatggtaaaacacaagtggttgtcaatacgattgataaagatcggggaaatgcttctaaagacggcttcattatccgaagagaagcagtcgaacatggtattccgttgtttacttctttagacacagcagatgcgatcgttcgagtgatggaatcccgtgcattttcaaccaaccctatttaacggtgtatacatgttaagaccgaaagaagaaaatccgttacaggaggggacagatgaaacaagaaatgatggaaatcgttcagcaaaaacagctggcaccaaagatttttgaaatgacattaaaaggtgatctagtaaaagaaatgcagcaaccaggacagttcttgcatatcctcgtgccgcgtgcagacttgctgctacgccgaccgattagcttgaatcatatcgatcacgagacaaatacttgccgtattatctatcgggtggaaggtgaggggactagcgttttctctactctttctgccggagactatttagatgttatgggccctttaggtaatggctttgatttatctgatcttcatacaggagacgaagtatttataatcggtggaggaatcggtgtcccgcctctgtatgagttatcaaagcagttagtcaaaaaagggatcaagccaacgcactttttaggttttgccacacatgaagtcgtttattatgaaaaagaatttaatcgtcttggagaaacaagaatcgctactgacgatggcacatacggtatgcacggaaatgtcggtaatttattattaggaacgaagacgaaacctacagcagtttttgcatgtggttcaaacgggttattgaagacagtggaacagctgttttcttcgcatcaaaatgtccagttatcattagaatcccgcatggcatgtgggataggggcttgctatgcttgcgtttgtcatacgccggaagatgaaacaggaacaaaaagtgtgaaagtttgtgacgaaggaccgatttttaaaataggagaggtaattatatgaatgagaatcctttagcagtcaaacttcctggcttagaattaaaaaatcctatcatgccagcaagcggctgtttcggttttggcaaagaatatggaaaatactatgatttgaatcagcttggttcgatcatggtcaaggcaacgactccaaatgctcgctttggcaatcccacaccgagagtggcggaaacaccatctggcatgttgaatgcgattggtttacaaaatcctggtctagacgttgttatgaataaacttcttccagaattagaggagtacaatgagttacccatcatcgcaaatgttgctggtgcttgtgaagaagactatgtagaagtttgtagcaaaatcggcgaagcgccaaatgtgaaagcaatcgagctgaatatttcctgtccaaatgtcaagcatggcggtatcgcttttggaacagatcctgatgttgcttttcaattaacacaagcagtaaagaaagttgcttctgttcctgtctatgtcaaactatctcccaatgtgacagacatcgttccaatcgctcaggcaatcgaagctggaggggcagatggatttacaatgatcaatacactacttggtatgcggattgaccttaagacaagaaaaccaattttagccaatcaaacaggtggactatccggaccagcaatcaagcctgtcgctatccgtttgattcatcaagtggcaagtatatccaatcttccaatcattgggatgggcggcgtgcagacagtggacgatgttcttgagatgtttatggctggagcaagcgctgtagctatagggactgcgaatttcaccgatccctatatctgtcctaaactaatcaaagagctcccagtgcgaatgaacgaactaggtattgagtcactggaaagattaatcaaagaagtgagagaggaacgtgaacgatgaaccaactaaaccaacgaccaatcattgcattagatttttcaacttggcaagaagtagaagactttcttctttttttcccagaagaagaaaaattgtttgtgaaaatcggaatggaattgttctaccaagaaggacctgaaatcgtacgttatttaaaagatgctggtcacgatgtgtttttagatctgaaacttcacgatattccgaatacggtcgaaaaagcaatgcggggactggcaaagcttggtgttgatgtcacatgtgttcatgcagctggcggtattcgcatgatggaggcggcaatgcgtggattagaagaaggaacgccagaaggtgggaaacgtcccctacttctagctatcactcaacttacctctacaagtgaagaggagatgcatgcagaccaactaatcgaagttcctttagaaaaaagtgtgatccattacgctaactgtgccaaaaaagcaggattagatggtgtggtttcttctgcttgggaagtagaagcgatcaaagaaacggcgggagatgaatttgtttgcttaactccagggataagaccagaaggaacagtcgtaggagatcagacaagagtagtcacaccttctcaagcaagagagattggctcaactttcatcgttgtgggacgaccaatcacacaggcaactgatccttatgaagcataccgagcgattcaaacagaatggagccaacctaaaatgaatgtagaacaaagtatcgcaaaagatctattagagattgaagcagtatttttaaatccaagtaatccttttacttgggcaagtggaatcaaaagccccatttactgtgataaccgaatcacgatgagctatccaaaagtccgaaaagagatcgcaaaaggcttagcaagaaaaatcaaagaagctttccctgaagtacaagtaattgctggaactgcaacggcaggaattcctcatgctgcatgggtagcggaaatattagacttgccaatggtctatattcgaagtaaggcgaaagatcatgggaaaggcaaccaaatcgaagggcgtatagttgaaggtcagaagatggttgtgatcgaggatctgatttctacaggaggtagcgtcttggaagcagctgaagcagcaaaaagagaaggtgcagctatccttggtgttgcagctatctttacgtatgagttgccaaaaggaaaagcaaatttcgaaaaagccgaaatccctcttatgacgttgaccaattactctgtattgatcgaagcagctttagaagatcgttatatcgatgagcaagaattaactctgctaaaagaatggaaaaaagatcctgaaaattggcagttttaagtacaaaaatacttagataattgaagaaataaagctatattattttgaatatttctaaattaccatttctctacaccgttatattttttaaggatacagtttatgtaactgtatccttatttttttcataaccctgcatggatgatttggatgaggagatacatccataaaatacatatgcatgatcttcaatagcgctgattacacaaagtatgaacgacttcaacgagtcaaaaacagcccctcaactgtgttcctatcccacagtcgagaggctatttttgttttatatatgtagaaaagcagttcaacacttttacaaaatagattgaacacttatcagtaaatgataaaagtgttgggaaatagttgtaactatagcttttacaggctgaacagaagttggcacggtatttgctttatataaaactgtcagcgaggaggaaataaaaatgaatacgattattctagctagtcatggcgcattatctcaaggtctaaaacaaacagctgaaatgatcttgggacctgccactaatatttatgcattatcggcttatcgcgatgaagatgagccgatagaacaacaaatacaaagtatagtttcaaaattaggaaaagaaaatctatttattctcacagatatcttaggaggaagtgtcaataatgaaatgataggactgttaaagaaagagccagcaatacgcttgatcacaggaatgaatctacccttagtgatttcaatcgccacgcaagttaacccaattgctgctgcagatttagaattgattatcgaagaaagtcggcagtcattgattgattgcaatcgattactaaaaaaatcaaatgaaggaggagatgatctatgatcaagttcattcgtatcgatcaccgattgttacatggacaagtggtgttttcttggagtaaatctttacaaatcaaccgaattctggtggtgaatgatgaagcagccaatgatgaatttaaaaaaatgtctttagaactatcaaaacctcaaggaatcaaactcaatatatttaccgttgaaaataccttgacaaaaatatctaaaatagaagcattgagtgaaaacatcatgatgatctttggaaataccaaggatgttcgtcagttttgcgaaagttactcaaacgttaaggaaatcaattacggaggcatcataaaaaaagaaggatcaaaacaattcagtaatgctatcttcttgactgaaaatgagatagaagatgcgaaagtactaaaatcaatgggcatcaaacagttcatgcaacaggttccaacctccaaaaaagaggatttgaatacaatgatttaaaaagaaaggagtttacgttatgttgtttcaatcgattgccttaggtctggtcggaatcatgtgcatcttggactctagactactagtgaggatgaattttgaacggcctttaatcgtgagtacgttagttgggttagtattaggtgacttggaaaaaggtttgttggttggtgcttctctggaattgatgtcgcttggtctggtaaatatcggagcagcagcgccaccggatatgaatatggcgtccattattgctacagcttttgctattctatctggctccaatgctgaaactgctctgactattgccattccaatctctgtattaggacaaatgcttggaatattgatgcggacggtactctcaaatctgacacattgggcagataatttaatcaatgaaggaaagttcagcagagcacgacggatccacataatctatggtacggtcttatattcactgatgtattttatccctatctttttagctgtttactttggaacagatttagtgaaaaatatcgtgagcagtatcccagtatggttgacaaatggtctgactttagcaagcaaaattttaccagcatatggttttgctttgttgttacaaacgatgttgacgaaaaaaatgatcccgtttttattacttggttttctaatcacagcttactccggattaagcatcacaggtatcgcagcttttgcttgcattgtggcctttgtgatggcacaagtcaaattcaatggtaaagataataggacagcagtaagcgaacctgatcctttagatgatttatagaaaggagtttttttatgactaagaaagatcaaaatagttggaagtattggcaatttttctggcgttcgtgggcaatacaagcttcgtggaattacgaacgacaaatgaatatgggatttatgtatggtattgcaccaatcatcgataaaatctatgacaagccagaagacaaacaaaagaaaatcgatgcttatgagcggcacatggcttactacaattgtacgccgcaaacaagttcattcgttttaggactaacagcatctatggaagaacaatatgccgaagatcaagagaatttcaatccggaaaccatcagtgctttgaagacttcgcttatgggccctttgtcaggaatcggagactctttcttccaaggaaccatacgtgttttggcctttggctttggaatcaatctcgctcagcaaggtagtatcttaggccctatcttggccattatcatctccttcattccgtcctttttcgttacatattatggcggaaaaattggttataatactgggaataaatatttagcgaaactgtatcaagaaggtttgatggataaagtgatgtatgtttgtacgattatcggtttgatggtcattggagccatgattgctagtatgattgggatcaccacgccgctaagattcggcaaggcgtttgttttacaggatgttttagataatatcatgccccagttgattcctttagggctgacgttttttatgtattggttgttgcaaaagaaagttcggaccggtttgatgctcactatttgtatcgctggtggtgttttactaagtttatgcgggatttttaattaagggaccaacctaatttaggttaaaaataaatagtatgaggaggaattcaaacatgaattcaacattaagtccaaaagatatcgtcaaagaaatcatcgcgaacaaagaggtggagtccatcgtatttgtcggctgtggtgcatcgaaagcagatctatatccagcaaaatattttttagaacaaaacgcaaacaaattacgtatcagccactttacggcaaatgaattcaattatgcgacacctcgctcgatcaacgatcatactgtagttatttcagcttcattgggaggtacgactcctgaaactgttcaagctaacgcagtagcgaaagaacaaggtgccacagttattagtttaacacatagcgtagattctccgttaacgaaagacgcagactatgtgatttatcatcgtttcacagaagattacgcagcaaaactagaaaaaacaggttactgcttagaacttgcagttgaactactaaatcagatcgaaggatataaagactacgataagatgatggatggtttcgacaaaatttatgatttgtcgcaagaaagtgcaaagggagcacgtctacaagcaaaaaaattcgccgaacgtttcaaaaatgaaaaggtgatatatgttatgagttcaggagcgactcatgaagttgcgtattccacttctatttgtttaatgatggagatgcaatggattcactctggtactttccattctggtgaatttttccatggtccatttgaaatcacggacaaagacgtaccatttatcttattgatgaatgatggtcgtacgcgtcaaatggatgcccgagcactgacttttttgaatcgtttcgatgcaaaaatagaaatcgtagatgcactggattggggactgtctgcccacattgcgaaagaggttcttgattacttcaatccattcgtcatcacagcagtattccgcgtctatgcagaagaattagctgaagtacgccagcatccactgacaaagcgtcgttatatgtggaaattagagtattaaactagagctgaggccaagtgcctcggcttttcttcccttgcattgaaaagggtttcttattctcgtacaattgattgagcaagagtaaattgggtggtgttgatcatgaacaaaaaagtagaaaaatatttaaaagagctgacaaaaaattacagtgagcatcatgcagaagatttttcagctttatcaattagcgaaaatgtcggtttgaatcgaagtacaacaagcttctacttaaatcaaggaatgaaagaaggagtattggtcaaggtcaagagttaccccgtctcttttttacatgttgaagctttagctgaacttggcatttttcacagagaatctgaatatgaaacttgggaagacttatttgcagcagaaaaagccaatgcattagaaacggtgattggagcaaatggcagcttaagagaagcagttgatcaaataaaaacagcagtactttatcctgggaatgggttacctattcttttatcgggcaatagcggttcaggaaaaacatttttagcagaaaaaatctatgaatatgctgtagcagaaaaggtcatcccaaaagatgctccgtttatctcttataattgtgcccaatatttcaacaatcctgaactcttgtcttctgctttgtttggccatgtcaaaggagcatttaccggagcagaaaaagaacatattggattgatagaaaaagctgataatggcgtattatttttggatgaggttcaccgcttaagtgatgaagggcaagaaaagctttttacatttatggatacaggagaaatttcaccgatgggggacaatgcaatcagacataaagcaaacgtccgtatgatatttgcaacaactgagaatgtctatcaaacatttttgccgacctttattcgccgtttgccagtgattgtcatgttgccgaattatgaacgtcgtccgcaatcagaacgtatgcaactgatagacacattttttatcaatgaagcgaatattttgtcaaaacgcatcgatgtaagttatcaactagtggactttttgcttaatagtgacttagaaggcaatgtagggaagataaagaacatcgtgaaatatgtctgcggtagtgcttacgccaaaaaccaaaatagtctgtctattcgagttcgtttgaaggatcttccaactgaaaataccatgcagctaaaagagcagctaaaaaaaacgattaaagctttaccagaccgccaatatttgccgcatacagctaaccaagtctttttagaatcttcagaagtcaggcaaatcagacagttatttgaaaaaatagtgcaaatgtatcaaaaagttgaaaagcaagaattaatgatcaaagattttattgatcatacggtaaatcgaatcaatcatttgatggacgagtttatttttaaagatagttattcgaaagaagaatcattttattctgtactaacctatcagatacgagaaacttttgattggatgcatgaaaactacggattggaacaagatggtaatcgtgtgattgccctagcacagtatctctaccataaaaacaacacagatatgattgcagaaaatcatgaatggcaaagtgtcaaagacaagttgttagaattggtttcgagttccatagatacttcttattggtatgctaaaaaagtactaggacatatttctcgacaattagatcaagattttaaagaggaagatttgatttttatttccttttattttcatgggttgcagatcacgctaggagaaaagaaaatcaagagtatcattttagttcatggttattctactgctagcagtatggcgaacgtaggcaatcggatactgaagcagaatatctttcaagcttatgatatgccaatcaatatcacgttagctaaagtagaagaacaagttattcgctttatcaatgatcatcaaacggacgccgggttgattttattagtagatatggggtcgttgaacgaaatcggaaaaaagctagcagataaaatacgtggtccactgctgattatcgattatgtctctacgcctcttgtattggagattgggcagttgattcaaagacaaatgtctatcgcagaaatcagccaaaaaatcgatatagaaaacaaagtaaaaaaacaactaatactaccaaaaaaagaaaaaacacaggcaatcttaacttgctgttacaccggaataggttcagctactcaaatacaagagattttggaatcttgtttagaaaatcattgcaaagaattgacgattattccgtatgattacaaaaaattgcaaaaaaataaaatgtatgaggatcctttccaaatatatgaagtattgatgattgtaggaacagaagatcccaaaatcgaacagattccttatattggtcttgatcatttaattaacggtgaagatgttgagaagttcatttcaattctacaagattattttgacatacgtgataaagatttaaaagaacagctgatgttcagtttttcaattaataaaatcatcgaaaatttaacgattttggacgcaaccaaactgttgcgtttagtgcaaagtgctgtatccgtagctgaggaaaccttagagatcactctatctaatagtaagttgtttttactatacctacattgctgctgtatgattgaacgaattttaaggaaagaaagtgtggatgaacaagaagatatagaggaatatacgactcaagcaggtgcagaaatggaacagatccatcgtgcctttttcgaaatagagagtgagtatactatcaagatttccacgttggaattacgattgattcatgaaattatttatggataggaggaaggtttgcgaatttaggcatgatttttgatatggatggtgtcttaattgactcagaaaatttttattttgatcgacgtatgcaatttttcaaagaaaaaaacatcctaccaggttcgacgaataagttggatttcgttggactgacagaaaatgggatttgggaagtattggtctcagaaaaagaccaacgagctgatcttagaaaagaataccttgcgtaccgggaaaaacatcctattgactttaaaatagcactgcgaaagggtgcggaagacatcttggattatttaaaaaagaaaagtatcaaaattgctcttgcttcttcttctcctcaaagagaaatcgacaaaatgctgacacagaatgctttagcaccatacttcgattttgtcatttcaggagaaaagctatctaaaagcaaaccacatccagaaatttatcaaatcgcagtaaatgcattggatggtagacattgcatcgcagtagaagattctcctgttggtattgcgtcagcaaaagcagctaatttatatacgattgcattaaagcaagatctgccccttgatcaggcacaagcagatatcgtgattgatgacttgaacgatatcattcaaataatcgaaacttacgatatagattgattcaactatctgaaaaagatttaaatgccccgaaacttcgtgaaatttttgaacaagaatcttaagcatataattaattgattgtgagaaaaaatggctatcaatcgatataaaaacaatccaaaaactgattgcgaaaagtatcttttcatcagatatgaaaagaaacttctatcgtgatcagtttttgatttttgcaaaatttattttgctaagactaaatagcagagaaaagagaataatctcttctctgcactctattctatcgagagtttctctattttttggtaagcgagctgttgcgaaaatggaaaagagcggaaatgttgcgaatgtcagttatttaatgatatgatattcggaaaaagaaatctcaaagggaggtaacttttatgggattgaatgaatttattttaggattgaacaatttagagacgatcacaagggcacctggtttttttaaatatacggagcatacagtcgcagcacattcgtatcgtgtagcatctattgcgcaagttctaggagatattgaagaagcaaatgggcagccaatcgattggaaactgctctatgaaaaatcactgaatcatgactacacagaacgttttattggtgatatcaaaacaccagtgaaatatgcaagcaaagaattaagagggatgctgcaaacagttgaagaaaagatgacggacgaattcatcaatcaagagattccagctgagttccaagaagtttatcgccgtcggttgttcgagggaaaagatgaaactgtagaaggagaactattagccatttcagataaggttgaccttctttatgagtcttttgatgaaatcatcaaaaataatccagaaaaagtttacaaggagatgttcattgaggcagtgacgactatcaaaagctttgaacatcggccttctgttcagtatttctttaaagagatatttccggaactattgaaccaggaattttatggaaaagaggcgtttttagaaactgtctcaacgattgtaaagaaagaagaaaaataaaaacgatatgagatgcagggggaagtatagttgaaaaagaatatggatgtcgaatggggctattctggagacagaggtccggaaaattgggcgaatttatgtgattggtttgcgagaggtgcggaatttccgttgcagtcacctattcatttaacaaaaggtgaagaaataaaaatgaaaggagagacactttcgtttcattatcaaaagcaacgcttcactgacaaggaattcaaaaatacgattcatttagtaccttttgatcaactcagttatgtagagttcaagaaagaacgctattatttgacagatattcatttccacttaccatcagaacatatcatcgacgggaaacaggaagatattgagtttcattttgttcatatgaacagcaaaaaagagaatctggtcgtgggcgtcatgtatcagttaatggaacaggaaggttggttttatagtcaagaaaatggagagagatggaatttagaaaaacatgaacactgggtaaatccagatgtcttttttccagagaaaaaaagccattttcattatgtaggttcattgacaactccacctaccagcggaccaatccaatggtttgtgatggatcatgtagaaaaattgaaccaagagtttcttctacccttcaaagggcagtatgcacagccgaacaaccgaccaattcaacccttgaatggaagagaaatttattattttgaggagtttgagcaatgaatattcaacaaatgaaatatgtggtcgctgtggcaaataatggtagtttcagagaagctgcaaagaaaatgtttgtttcacaaccaagtctttcagctggtatcaaagaattagagaccgagttaggaatcacgctatttactcgaacgaatcgaggtgcatatttaacagaagaaggacaagatttcttaaatcgtgccgaaaaaatcttggttcagcttgatacattagaaagtcactatctaacgagtgaaaagagagagaatttttcaatcgctgcccagcattatgatttcttaggtcctttgaccgcacagctactcgaggaattcaaagatgaaatcaaacaatttcggatcatggagacgacgacggcgagagtgatcgaagaagtcaaagagcagcacagtgaaatcggcattatttatatgaacgagcataatcaagctggtatcagaagatatttacaacaaggagaactaagtggccgcagcattggaaaatttaaaacacacatttttttaaggcatggacatccgctagctacacacgcagagatcacaaaagaagaattgttatcttatcctcaagttcgttttacacaggatggaaataattttccgtatttttatgaagaccttatcgagattcctgatcaagaaacagtgatctataccagtgatcgagggactttgatgaatatcgttcttgaaactgatgcgtacgcttcagggtctggtattgtgattggaggaattcgtgagcacttgcggttaattcctttagcagaaggcgagctaaatgaattttatatcatttattcggcaaagcgcccgctcagtgaaatcgctcaaagatttatcaaagagcttcctcggttactggaccaacagaattaagaaaagcagacggaacatctgactgatattaagtagaaagaacagccaaacaaaacagtttattcgaaataaggggttgtgacacgaattttgtcacaacccctctttttatagaaagcaatttataactgattgcttttatgaaaaagtacgaaaatatgattctaagaaaatacattcattacccgttttgtttcatagctataattttctcttcttctggtgtcacgatgactgttttctgattttcataaatgacgtaaccaggtttggcaccatttggcttgcggatatgcttcacttgtacaagatcaactggtacttgggcagaatatcgatattttgaaaaataggcagctaactcggcagcttcggtaattgtttcatctgaaggttgatcacttttgatgatgacgtgcgaaccagggatattttttgcatggagccaatagtcggttttcttagctgttttcattgtcagctggtcattttgaaggttgtttttaccaacaagaatgagcgttccgtcagaagaaaagtattgatcaggctgagatggtttctttttcttttgttttttctgtgtcttctttttcaaatagccctcagcagtcaattcttctttgattgcttcgatatccatcggaccggcaatttccagttgagacaagacagattcaagatattggatttcatctttggcttcttggatttgttcgccaatcaacttaacggcgttcttcagcttttggtatcgatgaaaatatttctgtgcattttgatttggcgtcaacgccggatctaatgctattttgattggccggtcttcttcataataattaggtaaaacaacttcttttgcgccacgtggtacttgtgttagaaaagtagtaagtagttcgccatctctacggtaattctcagcgttttcggattctttgagtgtttgttcacgttttttcaatttatttttatttcgttttagttcattttcgatttttcggatcagttctccgccttgttgttttgcccgatctttctccgctttttcgtgataatagctatctaataattgactgagtgttggataagttgtcacagcagatgcttgttcggaaaatacctgataaacaatcggcgtaaagaaatctttatttgtcgtttcgtaaaaagtagggtctgggtgattgatgatcgatgagaaaaattcgtcccaaacaaccattttttcattaggacgttcaagcaatctcttggtcagctcttgagcagtatcgaaaccgattccctgaaactgatattggattgcttttggttctagttcagtttgagaaagtcgctggaagattttttctttatcggagctaaatgggttcaagacctcttgttttggcggagcaatgtattctacgccgggaagcaaagaacgataagtgttttgagagcttcctatgtgtttgatcgcgtccaatatttttccagtttcttgattaactaagacgatcgtactatgacgccccattaattcaacgatcaatatgatattctgtaaatcgcccaactcgttgcgcttagcaaagtgaaaatggatcactcgatcgttttcgatttgttcgatgctttctaaaatagcaccatccaaatactttcgaagcatcatcacgaagttaggcggattatcaggattctgataatcgatttgggtaatctgtacacgagcataactagggtgcgcagataataataatcgatggtttttgccgcgtgaacgaatcaccagcacgatttcattttcataaggctgatggattttcgagatccggccagatagtaacgtttcacgcaattcgttgaccatcgcatgggtaaatacaccatcaaaggacatggttcattcctcatttcttttcataagtatattcattataacgaaaaaaagaagaaaaaccaatttggccgaatagtgaagcaaaagtctagaaaaaattggactaattacataaaaaacagtgtttttatcgttgaaatccaaatttttaggtataataaaaaataggagaaaaagtagaaaagaaggtgtttgttatttgggaagcagttaaatcgagagtacaagaaatgaatgatcatttctcagtgtcattcgcagaaaatccaattaagtattttcgacgtcttgtgtttctgctcatcttatcattgctactaacaattgcgatgtttttgttgccggaaaaaatccgagaagagcaagtaaatagtctcgtttattcatccataccaaccagcaaattaaaaccttttgattacagtcaagcggatcagaaaatcaaacaaagccgagcgatatcggtgatgttcagcaaaccgaacgggaaaacctatcaggatatgctggatgtctttaatgaccctgagcttatggaagaattgaatcgaccgatcttttattatccgatcgtttatgacgtacatgaactggaacaaaaatataacatacgaacggatgaagtgacatttattttctttgatggaggaaaagaagcaaatcggataactgcgggtaagggaggaataactgattttgataaggagttgatccctgagctgaatcgactaccgttagccaatatcaaacaattagaagaagaaatggatagaacaggaacagcttccccaaatgccgagactgctaattgagttgttaacgtgatgaaatggtggctctatatagcgctatttttaattatcagaacaagtgatgtttgatcttcaaaataacaaatgaaaaaaataaaaaatatagttgacgaaattcaaaaattcgattagacttaaatcaattcttaaggaaagggtgacctgtaatgaacttatcaaaacgtatttcagcagagaacaaaaaaaattggcgcagctggcgtagataagttgtattaatggtgaaactttcccatagatacaactttttagagtgcatttctaaagcttgtatctatgctagacatgaacattgactgccgcatagatcctatctatgcggttttttgtgtaaagacaatgaccgttttggccattgtctttttttgtagactggatacttgcctgattttaataaataaaaagattgactttgcaggaggaaaaaatgaaaaacaaacgtttaataacagttgtagtaattattttagtttatttagcaggtgcatttatttatggaaaagcctcaggagaaaaagaaagtacttcgacgaaccagacaaaaaaaacaacagttgtcggggtattgcaatatgtgagccatccggcattagatgagatttatcgagggatcaaagatggtctgaaagaagaaggattaaaagaaggagaaaatcttgaaatcaaatatcaaaatggacaagctgatcagagcaagctagccacaatgagtcaacagctagtacaatccgatcctgatgttttgatcggaatcgcaacgcctgctgctcaatcattagcaaacacgacttcgtcgattcccgttgtattaggtgctgtaacggatcctgtgggggctggattagttggttctttagagaaacctggtggaaacgtgacaggtgtttctgatcagccacctgttgcttcacaaatcaagcttgcttctgatttgctgccaaatgcaaaaaaagtcgggatcttgtatgcttcttcggaagataattcaaaataccaagtagcacaagcggaagaagctgcaaaaaaagaagggttagaagcagtaaaatatgcggtgccttccactaatgagattgcacaaacggtacaagtgatgagccgacaagtcgattttatctatgttccattagacaatacgattgccaatgctatgcagacagtggttaaagaagcgaataaagcaaatatccccgtcattccttctgttgatacaatggtagaacaaggcggactagcaacaatcgggatcaatcaatatcaattagggcttcaaagcggtaagatggcggcagaacttgcgagcggaaaagaaaaaccggaaacgacacctgtctatatgtttgatcaaggggatacagtgatcaatcaatctcaggctgatcacttaggaatcactattcctcaatcgatgaaagaaaaagccaaaatcattacagatgagtcgcaacaagaaacatctaaggaggatgacaaatgatcgtatcagctatttcacaaggcatgctttgggcaatattaggattagggattttcatgacctatcggatcttagattttcctgatatgacgacagaagggtccttcccattaggtgctgctgtctgtgtgacagctatcactcatggggtagcaccgattttagctacgttattgggcgtaggtgctggtatggtagcaggactcattacagggttactttatacaaaaggaaagataccggttattctagcagggattttagtgatgtcaggattgaactcagttattttgtttgtgatgcgaacaccaaatctatctttattgaatcatccgattctacaagacagctttcatcgctttggattacctgattactttgacacagtccttcttggcttcatctctttgggcatcttgattgctgtactgctattctttttcaatacagatttaggtcaaggctatattgcgacaggagacaacgaaacgatggctcggtcgttagggataaaaaccgatcgtatgaaaattttaggtttgactttgtcgaacggtgtcattgcattatccggtgcgctgattgcccagaatgacggatatgcagatgtaaataaagggattggcgtgatcgtcatcggtcttgcttccatcatcatcggtgaagtgattttccaagaattgacgctagcagaaagattgattgctattgttgtcggcagtatcatttatcaactattgattttagtagtaatcaaactagggtttgacacgacttatctgaagttgttctccgctatcatcttagctatttgtctgatgatcccgcaattgaagaaagcactgaacttaaaaacgggttttgagaaggaggcatagtaatgacagatatattgacaatcaaaaacggcagaaaagtcgtaaacaatgggatgaatgaagagaaagtactattggatgaaatcaaccttacaatcagagaaggggactttatcactgttcttggcgggaatggtgctggaaaaagcacactgttcaataccatcgctggtacgcttcaactcagtcaaggttcgatctcttttaaagatcagctgattacaaaagattcagaagaaaaaagagcacgattcctttctcgggttttccaagaccctaagatgggaacggctccccggatgactgtagcagaaaatctgctacttgcacaaaaaagagggcaaaagcggaaattccgtttacgtaacttgaaaaatcaaaaagaagattttttcagactatgtcaagaagtcggtaatggcctagaacaacatttggatactccagcaggggaattatctggcggtcaacgccaagcattaagtttgctgatggcgacgatcacggctcctgaattactgttattagatgaacatactgccgctttagatcctaaaacagctaaagcattaatgcagttaacaaatcagcggatcaatgaacaaaaattgacttgtctcatgatcacgcatcgaatggaagacgccttgaaatacggaaatcgtctgatcgtactccaaaaaggaaaaattgttcaggatctttctgaaaaagaaaagcaacatttgacaatgggcgaccttttgcagttctttgaagaagtagtagattgatttcgacagaaagtctcctttcagtagaaggacttgaaaactcattgacatcttcctttgattcatcctatacttaaaacaataaacaattggaacatatttgggtgttttgtaggatcacgtagtcaatgattttaacaattaaatagaatattctttgctctgacaagtgaacgatgagaaaagaatttgctactttgccacctagacgtttcgtactttttcgtatcaaacgctaagtggctttttttattgaagtaagaacaaaggaggaataagatgatttctggacaaaccaaattagctggactctttgctgatccagcttctcacagtttatctccattgatgcacaatactgcttttgaagcaaacaacatcgatgcggtgtatttagctttcaaagtaaacccaatgaatttgaagcaagcagtcgaaagtatacgaacttttgatatgttaggtgtgaacctttcgatgccgaataaaacagcggttattccttatctggatgaggtaagccaggaagcacaattgattggagcagtgaatacgatcgtgcacgaaaaaggtcgtttgattggctataataccgatggtgcgggcttcatgcaatccgtacaagaagctgggatttcggtcaaaaagaaaaaagtgactctgctgggcgctggaggggcagcaaaggcagtcactgttcaagcggcgttagacggtgctaaggaaattgtagtttataaacgaaacaatcaaacattcgctcaagtaaaagaaacattcgaacaactcagctatcgaacttcttgtgagataaaagttcgtgattttgccgatacgtatcaattaagaaaagacttgaaagaaagctgccttctagtcaatgcaacagatatcgggatgggaaagaaaatcgatcagtcaccgctcttagatataaacatgatgcatgagaaactagcggtttttgatttgatttatgcacctagagaaacacgtttattaaaagaagcaaaaaaagtaggagcaaaaggatacaatggacttggcatgttgatctaccaaggagcaatcgcgtttgaattatggacaaaggaaaagatgccgatccatgtgattgaaaaactgtttgattaaaaaaggataatagataaagattttttattctcgcataaacggtctcaagaaaagtaattctttatgtatcgaagcatttatttcgttattttttattaaattatcaaaaaatgataggcttttgtcgattggttatcgtatcctttatttatcagtaagaaacgaggaggaaccacaatgagtcggatggatcgctataaggacatccataagaaggcgaaacctctgaagcgggatacggggagtatttttgctagaagagaacgaaaacgaacgcgtatggaaaatgaggaagatgctacccgtatttatgaaagagagcagcactcatttgaacatttgaaccaacacgaacaacagatatatagagatgcaccaagaacagaagaacaacaaaaaaataaaaaatttttcaatcggcaaaagaagaacaaaccgttgaaatctcgaagaaagcgatcgtggaaaaaaatcattctatcgattttgcttgttttgatcctttattcaggtatctcattttttattggtaaatatgtagctgaacatgacacaagcttagaggcagcgacttcagaaacctttcatgggcaaaaagcgacaaatggtgcgcataatattttgattcttgggagtgatacacgcggagaagatgctggacgagctgatacgatcatggtcttacagttggatggtccttcccataagccgaaactgatttcttttatgcgtgacagcttcgttacgatcccaggggtaggacaaaataagatcaattcagcttatgcatacggaggagccgatctagtgcgtcaaactttagtagaaaattttggaatcaattgtcaatactatgcgaaagtcgatttcaaatcgtttgaaaaagtgatcgatgccttgttcatgaacggagtgaagatcgatgcagaaaaagatctgaatctggatggtgtagatattaaaaaaggggtccagaagatggatggacatgttcttttgcagtacgcacgtttccgaatggatgaagaaggagactttggccgtgtcagacgccaacagcaagtaatgaacgctattttcagccaattgaagaatccattgaatctgattcgtgcaccttatgcagctggtaaagctttagggtatacatccacagatgtcactgcttggttcttgacgaaaaacctcttttcgattacacgaggagctggtggcattgatcgaataagtgtgccagtagacggttcgtggaattatgggcaaagtgattatgctggtagcattcttgaaattgataatcaaatgaatcaatcagctattacagattttttgaataaatgatcataaaaaagattaagaagaagttgcgacaaggcttttgtcatgaatcaatcaaacgattcactcgtaaaaaacgctttcttatgatagattataaccaagaaaggagctgtttacattggatatctatctgaacttcaaaaatgagtctcgtgaagccatcgctttttatgaaaaagtttttgagactgaagcatcaggtatcaccacatacggtgaaatgcctggaatagaacaaatgaacttgccagaagaagcaaaaaatctaatcacgaatgcacggttgaacatttatgatacattagttatgtttgcagatacgccagaaggaattggtcctgaattagttgttggaaataatgtttctttagtcatccaaacaagaaatgaagaggaaacgaagcgtctatttgaaagcttagctgagggtggtaagattgagatgccgctggatgctgttccgtgggctcagttgtatgggatggtaactgatcgatttggcatcaattggcagattaaccaagagtgacagctaaagatgaatattttctagaaacatcaagcagcaaacggaacatcgtttgctggcttgatgttttttgtgcctatttcgactatacggtaccttttttttattgccagatgcgaaaatatgttccataatagagaagtccgcaaaaaatcaagtaacggaggtcagaagatgaagacggtgatactagctgaaaaaccttcacaagcaaaatcctatgccgaaaccttccaacagcgaaagcggcatgaagggtattatgaaatcagcgatccattgtttgctggtgaagtaaccatcacttatggttttggacatctggtagatatggttgctccaggagcttatgaagagcgttgggcaaaatggtctttagaaaatttgcctattttcccagaaaccttccgttacgaagttccaagggacaaacgtgcacaattttcgattgtaaagcgagagttacagtcagccaataccatcattattgcaacagatggtgatagagaaggtgaagccatcgcgtggtcgattattcgtcaagcaaacgccttttctaaagaaaagaactatttacgtttatggatcaattctcttgaaaaagaagcaatatatgaaggttttaagaatctccaacctggaaagaactattttccaaaatataaagaagcgcaagcaaggcagaatgctgattggctgattggaatgaacggaagcccattatatagcttactgcttcaacgaaaagggattgatggtagtttttctcttggtcgtgtacaaacgccgacactttacatgatttatcagctgcaagaagaaatcaaacacttcaaaaaagaaacatactttgaaggagaaggtttaattacgacaaacaaaggacaattttcaggaaaaatcgtaccaaaaaaagcatttaaaacacaagaagagttaacaaaggatatagagagactcggagcgcatttaggtaagcaaaacggacggattcttgaagttacgaaaaaggaaaagaggttgcatagcccacgtttattttcgctatctagtttgcagacaaagatgaatcagctaatgaaagcaagtgctaaagccacacttgatgctgctcaaggattgtatgaaagcaaatttctaagctatccaagaacggattccttttatatcacagaaaatgagcatcagtatctggttaaacatctgcaaaactataaaaagtttttaggaatagaagaagtacagacaactgagatcagagcaaagaaacggtatgtcgatgcgaaaaaagttcaagaacatcacgcaatcattccgacaaagacgattccgactcctgcacgctttgcgaagctatctaaattacagcaagcaatctatttgcaagtcttacgtaccactgtggctatgtttgccgcagattatatttatgaagagacgactgtcacgacgggtgtacagcaattaaagctaaaaagcaccggaaagatcccattacagcaagggtggcaggaaatcttgcgcatcaagtcaaaaaagaaagaagctcagacgcttcctcctatcgtagaaaatgaagaagcagaagtagagctgaaaagtatggagaaagaaacacaacctccgaaaccctataccgaaggaaccttgatcacagcaatgaaaactgcgggaaaaacgctggataatgatgaagcgcaagaaatcctcaaagaagtagaaggaatagggaccgaagctacacgggccaatatcattgaaaatcttaagcagaaacattacatcgaagtcaataaaaacgaaataatcgttacgccaaaaggaatcactctttgtaaggcagtagctaatgaaccattgctgacaagtgcagaaatgactgcacgctgggaaggatacttgagaaaaatcggtaaccaagaaggaacgccatctgtttttttagaaaacatcaaaaaattcatcttacatttattggcagaagtacctaatcaaatcgataaggtagatttctcagatgagatcagcggaatacgccagataaaagcgatggagaagaaaaacgaccaattaggaagatgtccaaaatgtaaaaaaggggtagtcatgctttatcctaaaatcgctacatgtttgaacccggaatgcgacttcaaattgtggccaacagtagctaaaaagaagctgactaaaacaaatctcagagatttgctttcaaaaggaaagacaagtaaagttgtcaaaggttttactggtaaaaaagggaaattcgatgcagttttagtattaaaagaagatatgacgatcggtttttcttttccatggatcgaaaacagcggaacaaaagcagttggtggaaacaaagaaacatcaagaaaaaataatgaaaacgaagtagagtaaatgaaaacaatgaaatagcagaatatttattccgaaaagtgagaatataaataccaataaaaccaaaaaatatcagtcaatcaagcaaaaatgttggggtaggctgattttatatagatagcaaggagtttttttatttgaaaaaagtgcattcatttttaaattatcttatgggagcaatcacgattgtggctgtataccaagcatttctaaagtatcctgattacgggacgaagttgctgtcattgacgcacaatcaaacagcatattcaccaacgctgattttatcgactttgactgcaggagctaaaagcgctacttatttttttcataaaacgacaagcatgttgaagcgaaagaaacagcgtaaacaattgttgatggtggtaggggctatgatcattatttatttcctaccagttattacacaagtattccatcaatattttggttaaaaatacgagagtttgtgacaaaagtcatgtcacaaactcttttaaattttttctttttcgtttttccgtaagaaaaagtaaatcaatagtatatacattgattaaatgtatatacttagatataatgtacttactatagaatgatatagaatatagagggtggcgaaatatgaaaaaaatgaaaaagtataaaattagaaaatccggcaatagcgatgtaacaactatcccaccagaagtaaaagaattcatgggtgtgcagacgggtgacgcaatcagttatgtttttcaatctgatggttctgtacgaatgatcaaagcacaagaagaacctgatattgatttattagttgattcgatcatgaatcaatatgaagacgcgttaaaagatttggttgatttatgaggtatctttcgactaaagaaattatcaaaatcaacgcaaaagttattttacgttactcaccaggcgaaatgattggtataaaagatgccaatgcattagatatggcagttaaacagccttcacaagcagtatttaatcaagaactctatcccgaagtctatgaaaaagcggcaattttagcaattaatttagctaaaaaacatccttttcataatggtaataaacgaactgctcttgttgccatgctgttgtttcttcaattgaataattgttcagttgctttttctcgtcaagaagctgttgattttattataatgattaccactagttcattggatttcgattcactgaagtccaagataaccaattatttacgacaaaccgcaataaaatgaacgaattaaaaaaatttatttctccattcgatcagcatgtcattaaagaatatgctgattttttgtatggttgttcatacaaaatagttttttcataaaaatatggattaattttgaaataattgatttaaaaggaatacaaaagtgtgaagagtaggaaatagtggtttagaactagtggattgattttttatatattttagtttacataatatatattatacaaagtagatttaaaaaataataagcctctctcgaacggttttttatcaaaaatcgtcatttttccatcaaaatctacttgtgcaaaattataaaaaaattttgcagtttttcttactttttcagcgtttaattaaatgataaaaaccattttctttatacagttaatcagattacgactcactgtatttatgtttgccatcactgaaggatttttaatcacatagataaatcatttacttaagttttagttgtcattgatatcgattcgattatttaatcagcaaattacatttcatacgtatggatcattttcgaccgaatcgattataatcattccgtttatttgcttacctatagatatcaataaaaaacctgcttaacagctgaaatatctgttaagcaggttttgattttttagttcttactcattatttcttataatacagtgttcaatacttctcttaaagcacttgttgatttgctgaacattgctttttcttcttcgttgatggacaattcaacaacttcacgaacaccattttcgtcaacgattgatggcacacctgtaaagatatctttttcgttgtattcaccagttaagtaagcagatacaggcaatacagcttgttcgttattcaagatagcttttacgatacgtgcagtactcataccaataccataataagttgcttttttacgatcaatgatctcataagcagcattacgaactttatcagcaattacatctaattcgtcttttgcgatacgatgatctttttctacaatttcaaaaactggtttaccaccaacagttgtatgtgaccatgcagcaacttctgaatcaccatgttcacctaagatatagccgtgaacgctacgtgggtctacttttaatttcaatgcgatttctttacggaaacgagttgtatccaatgttgtaccagtaccgataacacgtgatgttggcaggcctgactcgttccaagcgatatatgtcaaaatatccactggatttgaagcaacaacgataattccgtcgaatcctgatcccatgatttctttgacgatttggcgcatgattgacgcatttgtcttaactaaatctaaacgagattggccaggtttttggttgataccagctgtgataacaacgatatctgaatctttacattcttcataaccgcctgaccatacagcaacgttttcatcgccccaagccataccatctaaaagatccagtgcttccccttctgctttttcttggttcacatcgatcaagactaattcattagagattccttggttgatcattgcataagcgatacttgttccaacaaaacctgtaccgacgattactactttacgacttgtttttttcatgaataaacagctcctttttcataactatttgttactttcatggaaattatagtcttgtttattcattttatcaatatgttaattataatagctgttattataatttttgatggaaacgaattcctaaatacgtacaacagataactgataaacgattacacccatgtaccctgccaacacaactaaaagtactaacgctatcactaatggagctactttagctccaccttcatcaaagctatactttttccttgtacgctttagaactgaaaataaaaccaagccaaaaataattaaccataataaaaagccaatcgcacctaaaatcaatatcccttcatttacgattgaaattcctatatccatttgctctgctccctcattgtcccatctaaagttttgttttgttataaacgtttttctttactttgtccgtatcagtcaatcctttttcgtaattttcttggatcgttttcttttgtattttataggatgcagctaactgtcttttaaatcggcgtttgttttttcgtatactggtgccttttagatattcatagaactgtttgacgataaaaatgaacagatagacggcaaaaaacgtggacaatccgtatcggatgagatacatagcaacgaaggtggcaaaaataccagttccttcattttgtgctaagacagcaaattcgcttaaaaaagttatgataaatgcaaaatttcccatgcttcacctcattgtaaatagtaaatagttgccgtatcatcctttgatttctttaaagagatagaaaacatcacttacgatagtttttatattgctgctgcttctgaaaacccttattaccaggtgcgttactcttcgtacttgaacttgcggacatctttttgctcaacagaacagttaatagaatcacgaaaaaaagagcacctaataacacaaaacgatacttagacaagtacatagcgaacgcagaaaataaatcagtttgtccaacaacgctgtaagcagctaaaccacttaaccaagcctttaccattttcatctcctcctcccttcttcaatcacattatctaaaggatacaataaaagaagtttaaaaaaggaactgctttttcttgtttatgaaaaaactgttccttctatatgtttattggaagataagaaatgagtacactagtatcggatataccttatgatatgtaccaaacaaaagtctatctgtctgactaacctattgaaatgagtgaatattatgaagaataagtccaatggttcatcttagataaagtatgtctttttgagtgtcctctatttttttctgccacgtgtccaattaacaatggattcccatctatggacgctaatcttccaagttagaaagatcagcgtatctatcatcactgtatgcttactagtgagtatttatcaaatgaagagaaggcaaaagtggaaacagccactactaaaacatctatttatagcaacttatctcctatatggtgccatcaactttttccttcttctcttgattgagtttagttaatacgcggttaagactttgaatagtcttacctgttttttacatgtcagactgttcttcttatcgggtgtttctccattcattgggtgtacatgttgaatactttttgaataatttgaataaagaagtggtttgtttatatccgatgcgattagcaatctcttccaacgaaaaactcgtttcttgaatcaattccaatgcaaagtcaaattttttttgtagaaccaattcttgaaaagaagcaaaaaattcattttcaatttattactaaggtagaccggattgtagccaaaatgagccgctgtttcttttaacgtacaagaagtaaaatgcttatcgatataatccaatataccaagcatctcgttttctgcgtatccatctgctgacgaaaaggtttgctgttctaataaatgagtcaattcgattagtagtagtgatatataggtttagtgaacggattttatgactgtatgtatcaaaataaatcaacagcatattttcaatcaaatgcgtcaaacgactcgcttttccgccatgaaaatgaatgaattgcgtatgttctcccttttcttttgccgcattgattaaaaaagaagaaagcagattattggtgcttgccaaatggttcaatatttctgtagataaggtctcttcctttaataagatgttgattaaaatatcctcttgacctgtgtattcaattctttgagtagcttctttatcaatgattaccacgtcactttcttccataaccactctttctccattgatgacctgtgaacatcttccgctatacatataattgatttcaacaaaatcatgtgtatgctcaggaacttccgcatatcgacggtgtttactgatatgaatatttccgttttgaaataaatctcctcggtggatttttggtggtgtctgaagatgataagctaagtttaagtcattgacattctttccttgttcacgctgcagagtttcgattgattcttcattacgcaaaaaagtgtctaattcagctagttccaattgacttcctccttcttgtaagcagtttctttcgcttattagtttacgctgtactgcaattatatgcaaagctattttggttttcacaaagactttctatggttgggacatgaatttcctgtggttccgctattgagtgaagagctacttcatactatatttttgataagcgcttacaaaaaagtgaaaggaatatgtgtatgaataaaaaaatgatgaaattttctctactgtcagtctctcttattttgacttctgctggtgcggtcacatcagcgattcccagtatgtcagctacttatgcctcgcgttctttatctgctgttgaattattaacgactgctccatcttttatggtcactattttcgttttgtttagtagttttattgctaggagaatcggacaaaaacagactgtgatcatcgggttagtgattgcatcgatttgtggtgtctccccctcttctcgcaaagttacagtatcgtcttagcttcacgagctgggctaggcattggcttcggattgatcaattctttggcagtcagcatgattgctgccttttatcacggagatgaacgtgcatctatgattggttttcaaagtgcatttcagggatttggtgcagctctaatgacatttgttgcaggacaactagtacagttcggctggcaatatacttttttagtctacgccatcagcttgcctattttaatcttgtttgttttgtttgttcctagacctgaaacaactgagattcaagtacaaggcacagcttcagcaagacaagtaatcaaaacaaatcccaaaatgattagttatggtatttttctcttactgatcatcgtggtatataatgctgtctcaatcaaattagccacagtcttgacgacctattctctaggagacgaaaccaatgcagcgaatatcttgaccatcatgcagttggcaagtatggccgccggagtttgttttggctggcttcaggcaaaagcacatcgttatatgcttactctttctttactactgatgggtattggctttgtattgattgccagtgccatgaatctgtatgtgattggatttggcgcgattttaactgggatttctttttcgttattcattccttatttattcaaccaagtgagcatccaagcgcctaagcatgcggagagtttcaatacttcgatcttactagttggcgctaatttaggcactttcattgcaccatatggtttgctttttctctcttttgtttctcttggaagtaagacacttgctgttttcgttaatggcagtatcttgctgttgattagcgcgcttgttagcgttctagtggtatacaggacgaatagaaagacagtgataagagtagatgaagaaataaaagaacaattgacaacaaaataattttgatggaggtcgcgcaaaatgacaaatgaaaaatcacaaaatagatggctttggtatcctggagactttgagatccgccatggactgctacaaaatttccaacgagaagaacgaggtttcgactggccggcgtactggtacatggatgattgtcatcggaatgtcaagtttaagagatattactttcttgatcatccttccatgttcaaagtgacgatccaaggagttgggtacgtagaaattaatgggcaaaagcatccatgtggaaaatggctgacttgtccggctggtaaagtaaaaatccggatcttcgttggacatacatctgggctaccagcgatgtttatcgagggagatgaaataaaatcagatatcggctggacagcaagcaactttattgaagaatacccagctggctggagtccactctatgtcgatatcgctaaagatccaaatcaaatctattatcaaaaagaatgtgtccatccagttactgaaacggaggttaatggaggagtcttattcgattttggacgagcagtgaatggctgtgtagaactaatatctctggacgatcctatcgaatccatcactctatgttatggagagtccgatgtagaagctatggatatcgagtattgttactataaacaaattggaatgacaagaaaaatgaaagctcgtaaacgcgcttttcgctatttgtttataccggaggtttctactggaatggttcaacttcaagtttttcatgaatttttatctctttcgaaacaagctacttttttaagcgattcttctttattgaatcagatctggttagtatcagaagaaactttcaagttatgtagtgatttgttttttatcgacggtatcaaacgagaccgctggatttggtctggagatgcgtatcaatcatttatgatcaatcaatatcttttctttgacgaggaaatcaataagcgaacgatattcgcattaagaggacaaaatgaaatcaagcaacatatgaatacgattgtcgactattcgatcttatggctgattggcatcgaaaaccactatatgatgacgaaagactgcgaatttttacgtattgtctatcctaagatgcaatcattgatgaggtacttgatggaacaaacgaatgaattagggtttatttatggaagagcaaaagattggatctttattgattggtctgaaatggataaagaaggaacgcttgctgcagaacaagtcctattactgaaagcctaccactctatgatcacttgcggaaatatcttagctgaaacatatggagaggctgaaatttatcctactgatctctatcaagaaaaatatcaggtattgaaacaaaacctatttgactacttttgggatgaagaacttggcgcttttatcgattgctatgaatctgggagaagaaatgtgacgcgtcatgcgaatattttcgctgttttattcgattttgctaacaaagaacaacagcaatcgattttaaagaatgtcttgttgaatgactcgatcacacagatcactaccccctattttaaattctatgaacaagatgccttatgcaaactaggacagacggaaatcgtctaccaaacgattcttgattattggggagggatgttatcacatgatgcggtaactttctgggaagaatacgaccctactcaaacaggaaatgaaaagtacagtatgtatggagatccttatggaaaaagcttatgccatgcatggggagcaagcccaatctatcttttaggacgctattttatcggtttgtatccaacaaagccaggttatgaggaatttatgatacaacctaatctagattcatttgaaacactgaattgtacgctacctatcaaagatggaatgatttcgctggaaaaaaaagaagataagatcgtgattacttctgatagaacaggcggaacagtgaaaatgaatggtaaaagttatcctcttctagcaaaacagccacttgccttaacaagccattcaaaaataaatgcataaaacaaaaaactgcttgcgacctatcagaaaacattcgatcgtcttctgatattgtccaagcagtttttattttgaagcttgcttaattctgttctttagaaacaatgtttgttctttttccggcaaaaagaaagctagataatacgacaagtaaaaagaaagcgatgattccgactgtcaatgccatttgaccgtattctcctagtttcccaagtacaagtcctggtactagataatcagtatcggcaaatgtagaagaagcgattttaagatctcctaataccggaaggataaataatggcaaccaactaatcaataagctattgaaagcagaacctaataccgcccctcttctaccgccagtcgagttgccgaaaacaccagaagcagctccgcaaaagaaatggccaactactccagggatgatgactgtagtctgcaagcctatcatggcaaacatcgatagcgttcctacaaagaagctgacaaaaaagccaatcaatacagcattaggtgcatatggaaaaacgatagggacatctaacgctggtttagaatcaggtacaagctttttagcgattccttggaatgctggaacgatttctgccaacaccatccgaaccccttgaaggacgataacaaaccctgctgtaaatgttccagcttggatcaatgcaaagattacagcattatctccattgcttaattctctttcaacaaatccaggacctgctaataaggcaagtgcgacatatacgattgacatcaagagcatgatcgatacagtagaatctcgcaaaaaactgaaacttttaggaatctttatgtcctctgtagagcggtctttatttccaaagaacttaccgatccacccgctagacgcataaccgatattgccggtatgccccagcgcaacttggttgttcccagtaatgttcttcatgaatggttgacaaagagcgggcgtaatagttaatagtgttccttcaaaaatccctcctaataagatcatccacacgtttgcagtaaatccagcgcttactaaaatgactgctgtcagacaagaaacataaagcatcgcttgacctgtaagaaaaataaatttatatcttgtgaatcgagcaagtagaatattcacgatcatccctactagcatgatcaaggcagtaggtgtcccgaattgttgtaaagcaatcgccactactgcttcattacttggaactacaccttgggtatgcagagccgtttggaacatcgaagcgaaaggggttaatgaattactgatcagtccagcgccgccaatcaatactaagaatccgacaaatgttttgatggttccttggatcacttctgaaaatttctttttttgcagaacaagcccaagcagtgcaatcagagaaacgaggatggagggctgactgacgattgaaacaaacaaattcaacaatttatccattgatatttcctcccttgaatcatttttattcttttgacaagatctgtcctactttttcttttacttcatcactatcgatgatcgattgcaacggcacgagtttttcatccggtatagaagtaagtgtatctttcaaagaatgttcaatgaagaaataatccgccatatcgctagatacactcccaacatccgtatgacttacttcgaaatcgtccacatctgctccaagatctgcaagagcttgtttgatgttcatctctaccataaaacttgttcctaatccactttgacacactgcaaaaattttcatgttattcgtctcccttttttatgattgctagtatttcttcttttgttgaggcttgtaatagttcttgaagattttgtttattagaaagtagcttggttaaatttgccaacgcccgaagatgtgcctcgttatcgatagcggctaaacagataaataagctgatgggatgagcaggatcatcgattagatcaactggttgttgaagtttcagcaaagacatccctacttcgtttacaccgtcttccggacgagcatgcggcagtgcgatgtggtcgccgatgtggataaacgcaccatactgctccacacgttcaatcatcgctttgatataactctcctctattttattctttaataatagtggttgtgcggcaagtgtgattgcttcttgccagttttttggttgatcggataattggatcatttcttctgttaataattcagatagcataggacgttgatcctccttcttttctaaaagtttgttcattttacgatttaagacttgatagagcttttcttcatctacaccttcttttaattcgatatatggaagtagcgcagctagcaattcttgagcagaaggcatggagaatcctggtatcagccaatctctttgtacttgattgatcagctggtttttttccaagtcagtcatgattggttgtaggacatacagcgactttttcttattcgtaagcgtgagaggcacagtagaaaaaacgatatcgtaagaagtttcatcaacctcgtgcaagcgatcagctgaattggtctctgtaaaaaggatcatcgggaataattgctgaagttcgcttttcaagatcaatgaagagctaatgccacttggacagacgatcacggctcttatttttctgtttctttcttcttcatctacttttcttatttctccgccgaatagtatagtgaaaaaaccaacctcttcttcagggatgctcttccctatccgtttttctaacggacgcaatgcttttcttgtcatttcatggatggaagcatattgatgtttgatttgatcaatcatcacatttggcaagtaaaaagaataagagatacgaaaataggcaggtaccaagtgataaaagacattcatcaataattcacgaaatgaatcaaattctacggccatcaggaattccatgcgatggatgacttctgaagaacattccagcaaaaaatcaagtgcaggctcctggatatctccttcaacaatggaggttaagcaaagagagagaaatagaatctctgactctagatgttcggaatagcctaagccagtcaatatttgtcggctgatgtcattgatcgcaagagaagctaaaagttcagcatcttttaccttttctacagatattttccccattcgattagtggtcaaacttaaataatacgctaactcatccattcgattgggtgcaaagcgtagatctgatagagagattgtgttatctaacaaatctctagcttttgcataacaatcaagagaaagcattgcggttaaatacgtgagaccaaatcttccagcgagcgattgcattaaacgagcggtgcgattttttgcttcctttctcaatattacttctgcccccagtagcctaaagcctgcttttctagtatatgtcagctgacattcttccccttctaattcctttcttacttttttgatatccgataggactgttcctttagaaacctgaagaaaatcttgaaaatgaaatacagaaataggtatgctattcgaatagaccatcaaataaagaagatctctacgctcttgttcggtgtacaccgcttcaaagcgagtgatattcacgtatttttctgcccagtcgatcgctcgaaattttttcagatggatatgggtctcatccatatattcggcaaagggagttagttggttgattgcctcgtctatatttacttcgatgatctcggctgctctttctagactgatttctctgggtgttttcaggagataactaattttgtagttcacagcgctgttcacctcctatttgtattctagtatgataccgcttttaaatcgagggttgtttggtacaacttacagttagaattttttacgactgtaccaaacgacctctatcgggatacataaaaaaagcaggtgaccaaatggcttcctgcttttatgaattaatgatgatcgtgtttcttttttgaagtcagttcttcaaatttttctttgacctcttcaaccgctttttcgatatctttttcaaagtgattaggttcgttaggctctgattcttcttctacagaatttgaaccggataaagctgtttctttgttttctgtttcaccggagtttgtaccagctaatgattcttctttatcttctgtttcaccagaattagtacctgctaaagctacttcatcttccgttttaggggccattgaacctcttaatcgtttgtgtttttcaccatcataatttgtcatattggttcctcctagtaattctatactttttcatcgtacaataagacagtttgtgcgtcaaaaaacaaacccgattcttacaaatatgtcatgttttcatcttttattttctgattcttgaatgcctttgattccttcttccaaaattttcatctgtaagattgtttcttcatctttaatgactttttcagcgccattgactaatgtctcgtaaatgccttcgtagacgcgactataatcaccgacctcggaaatcactttttcttcatgataatccccttgttcatctatataagtcaatacaccgtagtgttcgggcaagtcgatcccaaagtcttcatgatcaggcatataaaacattttaagatgttcttcttgccgatctttcgtttgtttcacgaacatccctttttttccataaacgacgaaacttggacgttctttgatacggaaatagctggattttatcgaaattttcatgtttccgtagaaaaagtccaaatcgaagtaatcattcattcgtcctttccctaatagttgacgaacatcataacggatatcatctggttcgccgaaataagaaagaacttggtctactgtatgacaagcatgtccatataaatagctgtttgcagtagaaaattcatgcgtattttctggtacttccggtctgaaataatcgtaatgcatttctacttctaaaatatcccctaattttccgctttcgattactttttggactgtcaagaagtcagaatcgaaccgtctgttttggtaacattggataaatagccctttttcttttgctaatgcaaataactcttctgcttcctttgacgtttctgcaaaaggtttttctaccaatacattctttccatgttcgagtgccatttttccatattcataatgaaattgacttggcgtagtaatgacaactaattggatctcaggatcattccaaagatcagacagctgatcggtatattcgatgtcttcaaatgtttcccacactggtttagatggggaaaaaatttttttgatattgattttgtccgtaagttttcttgaaaatggcaaatgatagcgatttgtactctttccattgccgagataagcgattgtaagcatgatttgtgcctccttttattgttgttttcagtatatcttagaaaaatatagaaagtgtctataatagccattctggcaaaaaagttcagaaaaacatttgttatcatttggtttggtgaaatttatgttcaaagtaaggtaaaaaatcaaaaagagagtggcggaaccaagcatttatcagtaagatagaatttggaggtcagatcatgcttattgaagaaaaattaaccaaacaagagttgtttaccacgacagagaaacggatcgctgattatattcggaggaatatcgaagccgcagtctacatgacgattgaagaattagcaaaagctacgtatacttcccattcagctatcattcgtttatgcaaaaaaatgggcttcagcggatttaaagaatttcgtttcgaactaggacgggaagttcatcaattgattgcccagtttaatcaaacggtcgatcctaattttcctttttcaagtgaagataacacacagcaaattgcaaagaaaatggcagatttgtcaatccagtcaataaaaaaagcgcaattgcagatcgagcatcaagatttggatcacatcagtaaagtattgaacaacgcacagcgaatttttctttttgcaaaaggcgattcccaaatcacggcaaggaagttccagaataaaatggtcaagttgaataaatttttgatcttggccgaagaatatagcgattcttcttggaatgcagccaatttgactagcgaagattgcgcagtttttattagctacagcggtcgtatccatcattatgaacggataatgacctatctaaagcatgtaggagctccaacattattgattaccggaaatcagcattcagaaatggccaaacaggctgatatgtgtcttgttatatcgcaggaggaatatgattttgctaaagtagcgactttctcctctcaaattgccttcgattacgtattaaatacgttattctcagtgatatattctcaaaattttgaagagaatatccgcaatttgaaaaacaaacaagaattgatgcaaaaaggccttcttaaagaatatcggaaaaattgagacaagctttctttgatatcgttataaatatagactggctgaagttttctttttcaaacttcagccagtttatttgtttacgcattgctttgaatacatctatcatagaaaagagacacagttaccttctgtttcttattttaaatgtttgccgaaaaagataaataagaaacagaaaaatcagtatacttatagctatcaatccatacaggaagaaacgtttgttctcagatactttctgtacttctttctgtactttttttgcatgataaggaacgcgatgccctctgacaagtaagcgatgactgttgatcatataaggtgtacaagtcagtagtgtcacgaaatccttccctttttcgattctcaggtcttttgtatcagttggttctaccgtctttatctgatcgacttgataagcaagtgtctgtccgttgatctcgatatagaaagaatcacctaaagtcagttttggcaagtcagtgaacaactttgcttgaggcagtccccgatgactggaaataacggcatgcgtactttctcccccagtaggataagatgtcccttccaataacgaagcgcctttttctagcagcacggtatttgtttcgtcaaaaatcggtaaatggacattgatttcaggaatcgtcagaacgccgatcgtatgtttttcaaaataggttttgtctgttttcactggttcctttttcttagtaaagggatcaacaccgggatttcctcctttttttgctaattgctggtttttctttgtcatgtctttttggattttggccatgactgcttcattttctttgaccgcttgttgctgataatgagagatgatctgctgatctaggtagttattcagcgcatcgctaacgaatggataagccaagacgcctatccctgacagaagcagaagaatcattagcaggtctagaagtttccttttctttggtttcatttgtgttctccttgtgatgactgtttgataataaaagaaaaaggagcatttgcgtaatccgctgctcctctttccaattcatgtacaaagattaaatctgactatgcttgcgtctagcaaagtacagtccagcaatcaatagaaggatcactcctgcaccaatataaagatagattcccttaccacctgttgaaggaagtgtacctttgtgtttatttggtattttttcaggagaaatcaactgtcctgctgttgcgtaagattgttcatcgatagtaaatgctacgcggtttgccaatggaacataattttctggtgctttcgtttcttccagatagtacgtgccgtatttgagacctgtcacatcaactaaaccgttgtttgtggttgtaaaaactgttgctgattctttcgtcgaaacccagttgacggcttttgtagatgggtcgatcgacaaatagttggctgtgtcactctcttgatcacgaacgacgaattctgctccagcaagtgtttgatctgatgcaacatcaccatctactttgacaaatcgtttgccgccagtaacgacatcgactgacggtggtgtttgatcatttgtatgtccgttatcgacatttgcttggttagaaaacccttttgttggatctgctttttcgttcaaatacatatagtaaacaaatttcagcgtaccaccaggagtgagtgaaggaatataattcggatcaactgaaaccgtgaatccgtttgtttgttcagtgacagaataatttgttggatcgatttctttatttccatcatataaggcataaacatacgttcctgaagaatcattatcaaatgttaaagcagcgtcatgagtatcgatgagtttgaatgttgtgtacttgttttgcgttccttctttatcagcgatacctaatgggatattgacagaaatctcatattgaattttttcaccgattgcgacatcttttccattcaattgaggtgttgttttatcaactttagacgtatcatttttgatggtcttttctactggtgtttggctatttgccaggatctcaaaaggcgtgattgtttgcttttcaatcatttccgcattatcaggagcttttacttcttctaaattatattttccaacttctaaatgattaacgatcaactggcctttttcaatcgttgcctcggcaaagtcattgttgccgatatcataagaatgaccagtaatgaaatgtttggctttcgtttgatccgttgtccaagtgtacaatccatctgtgacgctttgaatatattttttgacgcttggtgttccttcttctttagaaataataaattctgctccatttagtgcttcgttttcggcagtaccgactttggtcactttcaatgttccatcattaccaactatatttttaggatagagatggatagtgtccaattcttctgtcccgtatttataagagccatctgcttgtttgatcatctcgtatacaggaaaagcgagcaccatgtttgtggcagctgtcactccgtcttttggttcctctttgattgtgtagactgcatctttcccgttttgttttttaggtaaagataaagtcacatttccatccgcatctgtcgttcctgatgcaattggtgtaccaggagtcaaagattggactgcttgttttgctgcatccaccgacgctcctttcttccgttgcgcataaaattctgtagtgacgttataaacggaaaatgaaatatcggctaatccttggtattaatcgaattcactcatttctttcccactgttttgaatcaaaggatcgggtaaatcagtcattttctttttatggagaatgacttgagctgctgtctcctccgcaaacactctttttgcgccgaagctacttgtgattaatggtaaaataagaaaaagtgcacctaatataatgcttatttttttatgatttttcattttgtcactcctgttctttttttaataaacaaccatattgcaaggcttgcgaacaccatgccaacaacgactagaaggatgtttttcgtttcgtttgttttaggaagaaatggacgactattttcttttttgttgactactttcaatctaccgacagtctctttctcctcagagaggctagttgaaatggtaaacggaatttctgtttcacttaaaatataaccagatggtgctttgatctcttttaaccagtaatctcctgttttcaacccgataattgaaaaagcgccatttttatcggaggtcaggtgaagcgcatctgattcattacttgtccacttgtatccgttggctgttcgctggagataatttcctgctttgtttttaataaggaatactgcgccagctaatcgtttgtttggtttatttgtctcgattttgacaaattgcttactccctgtatatacagagactttctttgtgctgataccaaaaccaaaatccagtgttccgttgttattgatttccttgttcgcctgagctgtactgtttagctgcatctgataagaaatggtcaggttttttccagcatatttttctagcgaaggaatcgaaaatgcaatttcaaatccgtgtggtttcgtgtgtatgacaaatccttcggatagcttttgtccattcgatgacatcgttagactattaggtaaaaacgttaatgctccatccgcactatctgataatacgaatttttgatagtctaagatattcatagggatcgtcgtgtgcaaggaataagtgactttgtcaccaatcgtaaaattattcctcgtttcttctaataccttttcaaaaggaggatcagggtagttattttcttcatttttaggatacaaatggatagatgaaagttcttgatcgttttgtccatatacaggtagaacaactaccatgttctctgctttttctttgacgacttctggtgctttggattcaataaaaagatacgctttctctctttttttatgatctttggcaggtagagaaaaagaagcaataccatcttcgttgttcagagttgcggttgttgcttctgcgataaacgtgccagaagacttaccgttttttgcaatctctgtttgtgcttcctctactgttttccccttttctcgtaaatggtaaaaagattctgtgacatcgtaaacttgaaatgtgactccattcaatccccgatacgtttgcaataactctttttcttgtccgtcacttggctggttttccggtagttggccatttggaaacagtaatttgtgcaaagtgatctggaccatatctggttctgttgctgttactgcctgagtaaaagcaggtttaaacagtaataagaagagacacatactaagccaaccaagttttttcatattagctgccccctctttcttttttgaaaaaaagataccaaatagaaaatgtacaaccaatcatccctactagatagattcctaagcggccaattcctcccgtatcaggtaatggtacttttgcctgattcgtgatgtctaaagaaatctggttgtttttggctcctggtgaaagaacagactcatactcttgtccatccacttgaatcgatccatcttcttttatgatgatagtaactggatcttttagtccttggtatccttctggtgtaaaggtttcggtcagcttataagttccaggttttaaattttcgaatagaaaggtgtccgtttcttgtccatcttttggcaattctaagtccatttctggtccttgcagtctgaatttggctccttttaatgcctgtccgttgtcttcctttttgtgtactgtcaggtcaaacgcttttaatcgattttgatgagtgagcgtccacatgccattcgttgtctcggtgtttttccccgtgtaaataatctttccatatttgtcgatttggaattcataatttcccggcgaagtatcatatccgacaggaccagctgtttcaacgactcggtattctccaggtgtgagtgaatcaaaaatggcaaggcctttttcattcgttgtttggctgtccattggctgataagcaccgtttgcttcttttttctgtagggcaaaagctgcacctttaagattcatctctttgcccgtcctttgcatcgtatacttacgtactgctataggaatttcaacaaaaggattttcaatggtcaactggatcgtatcatcggaagtagtgactgtttttccatcaatggttaccgtaccatcagaagcaatcttgatttcccaagtagtctttttgcttaattcatgaccttctggagcttttgtttctgtcagtgtataagtcatttctttttgcaatttgacattttccggaagagaataggtcccatcaccattatcagttagtaaagtatcaatagaatctcctgttaatttgaaaacagcgccaatgagtttcttttctcctgtagaggaatttttcgttatttttaagtctaacggtgtgaattgtttagtattcttccatgtcagtgcatctatttgttgagaatcatatcctggtacaggtagttctttgattgtttggtaactgaatgcttgaccttgattattatattgaggcagtgatagtatctcgtgataactttctccactatttgcagagagtttgtcgacgtctgcacgttcccacgaatttgcagtatctttagctggtttagtgatgcggatatatccgtttttccaagctgcagcatctgttgtatggttccgttggatttcaaaagtgacttgatctggacgattagctggattattgtcaaattcttcccataattttttgatgtgaagattgattccgggagctttagcagatggtataccgaattcagctaattcgtcagtgtcaatacttggttggaaagtcgtcctaccgttcatttgataccagaaattcgggtggaagtcctcgttttctgtctggatcctcacttggtaatgaatttggatttcttggtcttttcctaaataaatctgattgctcttgatcgtatttccatctatagaaatagttggagtaactgttgtagggtttgttcccacgcttttgactgaaagtgtaccaggttgataaataaatggttctgcgattggatcatttatttgtccattacttacagttgcagagatctgtacagcttttttagccagatattcagagatatctgttgcatgatcggctgattcataataaaggtcacctttttcatctgatgaaaccatttgccgcatacgagactctacttctgctttggatagaccagctgctggatcgctttgaagttggataccaagaccatgtatctcgattcctcgttctttgagcgccatcgcttctcctatagttgcgataaatgtgctgtctattcttctggattggttgttttggtcaggtgcataatagcttcttgcaattcgagaagtatttcccggctgatcttgagtattggaaaactgggtaccgtaataatcgttgcttgattgtgcgtgtactcgctgtactttataagaaaatgtcggtacaccatccgtcagcaagacgatcacttttttatgtccatttggaacggatagcatgtcttctgcatctcttagtcctttttgtgtaaaagtaccgccatttgtccatgaaggtgtgatggattttacttgattttttactgaatcaaatgaacccatctgcacagtaccgttactgtacagatggccttcgctggagtagccgacatatcccgtattgattttgtctgtgataccgctatctgctaaagtatcgacaaaacgatcgacaccgatttttacttcaccgatccgatcattgtcgttcatacttcctgaccagtctacgaccaatacgagatcaagaggcgtgatatctttttgtacatttccacgggcattcaaataaacatcaaacaatccaggtgtagttgtctcctttgcaaacttacgtatcgcatagtctgcttgattgcctgttcccccgtattcgatatacgaatgagtccgatcattaggatctccatcccaagaatttatcccatcccattgatttgatccatttttattaccttggtgatcaagaacatttgtatttcctgtaggttgccaattggctttaggataagtgccttgatcatccgtcgtatactctgtaggaatcgtctggttagctgaaacagtcatagctggcaaagacaatgtaggcaatgtaaagggactgacagaattttcattttcttctgatattccttcttttgtttcgtctgtatttggtgttgacacttctgtctctttcttgtgttctgtcgcatcagtaatgtcatactctttattatcgacgatcagcttatttgtctggctgtgataaagtgttggatcgattggaagacttagattgatcgtttgtttagtgtttggagagatttccagcgtggttttcccgctttttacctgataagcatagccatctccttcctttctttctacatctcttaagtaattctcaactagaccaatttctttctctaccttttctgtactgttgttattcgcatttagtttgacgttcagtgcttttttcccagattgatctgaagtgatttcagctgaaatgatttctaacatcgttggattatctgtagcttctgctgttgcagttacaggcagaatgttcgataaactcaataatatcagcacaaaaacaactttcagcttcttccctgtggtcgtcatttttcccctcctttttatttttttctgttttgacgtgaatagtgatgattattaaaataaataaacgtatttattctaatatgataattattatacgaagggcactagagggaatcacaccaattttcataccaattggtttcatttatgacgttgattcctttgattaatgagcgtttcattaaagaaaagggttgagagagaaaaacatatgatcaggttgctggaaggaaactatagaaagatggaaaaaatcattcggattctatccatttctgacaagtggatgactaaaaaagaacttgccaaacgaatcggtagttcggaatctacgtttgtaaggtatatcgaagaaatcaaaatccgctggggaacggatgtaacgattcagtcttcacaaaaattggggtatcgacttgaacatttgaatgtaccggcttatttaaatgtgctaatggaaatgtcacaaagttctacaaatagtcgtctattaaatgaaatcattgtcaatccgggtaaaacgatcgagtattattgtgaaaaaatctcgattagtcgttcttcttttacgcgtaagttgaaacaatgcaatcaaattttagaaagctatttattaaaagtaatcgtcgatcaagggtttcagttgactagcctgaaaagtgagctccagctgcgtatctttgtcacctttttctttttaagctactatggaagacgtactttgccatttccaatcgaaaaaaagaagatcaaagaaattatgtcaaagaacaattgtcagttgaatttattccaagaagaaagtccttatgagcaatctttctttattatgtattttgttgtgcatcttatgcgggaatcacaaggaaatccattcgaatggaaagctggagacccatatgtaaagttgataaatatagataaaaaagactttttgatcttgaaaaatcttttagggaaattgaagtacagcagctatataaaagtagtgaactattttgtcaatacgattttttcagaattttcggagaaagaaaaaaatgaaatcagtgaacagatacgaaaaaatatatcctactgttcattttcatctgctgattgcaaagaaaaaaacgaagaatttgttgttcgactcttaactcaaatttattttttctcacgtatttttccatacgatacgactcatttgacgatccgtgccactttctttgcggaacagatgcaacatcgccatatacgtctatatgctggatttcgtgcagaacttcaattttattccaccctactgaatcgaaatttgatttattatttatctagctatatattttggatgcttatcggtaatcctgaaatacaccattatacttccgataaaaaaatactgatcgtcagtgacttaagtcttcgacatagtcgatacattgaagaatatgtcagtgatgttcttgctgtgcataagattcactctgaaacaactgctatcactgaagatcaactttcgaaatacaatcttcttgagtatgacctgatcgtcacgaatcaaccaattccgaatacccatgttccttatatgttgattgatgatagtgtgtcattcgcaaatgaagaagaactgatccgcttatttgagctataaacaatcaaaaaacagctatgtatactctaccatcctgataaaaatgtcaggacaaatagacatagctgtttctttttattggataccttttgcaatccaacgagatttatagcgaaaatcttttaatagttcttcttttgtccagccatttgcaatgagatccgtcaatgagttcattacgagagacatggagaagtataagaagctaactgcttcttccgacgattgaatggtaaaatgattaatttttagtaattctagccatttgtcgttcataggagaatcagcagttagctctctgcgtttggttgtctgctgatcatttctctgggtcaataagtataatctttgccaatagatactattgtgatctaaatcgctgcaccactccaaatacttttcgatccctaaaaagaaatgttgtttgttttcactaatgaatgtcaagatatcttgatggactatatgagaactgcttttgatcgtatacaaataagcatcttctaaatcttgaaaatatttataaaaagcgccgcgtgacattcccattttctcaacaatttctgagacttttacttggctgatgtgctgtgagcaaaatatctctaacaataggtcgtcgattcgctgcttctttgctttcggcaaattgaaaaaagtttcttttggcatccacatctctcctttatctctgattatacgtggattgcccatccttgtcatgaagtactcattttttctctttctcttcttctgtcaagtacccatcttccattcgataaacgcgatcactccactgaatcatacggacatcatgagtaaccataatagttgctttttgtttttcatgagcttccttaaccagtaatttcacgacctcatatgcatgatcggtatctaaactagctgttggttcgtccgctaagatcaagctcggttcattatataaagcgcgagcaatcgccactctctgtctttccccaccagaaagatctctaggataactgttctttagtgactggatatctaaagattgcagtaaagaatcgctttttttggaaacatctttttttgaagtgacttgatcaactagttcaaattgctcttttaccgttaaaaaaggaatcagattagagctttggagaataaatccaatttcttgaaaacgcagatctgctcgttttttttctggaagttcagttaatgaatgaccgttgatcactatttctccggaagtcggtgtttgcaatcctcctgaaatggtgagaaaagtacttttacctgaaccagaaggaccaataatgctgacgaattccccttcctttacataaaaatcaattcctttcaaagctgagacctttgtatgaccagaaccgaatgtcttggtaacttttttcattgtcaatatttctttcatttttattaacctcctattgctgtaattgggtctacttttgttattgtacggattgaaaagagtccgcctagcatcgcgacaatgatcaaaatcccactatatagcagccattgggaccaaaaaacagcaaaaggcatcgcacttggtaaaatcagactagtcagataagcaaacacaagagcaaccaggacgcctaccaaccccacaataaatgactgtgcaactaaagatttagcaatgaaggaatttttgattccttgtgctttcattactccaaaaatagcagttttttgaagagtaatcacatacataaaaataccgactacggcagcgactactaagaacaaaaagtagatcatcgcgtttaaggtcatgttttgggcagaatagccaggaatgctttcaatgaacgtctcaatagttagtaactgtagtttctttgatgctttttctttcgaaattttagcagaattctttgtaacgattccattgattggctgttcctcttcagaagcaaatggctgttttccatacttcaaagcagtccacgtatcaagagatgtatagatgactggagaaacagtgtaataagttgcaggaaagataccaacaatcgtcaaaggatcgttgtaactgccaattttgatcgtatctccgattttataacctgaatcagccaggttttgcgagatgataatctcattctttgttttgaattcatgccctttcgtgagttttggtaataagaatgctttttttgacgtgccgaaaactgtgacattttctttattttttcctttgactgcaccgctgtataatccaatcggggctttttctcctccttcaatatatgtcagatcttctcttgttaattgtgaagcagcaaatacttgattggcgtcctctgataaaacaatctcttgtgcatcccaatcatcgattgctttcttgaattcttcagaaagcccatttgctagtccagataacataaatacgacatacgcaatcaagaacataatcccgatgatcaagccataccgtaatttagaatagcgaatttctttgatagctagaaacatttgattttcctccctatgatatgttgatagtgacaaaatgtcactcgttgaatagtgtaactctaaagtgacattttgtcacttctgttggatttttttatcaataaattgtctaagacacctttccataaaatcttaacatgtgtcataataggattatttaagtcttatttatgttatccatgttaaactaaagtgaccaaatgaatgaggtgggaaaatgtttaaactattagtagtagaagacgataaggtattatccaataatataaaagaaatactcacaacaattggtgagataacacaagtttataacggtggtgaaggactgtttgagttggaaagcggtgtttatgaccttgcaatcttggatttgatgatgccggaaatgaatggttatgaagtcctagcaaagttacggaaagaaaaaatacagactcctgtattgattttgacagcaaaagatagtttggaagataagattgaaggatttgaacgtggtgcagatgattatctgacaaaaccgttctatcgagaagaattgatcatgcgcgtgaaagcattattgaaacgatcgcttggtctctttgatgaaaacattctgaagtataaggatatcagttgtgatctaaaaagtaatgaagtattgtataaagaacaagttttgcccatacaaggaaaagagtttgaattactcgtttattttttacaaaataaaggaatcattttgacaaaagagcagatatttgatcggatctggggatttgattctgatacgacgattacagttgttgaagtttacatgagcaatttacggaaacatctacgcagtactggactagataaagaaatcaaaactttacgtaatgttggttatatattgcaaggggtgtgatgcaatgaatggagatattacacgcaagcagcgtagccgtttttttgcaacgaatgtagctgcatttgctttgatcttttttcttctggggtttattactttacagatattgaaccaatctgcgtatagagaaacggatctttcattagagaaaacagattttgattctcggacagtacaattagagatacaaaggtatcagcaaggtgatccctttttgaacccgaatcaaatggaacaaaacagaacaaacatggaacaaccattgatggaaccatcaaatgaccgatttaacactcaagtgatcttgtggtctgaaaatggtgagatattgaataaggcagctattggtggacgcttcaatcagatcaaagaattaaaaatggatacaaaaaatctgaataccatccaaaatattgaattaaatgaagaaaacgactcatctaccctctccttccgctcgataacgaaaaaagcagagacgaatcaagttggtgttgcctatatccaaattttagaaaatacaaatcaaatcaaaaattcattagcaacttttcgcacaattatgattttgtgtatggttgttttctggcttatctcaattggcattagttattacttgtctagtctaagcatgcgccctatcattctttcttggagaagacaaaaagaatttgtcgaaaatgcttctcatgaattacgtacaccgttaacgattattcaaaatagtttggaacatctatttaccaaacctgatcataccatcattgaggaatctgaaagtattgctcaagcattgtcagagacgagacggctcactggattgacttcagatctgctgacgattgcccgaaatgattctgatcagcagctactttcaaaacaaatgatcaatacacaggaatatatcgaaaaccttgttaaaccatttcaagagatggccaccatagacggaaaggagtttatccttcataacgaggcaacatcagaagtaccaattgacgaaaaaaagatccatcaagttttggttattttgctagataatgccttaaaatatacgaatccaaaagataaaatcattttagattcgtctgttaaccataaagaatggctgattcacgtaaagaatactggcccttctatcagtgaagaagatcaagtaagaatctttgatcgattttatcgggaagatcaatctcgtgcgaaggaaactggcggttacggacttggattggcgattgcaaaacagataatcgaacagcaccacggacaaatttctgtatccaattatcttccacaaggagttgattttaaagtccaattaccgttgaagcctaaaaaataatgcttaactctaaaacatactaggaaaagggctgtgacaataatcttgtcacagccctgttttccgaataaacggtgttccagaagtagcttcttcggaaataagccgaaatttcacaaaaatttgagaaacaaatttcgtaaactccttcttatttcttgaagctgaccacttctgtcacaacctctttagcttacgcttaagattttttattgcggtcttcaatgtgtacatcaccgcttgtgtcaatatccaattcttctcggctaacatcttctgtcactttttcaacgtcttcatgttcttctttatgaattcccacttcttcacgaacaactgtatgcttgctaacatctacttgctcttctttgattgggatagtgattgtgtcatcttccaagttttcgtctgtaccctgtgaagatggatctgttactggtttgcgctcgatgacgatttcttcacgtttgaccggtacttctaccgtttcagtatcgttgaccatatgtttgtggatgtcgacttctccagtggtaacatcatgtgtatttacatctaatttttcttcttttagttgaatcgtatcatcatctagatttggtttgcgatcgatgtcttccgtctcttttgtactcatagaatcagcttcgccaggtacgtccatcggatcagttcctggtgtcatattcaatggatctgttgtattttgaaagcctgtcgtgccatctacgtccattggatcagtgccagtcccagtccctagtcctgttcccattgtgcttgccggggtaactgtatcttgcgtatccattgtgtcttttgttgtttctggctgacgatagccttttactgtgatgacaaattttccagcagaaatatctcctctatactgatataaaggatcattttctggcgtagccgtctcagaatcataggtatcaaaagaaaaagtgtcttttattctttcccataaagagcgatcttcttcgccatccatccgattctcatctgtttcaacatctataccggataatccgtcgaatcccagtctagttgctgcttcatcagtagtataaataacgatatcatctcgatcatacccttcgttacgcaaccgttcgattactgataatgcttcatcccttgtactgtagctaccgatgactgttaaatttttgtcttccatgtaaattcctcctagcaaatagatttatgattggtatatttttacttataaatttattctataggagacgattgatttctacaaatatttagattggaattagattaaaacattttaattgaaattttggaatatctatgctaatagcaaaatatatatcactaaaatagtcatttgtgcatttattcctataggaaattttttgaaaaaatttcttatattttccatttattacgattgtattatttatccaatccttgaataagcaagctacttatatagataaatagactgattcctagtataatcgttcctatcataggataaattcctatgtaaggtgatgaagctccagctatttctaatattcctttaagaatcattccgacgatatagctagccaaacccgtattgaataaattgaaagccaggcgatttcgaaaagtatttaatattttttcgaaaataaaaaggaatgcccctcctaccattggaataacccagacccatttcagtgcttgtgaagtgaccccgtggctaaaatgatgataaaccaattgaaagatgaaaagaatgactgaactaataaaataactataaaacgtttttttcttattcataattataccccttttcttaacctataaaaacgatatcgctgacagatcgttcagagtttccacttccgccgactgtttgattaatgacttttccattgaaataaagcgttgttgaccctccaccatctaaattatatgcggtttttgctccatgatttttcaatacagttgctagttcgctgagactcaacccttgactatcatctgttcgaccttctgaaacaacaacgagataatggtttgttccaacttgagcaattgcgattcgtggattactttgcatcgactgcgacacttcctcatcttcagaaacagtgacttctccatcttcaactaaagcaggaccaaaagataaaacttgttgtacatcttcttctactagcttttcagcagatgtttctgcttcttttattattgagaaatcaccatttttatcaattactaagtcttcttttgtttcatcttcactaggtgtatcacgatatagtgtgccatttctaagtacatatcctgtatctctaaaaccataataatctccgtttatcgctaaaatcgcttgttgttcttgtgcgatcgcagatgtagtttctttgatgttgcgtccatacgtattgtttgccaaagctgtttttaaatagctagaatcgcttactgtaatatcagcaacataaactgtggtttcatcaacacgttctgaagataatgtgatattgatattttcatcttggtagctattatctgtaatcactggttcaaaagaacttgagttactcgtattttttgtgtctgttgtcgaagtggaagtctcattggataccgattctactgctgctatttcctgaggcaaaacaaatgtttttaataatatataacttgaacttcctaacaagaaaacactcgatagacatgcccacatatatttttttcgtaaaaaatgtttcataaagatttcctcctaacaaaagactatgcgtctttgaatcgaaaaactgacaaaaaacaataaaatatccacaacggccttacaaagcaaaagcgactgaataataaccgaaaggatcgacacacttagccaacttaaaatcagttgaaagagaaacaataagctgtatttataaaaagcagtatgggctctttgctttctgaacacataatgtcgattcatttgataattgaaaattcctgatagtactctagaaagtatggtagcaatcaacaaagaagccattgtatgatttccaataaaaaatataatggaatagaatagtccaatatccaccaatgaagaggaaatcgaggaaaaaaagaaacgaatgaacggacgataaacaagataggaatcttggaatattcgaaaatgggaacctttatttccatcgctatatattgttttgatagggatcgtagtcattcgatagccgatctttggtaaaactagcagttgattgatttcatattcaaaccgatttccttcgattttgagcagttcagataaactagagatagaaaatcccctcagtcctgtttgtgtatcctgtaagtggatacctgaggaaagataataaaaaccgctcgtcattcgattcccgaaatagcttcgaaagggcgtgttttcatacgaaaaatctcttacacccaaaagtaattcctgaccagctaatcgatctactgccactagcattttttggatgtcttcgatttcatgctgaccatcactgtctgctgtgacaacgccagtaatgtctggataggaatcaagtataactgaaaagccgaattttaatgcatatcccttgcctttgttgtcaaagtagctaattttagtgatattaggatgttccattcgctgaaacagtttttgataggttttcccacttccatcatcaacaatgataatcggtacgtttacagattgtgctaattgattaatgaagaatacagtgttttctgtgggttcgtagattggaattaatagaatagctgacatatactcacctgcttttatttgaaattgtagttattgttgcaagtgaaacttaagggcttcttaaaaactaagagaatcacctctgattttgtaaagacttttaaaagacagttacatggatgttcgttatcaaagcaagacaaattccctatcgtcatttgaggaaatgcggtaaaataaaggaaatgaacaataactggagggatttgtattggacagcaaaactagaaaacaactgcaagaaaaattaaaacaacgtacacatttgctcccttccgtctttcaacagtttttagaagaaaatcgctcttctttatcattaggtagtcgctatgaatatgcaaaagatttccatttgtttactgattatttgagaaaagtattttctgaagaagtggatgatcagctgattatccgtttagaaaaacaagattatcagaatttcttagctaaaatctatcgacatactcgttcgttccaaactacagcgaaccaagaaacggagcaattgtttgaaaatagctactacgggattttgaggaagcaatattcattaaatcattttttacgatttttatatcaaaaaggagtaattgaagaagagatctctcttttgggtacaagtttaccggaaacaactaaagcagctccgcgatatatcgatgcagaacttttcaaagattttgagcatttgtttatcccgattgaaggctttcaaacaagcagagaagctagctttgaagaaaagaatagaccgaggaaccttgcgattactgccattcttctgtattgcggattaaagatccatgaagtagtagaacttaaacgtaaagatgtatctttgaccaagcagattcttaatctgaatagaaaagaaaacagattgagtaaagtaccaataccaaaagaagcgatgccgtttctagagaactattttaagttaaccgcacaaaatacggatgaaaattcttttgtttttcgttcctcgcatgatcaacaaatttctcctcggactattcgccaaattttgagcaaaatcacagtgtataagaatgtatcaccagaattatgccgaaaaacctatcgctattataccgaactatatttagatgatgctgacgcggtaaactatttatgtggtaatcgatacctatcttcccactcttttcaagaaatctgggaaaaaatggttgatttttcttatcacgaattagcggcattcgttcaggtttctgtcacataggaacctgaactttttttcacaataaactatattattgtataaaggtttatgttacgattatcttgagtttgtatattacttaacaaaagataatggagtgtgaatgatggagaccataacgtattcccctttgaatttatttacgaattttcaagaagctgcagctggcttttccgagaccccgattatctgtgatcagccgttttctgcttttcctgagttaggacttgaaacaacttacaaaaaatgctttgaaagtgtgttagatcgagcttatcaattggcccatcttggtgtgaaatctggagacaaagtcattatctataagagttccgcttttgacacataccttctcgctgtttctgtgtcttaccttggtgcagtgcctgtcatgacttcttatcatctacctacagcgacaatggaagtatttatcgaccgtttagaagaccccttcattttatttgatgatgagacaaaaaaacgagtgggagaaatttcaaacgggactaagtcaaaacagattcctattttttatttactggagcaacctacttttcctgttccccaatcgtttttagctaaaaatgaaatttcttatatgacccatacttctggtacaactggtatccctaagcttatttgtcattctgctcattctatgggttggcgaacgaaatggcaaaaaactgtttttgcaaaaatttcagaaaagaaattaatcgcttttcacatttcccccgtacattctagattcaatattggcatctcttctttgatgtccatgggttttcctatgatgcctttagcagatgcacaaagttcaaaaattattcgtatgttggaaacccaccgaccaatcgcattagagactcatccgaataactttgttcagtggagttttactgctaaagaacatccagaagctttctctggtatccgttattatcactctacttttgatgccataaacaatcagacaatggaaacatttttgcgaacatcaataacacaagatgcggtattccttcaagtatatggccaaagtgaatgtggaccaatgattcttaaggctcatacactggaaagtttgaaaacgagtgattcaagagatatgggcgttggactggaagacatgacaagcgctcggatcacagattcagttgggaatgtccttcctgaaaatacagatggtcatatacaattactgtctaaaggacgggctttgacttattataaggaagatgcacggttccaggaaaatgtttatggcgattggtgggatagcggagattacggatttatggatgagcgtggtcacctatttttgaaagatcggcaagtagatttgatcgaaacgatcaacagtacattagctattgaagactttttattagattcgttagattttttggcagaagtagtgattgtaagggataaaaatcattctccacagccgattattgctttagcccctgataaagaaatggattggaatcgctggtgggagcaagtccatgaacttccccgtttgaacgcccctatcatccgtgactttgatgcaatcccgcgaacagctacaatgaaagttcagcggcttcaaatcgagaaagaattaaaaacacaaaacaactaatcgtttttaagtggttgtgaaaaagctgtcctgcatcaagtaataagaacagccaaataaaagtggttcctcatattttgccgtttgttgagctaatatcgaggaccagctaattgaagaccgtttattggaaaaagggaatgtgacacgatttttgtcacattcccttttcgcttcttttgaaaattggatgagataaaaatatgccaattggctgtttttcttttttgaaaatttcgttatactcttattcatggagggaaatgttatgaaaagaatcttgacgattggtggttctgatccatttgctggcggaggaatccaaacagacttaaaaacttttgaagattttggtctattcgggctaagcgccctgacatctataggggtactagatacgaatgggcgatttatcttggaatctattccttcagaattgcttgaacgacagttggcttcaattgatcaaatgactacattagatggaatcaagatcgggttattaaattcaagtgaagcaatcatggttgttcgagacttcataaaagcaaaacaaaatatcccaatcatcttagaccctgttttggcattcaaagaaactgaatctgtgatcaatcaattgtatatttcacagctcatcgaagaactttttccacttgttacgatgattacgcctaatttggcagaagctgctttactttctggtcaagctctcccctcttcgttgatagaaatgatccatctcgctaaagagctcactgcttcaggagcaaagaaaattgtaataaaaggcggcacaaggatggctggcgaacaagctgtggatcttctctattcagttgaccatcaggaggtgttttctcagaaaaaagttgacaccccaacagtaaatggtgccggttgtgccttttcttctgcaataacagcgaatcttgtattaggattagatgtttcaaaagccgtagcagaaagtaaaaaatttgttgcccattgtatttccaatggtgtgctgatgaatgatcatacgggaagcgtctggtctggcggtatccaaaaaggaggaacgataaatgaaaactaaacaactaacaatctatgcgatgctgattgcgttgaccgttgcactttcattaactattttgatccctgtgccggctacgaacggttttgtgacattatgtgaggctggaatctatactgcttcttttctttatggtccaatgggtggattagttgtcggtgcttccagtggactattaatcgatttgatttcagggtatccgcaatgggctattttttcattagtgattcacggattacaaggatatgttgccggatctttcagtaaatcttctactcgcatgtggctatttggtctttttttaggaagcttagttatgatcgtcggctatggtatcgccggttggattttgtatgattggccggctggagtggcttctatcccagggaatatctttcaaaatcttatcggtatgggccttgcctttcctataactgcaagtcttcaacgtattcaagcacggaagcaatattaattgaaaagaaggttttagagaatgaagttgtcagaaaaagaattgaaagttcaattgactgaaatagttaatgacgtattggctgaggcacacttgaaaaaaggagatctctttgttttagggtgcagcacaagcgaagtcgtcggtggacatattggaaaaaattccagtgcggaagttggtcagtggatcattcgtacgttaaaagagctattagatcctaaagaaattgcgttagctgtccaaggttgcgaacatctgaatcgagcattggtggtagaacgaacagtggcagaagcaaaaaaattcgaaatcgtctctgttattcctgcattacatgctggaggtgcttgttctgttgctgcttttgagcagttcaatgatcctgtcgaagtagagcatgtaattgggcaagccggcatcgatatcggtgacacttcgattggtatgcatatcaaacatgtccaagtgcctgtcagacctcgtttgaaaaccttgggacaagcccatgtgacagcccttcgctctcgtcctaaatatatcggtggtcctagagcaaattattaagatgggtaaatcagaaaaacttcctcggaaagtccaactattgaactttaacgaggaagttttttaattgtttgttttatacagacaagcttcataaggtgctagtgttccttttttttcaaagtttccgttagaagaatttgacaagagtaatgtccatgactgatctgcttcttttgggagttcatagtcagcaaatgattctgtcaagtttaccataataagatactgttcatcttctaaatctctttcatagacatatagttgtggatgttcatgaagatactctttaaaagaaccgtatatcaggcctttattgatttgtctaatgcggatcatgttcttatagaattgcaagatcgaatccggttcatgttcttgttgttctacattgatcgttttggtatttggattagtgatcatccaaggctcctgtgtagaaaagccagcatattcttctgaagtccattgcatgggtgttctgctattgtctctggtggtttcacgaataatatccaatgcttcttctcttgtcttataatccggaaatccaagtagtctttcgtatagtcttttcgaatccactgcatcaacttgatcgatcgattcaaacggcatattcgtcattccaatttcttgtccttgataaataaatggcgttccttgcaaaaagaaatacatcatagcgattgcttttgcagacatagcccaaaattcgggacgggtatctccgaacacagaaacggcacgaggaacatcatggttttccatatataaagcgttccatccgataccatctagggaagtttgccaagcacttaatgcatgttttaacttaaggacgtctaattgcccttctttttcttgctgccaaatatggatatgatcgaattcaaagatcatatcgaaataaccgtcttttcctacccattccggcccttcttctgcagtgacgccgcttgcttctccgactgtcatgatatcgtattcttcgaaaacatgtttcaaatcagtcaaatgttcttcgattcccgagacattctgaaagggtgaaaaaaaagggttctctgtggcttttactgaatattcatctttttttacatgagaaatcgcatctaagcgaaatccgtctatccctttatctagccaccatcgaatcatattgaatagttcttctttcaatttctcactttcccaatttaagtctggttgttctttcgcaaagacatgcagataatactgtcctgtttcgtgagaatattcccaagcagagccgccgaaaatcgatgtccaattatttggttctttgccatctactccatcgacccaaatgtaataatctcgataagggctttctttggatttcttcgattcttcaaaccattgatgctgatccgaactgtggttgatgacaagatccataatgactttgattcccagttcatgtgcttctttcagcaataaatcaaactcttccatcgtcccgaatcgcttttctatgtcttgatagtcacttacgtcataaccattatcgataaatggagattgatagattggattgatccagataaatccgatgccaagatctttcaagtatccaagtttttcgcggatcccattgatatctccttgtccatcgccgttgctatctttgaaactggccggatagatttgatagcctactgcttctttccaccatttttgttcttgtatcatatcgtttcactcctttaacggtccctcttgattataaccgattctattttagaagtatccttgttaccggtaactagaaacgaaaagctcaacgaatctgctaagtgcgttcgttgagctttattttatcatagataacgggcaatcaattgaatcatttgcttgggaaattcatttaggtcagtaatatctacaaaacggctttcaccgtagatcgacttgatctcttctttgtcttgaccaatagctgcggaaacaaataatatgccttgacgctcgtattctttcaaaacagactggatgtcctcttttgcttttttgccagtataatctggcaacgcctttggctgaccgtcactaatattaagcaacagtttggttgtggcggattgtctgtttaatttttccgctgctaaacgaagtgccgctccatcacgattgttttgtcttggtttcatagtgactaatttttcatttaaccattgaaacccgtcttcaaattctttataagaaaacaaagaagttttttctcttgctgaacggtctgctgtatccccgtaaatcaacaaggggatatcgactttcttagcaaattctgcaatagcaatcgctgctttttttgccgcttcgatccgatcatcccgtatcattgatccagattcatcgatccgcacagctaccgctaaggaaggttgctcatgtggcgggttctttttgtcaaaatttctcaaatcaccatatgctactctacttgcgttaaaccgctgtccttcatattttcccttttggtacgtctctgtttgttcattatccagtaattctaaaatttgtcggctaagtgattctactatcggcatgacttgcatttgtagctcacgtgcttcttgcgtttttccttggaaagctggtcggtgaacgatgagaccttctttttcatgaatcgtttccttcatgatttgccgcgcttctttatttaattgcttcttgatttccttatcatgtgtttccatgtcagaggcagacatttcttgggaatcctcttctgtttgttgttgttccttctgatttttcccttcgatatcgctcttgcgttctttttgcatttgaggaggcatctcgtttttttctgttgttttctctagtctctctgctccctcatttggttcttcagcagacagttgtttcttttcatctaagcgcaaagtttcttcagcatcttcagtgatgtttcgttcgtttgcttcttcggcgctgatagttcttccttttgcatgctcagattgaggttctatttgaggatagccccatttttcttttctcaaaatgtcttgaagttccaatagcaatccactctcagacaaagcttgctcaaggatcgccaattcatctggatcagtggataatttatacaaaacttttggataaatcgactggagtaaatcttgtccttgcttataggtattcgcccaataaaaatatgaacgcattcctgctacacctttgatggcatttgcttttgcagtttcatccaataaacggataatctctgccatcttcataaggagttcttgattttgaatctgggttttcgccatcgcacgttctgccatgacttctaaggcaggaagatccattttttccgcatgctgcatccgatctcttaaggattcatttaagggtcgatttccttgatagtttcgatttgtggtaatgacaataatacaatctggatggcgacgaatgattcctgttggcaaattcaatatcccattgggttcgagcgctgagttaagtgccacaagaacagaagcatcacggatgacagtcggctcttggatctctaatagatatcctttttcgatcgctcgaacgatttcagaaggataataactataatggattgcatctggataatcggcttcgattctttgaactaactctgctaatttttctttggcagaaaaagaatcaatgccgtaatggttctggatcagtgtcagtacagcttcaagtgtatctgtttggtaaatagcttccagcaattcttggtcttgttctttatcggaatctactacaggtaataaggcgccgaacacatctgatttatccatatctgcaaaacatgtcacttttgtatagggaagttgcaaatcagcagatagtgcttttgctaactgtgtcttacccgatccggcgtctccttctaaaagaacgttactgattttcatttcaggatcttgccaattttctttgatttcagaggcgatccgccactcttctgcacttgtccgatggcttttcggtttcttccagatcatttgcttttctagccgtgaaaaggtccggttttctgttagtgagaaattctccatgcttctcttccccttttgatcatctctgtctattaatatcctaactcatctaaaagacgttttaaaatacggaatcgttccccaatcagttctccgtctttttgtagtgtatcgtaatacaaaataatgtcttcatcgatctttggatttttggtatctacctcgactgtcatccggtttccctgcaaaccaatgatgtccacaactggattttctggatcatagaatttttcataacgataagcatcttgaaagtataaacttccttgtgcagctaagatcgctaaatctaaaatacgtgtaattggtaattcttctgattgtcgagaccatttttctccagtatgtcgccatactttgcctgatatgtcgacttttccacggtcattccattgagcgagacccaaagaaagaccttttgcgtccgtattcaatgcatttcttccatcaactttatcgtagtcttctacaacgagcactggtttatgttttaaatttgtaggtatttccatgattttaattcctcgtctttctatttttagtaaattagtaaatcagtagtttactaatttactaaactatatgcgacattataaatgactgaagagagaaatgcaaagaaaaagagcctgtttgttagaaatacataaaaacatcatcttgctcttctgcacgttcatttatcgcgtgaataaagagcaagatgatgtagaatatttttggtatgttttttgaataaaaggaattattgcgctgaaatggcgatgccgatggctttttcgcctaaatgtgtaccaatgactggtccaaaatgaccaacttcgatttctgcatttggatattttttctgcaatttctctttttccgcaatcgctacttctaaattgtttgcatgtatcacgtaaagtttgactggcggttgtatttcgttatttcttttgccaatgatttcttcagcccgagcaaatgcttttttacttgaacggattttttcaaataaaacaatttttccttcagaaaatgtcaggatcggtttgattttcaataggctaccaatcagtgcagcgccattggtcaatcgccctccccgtactaaattgttcaaatcatctacaattagataagcgtaagtattatctcgaattcgatcgacatgcgcaagtatctcatcaaggggctgaccttcatcatttaagtctaaggcagcttctaccatatgtcccatcggcatactagtgatcttagagtcataaggaatgaccgttactccactgatattgtctttcatcgcaaataaggtgttgacgaaaccagaaatacctgaagaaagatggatacttaaaatcgtgtcataccctttctctttcaattcctcatataaagccaaaacttcccctacgacaggttgtgaagtagtaggaaaatctttactgttttttaaaagtccataatattcatccgcttcgatatcgattccttcgttataaattttcccatccataatcaaagggattggaatcacgaataagtcgggatggttcttgatacgttccggcagatacgccgaactatctgtaactactgcaagtttcatgtgtttaatttcctcgtttcaaagaatttttccagacctcataactatatcataagtaagattagatatgaaactaaaattggaaaatagaaaaacgacaagcgtaatcatacgaattgccgtttttctagcgacagcaaaaagacgactagttagcctattctttgcttccgctacgatgtttaacatttttcaacattcggaacccattttttccgaattgagaaaataaaaatactaaacccccaatacttcctaaagccacacaataaaccattgcataactttttgattccattgacaatcgctgattcagcaaaaagaaaatgataaaacataccgcaagcataatcaaggtagatcggaaagtttttaagaaaaaactgctgatttttgctaaaggtgctattcggtattctttgcacataaagtgataaccacgaacaaagacgatgccgaatgccaagccatttgataagctcatcccgtatccgccaactagacctagtccgattacttggaagatgactttcaggataattgcttctacagttagtcgaatcgcaaaacgatggtggttcagagattgaagcatcgtagacagaatcgtgaataaagagaaaaacaaagaagctaacaaagccatttggaaataaccaacactttcaggatcataaccaaaaaacaatgtgtataatggaccagctaataaagacatcccggtcaatgaaggaagaaggatcaataacgcaatcgaaaaactgtctcctactgtcttttcgatttgtaaacgatcttttttcttcattgtgcttagtattggcaaactacttatagcaactgttcctaccatggaaatcaggatcaatgtcagtttgtttggattaacagaagcacgactgaataagaattccagttgctgatctgcaatctctggacggaaaaagtgaagcagtggtttcatcgttacttggtcgatcatctgaacgatagtaatgacggagccgacaaaaatgaacggtagtgtttcccgaatgatagagacagaggcagatcggttttctctttcgaagtaacggctggaaatcaaaaagtctttaagttcaaagaagtcttttctgcgtccgacgatatacatatggataatcgcagctaacccgccaaagaaagaagcaactgtactgatcaatacagcttctaatatggttccgtcagtcaatacgcgcaagtaataagtaccagccaagataacgatcactcgtacagcttgttcaataatcaaagaagttccataaggtcgtaaatcgtttttcccttggaagtatcctctcattgcactcaaaatcgggatagcaaccaaagatgggcataaacttcggatagctagtatcccgttgttaacgttagcgattggactgattccggctaataaaggagcaaataaatacatcaacgcagcagaggcgataccgatgacgaacataatattgatcgtacttcgaaaaatcagccgacaagcagcgttatctccttcttttgttgctacagctactttttttgcaatcgcatttggaaatccgactgtaccaagcatcaggaacaatccatatggaagatagccaacattgtataatgtcgtagcaagcataccatcttgattgttccccatcatacttagccagggaatcaaatagactacccctaaaactttacatagaagattagcaaaggttagccaaaatgttccttgcatcaattttttattcatctaatttccctcaactattctttcataaaataaacatcttccctattatagcaaaaaaacatagaaggacaaatccctctttaattcttaaaacaaaaaagagcttgcatcataagtcaacactaatctttttctccgaataaatgaacttgcatccacaattggctgatgcaaatgcagtttggatagatcagtttgaacaacttatgtcgcaatctctgtttttttagggaataaaacagtttaaagcatggacagtaaaaagacagacgcaagtcctgtcaaaactgacaatgccatcgaacgtgttttgtaagccacacctgctactagaatcattgcagctattttgatattccaagcaatatccagatgttcatgagtaatgaagacatctttgaaagctaacgccgcaaacaatgctactggtacatacttcatccagtcactaaaccaagatggcacttttcgatgagtaaaataaagcatcgggaacaagcgcggaatatacgcaacgatgaacagacaagcaactaaaaacagcaaatatagtttagtcatgatggttggcctcctgttccgggaagttgaagagcggttcattgacatctttgccgcgatcccttagtttcttggctttttcttttttaaatgccttctccaacataaatccggcaaatgaagcaataacagtagctgcaatcaagccgaatgtgttttggaataataccatgaagatcacccctaatacacctgaaaacaaacctgtaaagatcagtagtgagtttttcatttgcatgacaaacataaatatgaacatagcagtcaaagcaaaatggacaaggtcagcatctacacgaatcaccgagccaaaaaaattaccgatcatgttgctaccggcccatgcagccattgagaaccaattgacatataaagcctttcttttgttccaagaggggtcagttgagaactttaagtagttcaccgcatagttttcatcattcagggattgagaaaagacagctaaaaacgtccgcttttcttttttcataaaaccggcaagacttgctcctaataatgtatagcgtaattctaaaaagaaaaccatcaataatgtcgttgcaaatgatgcttgcgtcgtaagcatagatgcaactaaaaactgcgcgccgccggaaaagaccagaatcgataacagccctgataagagaggatcaaatccaactttttgcaacaatactccgcaagctaatcccactggtatatagcttatacaaagcggcatcactgcatgcaaagcttgaagccatggcgcacttttctttttgttcattaaaatatctcctttaattacaacaaataaacagcggactcattgtaacataaattcgctaaattgtagccgttttatttaaaaacaagattatatttttctcatttttgcttcaattcatgaacatacgttttatttgtgagaataatttgggtcatatttatctgtttcaatgtatatatacatcttcttgtcaggaagagactgacgcatatttttttcaatatcattgatgatcgaatacgtttcattttctttgtttccaacaatatctgcttttgcagcgactaaaatttccgttggacttaaatgaacggttttgatatcaattagccgactgatctcaggtcgttcaaaggctaacttgatttttgataaatcgcttgctgtcacactttcaccaatgatcagactataaaattcttttgctaggaaaatcgcagctcccatcagtaagaaacctatcagtaatccgctgatagcatcaaatgcagcaatcccggttgcataagtcaagattgttcccactaaagccaagaccaaaccgattacagcacacaagtcttccgtaaatataatcagtatttcactatgtcgactttcgcgcaaaaagcgcatcgtggaaagattttcagtattcaattctttgatttccttcattgcgacacgcaaagaacttccttcgattaccaaaccaaataacaaaatggcaatgacaatgattggattaccaacttcatgggatggatgcgtcaatttttcaaaagcttccatcacccctagtgctcctccaccgaagaaaagcatcattgcgacgatcgtactaaaaaagtattttgctcggccttcaccaaattgatgcaagtcgctctgacctttattagcttgtttatcgccaaatagcagcaaaatctgattactacaatcaacgatactatggatgctttcattcagcatggcggcactgccactgattgcatagccgacaaatttgctgatagcgactagaatattagcccctagagcagcaattacggaaaacattccgctttttttaaaattttccatattcttttccttctttcatcaagtgaactggctaaagtgcggcaatatccgccctttaacagtttttatgaaacttatagtttagataaattgaaaatgaccgattgtccattgttcaattcgatctcttttgccccagtagtagcacttttcccatccacagtaaacatccaataggtttgattcttttcatcctgagaatgcccttcaagcgaagtgatgaagccatcattttcctcgacttcaaaattttgtttcaaaatagtcagcaaagtttctccttttttgaaagtcacttcttttttcaaaaagttttgaccattttcttgtaacgtgatcgttgctttttgcgatgtttttacttcctccttttggttggaagtcgatggtgtgttggttgtactacaacttgtcaacatgagtacactgacactcattgcaagcagactataaattatttttttcattttttcctcctgaatgattgtaaaaacgtttgacgactggcagaaaaacaaggaagaacacaacattacctatactgtgcatcagatcaaacgacaccccttgaaggtaatagacccaaggttgaggtaaatgatagaggagcgtatcgaaaacagtcatccctattccataaactatacctgctagaaaaaagcaggttccttttaaccagagattccttcggattgttcttctcgagcagaaaattgaaaacaacgccagaacgacggtatagctgagccactgaccgaagacccatggccccacaccaaaataaaaactgctgattgcgatagaaagactcatgacaattagcgcatctttcaagcttaagtaaagaactataaacaaaaaaatagcagtcattggctggaaattcggaataaattgaaaagcgatcctacctgctacacaagcagcagacaataagctaagctgggcgattttatttgtggacattcttgatgtaactcctccttcaccagcagatgattcacgttcattcagtacatacagaaaagacttgtgacaattattctggataactgccgcaagtcctttggaacagaattatctgaatgacctctggtaatccaacttatccaatcaggactttctcaccattaacggaaccaagaattcgtaattgataaagaaatcaatgacggatcgtgggtaatctccagatgagatcgacaagaccgtttgatctttttcgtttgttgctatcgttaaagactgtcctttatctaatcgtacttgataagtagtttcgttgatcttttccatatcataggatggatttttcatcgccacgataaaaatatcatccaatacttcattcgtcaattcaaattcgctctgaaggttcaaacgaagtggcttcgtattgtctagtagtgtctgattaactgtaaaaccaagtgttctagcgtgggctaataattgattcaatttgtgattgaaaatcgtgatctgtcctgctgagaatactcgatcaactgaccagtatcggatcaaagaaagcactcgatcatcttggacatcgatttccatcgtctctggtgatacatttagaagactcatcgattccacttggtatcgttgatcgatggtcggtaatacaaaggaaaagactaattcgttttgtccattcaacgtataattgatagagaaatgtcttgttttccatgtgtcataagctgaatttgatcgttccagaccaatatcattcaacggtttcagtaattcatatgtgaagtattcgatcagacttgtctttccaatcgttgagatcggttcttcattcaatataaagcggtcatatgattctaataattcgggaaaatctgattcaatcaaatattttctcatacgtaaatccgctaattctgcttccgctgtttcaatcaaactgacgatatcttgatgatcttgctcttttccttctaaatacccgggattttcagatacttcataagcatgcgtgttttctgaagtatccgtattcgtcggagttactttttctttttcatggatttttgtttcttctggcatagggacttcttctgtgtcatccagtggcttacttgtttgttcctctaatgaagtgttcgtttcttcatgatcttctgtctgtgcttcattttttgtccattctgcttcatcgtgttcattcatactcggaacctccttcattagattgattattaggattttcattaccaagataattcatcaagaattcatggattgcttgaccaaacccctctttgctaccgaaatagcgactgatttgccgttgctctttttctacgatggctgcgcgaagttggtccgctcttgcttcttgtttcaatgcttctttttgctgctggattgtttcaggtgtctcgatataaggaagccagcctaatttttcattagatagcacttgcttcttcttctctaattcttgaatttcttcctcgattttcttacgattcaagaatcctttattatcgtccaaatcagtcatctgccgattgatttcttttatctgttcgtctagacgttcgatctctgtctgggctgtgatcaccttcgcgtctagctcattgatttttttgtcatagtccgttgtctccggttgggaatatttctcccactcttcatcgatcctaggcaaaacaaaaatttctggcaaacttgcatcgataccaattgtagggcgatcatggtaataagtgccgattttgtaatagctcatcgttggtgagatgctttctacttgttccataaaaggaaattcttgcaaaaaacgatcatggatcttacgcatcagcaattggtcaatctcgtgattttcatttgagcttcgttttaattcttcgttcaatcggccgttgtacaaacggtagatctcaggaatatcttcttcgcggacagctttttcaaaagcctgtaaatcttctaataattgggaaagattcatgcttgctttttctttgatatcataaaaagaagacgattcttttgctgtatcctgattcgtgctcgtctcctctagttcgccttgctcataatttgtgtttgtatctggctctttcatactacttgcctcctcttactcatctgattttcacttattaatacttcaatagtaccattttctgtaaaaaattgttataaaaaagagcgggcaatgctccataaaacaggctgcaccaaaatttggcacagcctttttttcgatcaactagtctttgatatctgattcatctgataggacagaatcgaatgcaatgacttttatcatattcttttatttactaggcagatctcttgttgtgaaatgaatgcgctgatggtcatcacgagttagttgcgtttcttcgtttaaataagtaaacgtcaattgttctaattcgggatcttcaagcattttttcataaccggtaaaaatcgaacggatatagtgtttatatgcgtttttctttttctgtctttttttcatgtagcaccttccttatcaaaaactatcataccaatgaataactatctagacaagttggtttaaaccattttctttgtttttttgaggaattttgctcttccagttgacgaatccaaaaaaaaatgaaaaaatgctttagtacttaaggagggaacccagtgaaaaaaattggttttgattcagagaaatatattgaagagcagtccgcgtatattttggaacgagtgaaccactatgataagttatatttggaatttggtggaaagctagtggatgacaaacatgcaaaacgtgtacttccaggatttgaagaagatgcgaaaatcaaactgctacaaaaattaaaagatcaggctgaaatactgatttgcgtctatgccggagacattgaacgtaataagatccgcggtgattatgggattacttatgatatggatatcttgcggctgattgatgaattacgtggttatggattattgatcaacagtgtcgttatcactcgctatagcggccagcctgccacgaaagtctttatcaataaactagaaagacgaaatatcaaagtctataaacattcagaaatcgaagactatccagtcaacgtagaaaaaatcgtttcagaagatgggtttgggaaaaacgaatacattgaaacaactaaaccaatcgttgtagtgacagctcctggaccaggaagcggaaaactcgctacttgtttgaaccaactgtatcatgaaagccaaaaaggacatgcagctggttactccaagttcgaaacttttccagtatggaacgttccgttgaaacatccattgaacattgcctatgaagcagccacagtcgatttgaaggatgtcaatatgatcgattccttctactttgacgcctacaataaagtagctgtaaattataatcgagatgttgaaaccttccctgtaatcaaacgtattattgaaaaaattactggtaaagaatctgtttatcaatctcctactgacatgggtgtgaatcgtgtaggatttggtatcgtggatgatgcggttgtccaagaagcttctaaacaagaaatcatccgccgctatttccaaacagagtgtgacttcaaaaaaggattgattgacgaagaagcagttaatcgaatcaaactgattatggaagaagtcggattacgccctgaagaccgaaacgttgtcgttcctgcccatgattatgcagataaaattcaagaacaaagtcctacaaaagatccttctgctgtgattgcaatcgaattaccagacgaagtcattattaccggacgtacaagctcattgatggatgcgtcagcggcagtcatcttaaatgcagtaaaacatttagcgcatattgcagatgacattcctttattatcaccattagttcttgaaacaatacaaggattgaaatcaaagacacttcattcctctttggatgcactaagcatcaatgaagtcttgatcgctttatcaatcagtgcagtaacgaatccaatcgctcaagttgcttatgataaactagctgaacttgagggagcacaagcccactccactgtgatggtcaataaaaatgatgaacaaacattgaaaaaactaggaatcgatattacttgcgcacctgtctacccttcagaaaatctatactaccaatagaaaaaattcacttataaaggatgaaaacgaaactattagcattagcttaaacaatagtttcgtttttttatagccatcactaagtggatacacttcttgtcccttcttgagagatattcagtttgaaagaaaaaacaagagtgtaataaattttatttctcatactttaacttgctttctctctctatttgaaatacgaaaaaacaatggaacatcagtttttttagcgtcttttatctgttttttcgatttattttggttgctttatattctaatggaaaatgaatgcgttttactctaaaaaagtaatgaaaatttcactaaagattagtattttatttacaaaacaggtaaaataaaacggaatttggaataggagtgattatttgagttatttattaggtattattggtttatttgtcacattaggtcttgcttttttgatcagcagcaacaaaaaagcaatcaaattgaaaccactaattgtgatgttcgttttacagcttgttcttggtttcgtattattacgtacaacttttggtacagcggttgtttctgtattggcaaaaatgtttgatcatcttcttgcttttgctgggcagggtgttgactttgtttttgccggtgtagcaaataaaggaagtgcacctttctttctttccgtattgatgccaatcgtatttatttctgctattatcgggattttacgctacatcaaaattcttccattgtttatgaaagctgttggtcttgggttaagcaaaatcaacggaatgggcaaattagaatcctacaacggagtagcttctgctattttagggcaatcggaagtatttatttccataaagaaggaattacctttcttatctgagaaacgtttattcaccatgagtgtctcggctatgtctaccgtgtctatgtcaatcgtcggatcttatatggcactaatcgattctaaatatgtgatcactgcccttgttttgaatttatttggcggatatattctggcttcgattgtgaatccctatgtattagaagaaaaagaagacgaactaattattgaagaaaacaaagaacagacctttttccaaatgttgggagaatacattcttgatggtttccatgtggcaatcacggttgctgccatgcttatcggttttgttgccttgattgctatgatcaatgctatctttcacgggatattcggtattactttccaagagatcttaggttatatctttgcccctcttgccttcatcagtggaatcccatggaaagaagcagtggatgctggtagtatcatggcgactaaattggttacaaatgaatttgttgctatgacagaattagctaacggtcatttccattttactgaacgcacaacagcgatcatatctgttttccttgtttcatttgccaacttctcttctatcgggatcatttccggtgcgatgaaggggttaaacgaagaaaaaggaaatcttgttgcaaaacatgggttgaagatcttgttaacagcgactttagtcagctttttaagtgctattgtgactggattactggtataataaacaaaaaagcaacgttgctttcaaaagctttggaaatatttccaaagctttttcagttgctcaaatatcaaaggagaaatgatgatgaattattgctatgtgtttatcggtccttctggttctgggaaaacttcgctcgcagaagctgtttttcagccggaacaaaagatcattacttacacgaatcgatcaccaagacctggagaaaaagatcaagaggattattattttgtatctgacgatacattcaatcagatgatcaagcgagacgaatttgcagagtgggatcaatatgctcaacataaatatggttccagcaaagcagagattaccaaaaaactgaaggaaggaaattgttatgccgttttgacggcaaatggtttttggcatttatacgagtattttggcacggtagtccgtccgatctttattacgatttctaaagaaacactacaatcacgcctgaaaaagcgtggagattcacccgaacagatttcggccagaatggcagtttatgtagaagacttagctcaactggaacggttggcagctattcccacacttttagtcgtgtcaaacgatggagcgttccaagaagcagcagataaaataaaaaaaggattattgatagaaacagattagctaaatatccataagataagctgagaggccgcgacaaaaatggtgtcacgacctctcgatgaacggtgtttcagaagtagcttcttcgaaaattatttcttgaagatcaccactactgtcccactctcttagcgatcagctagttgtttttcgtattattaagtcttcatccttgtgaagatgcttttatactcacttgattattttttgatacgcttttctttcaccatgttcaaaagggaattcaatcatcccttgataagtgaatccagcagaatagatggtcttttccatcggttcattagatggataagtatcgatacggacatcttggatatctttgctggctgcaatcgtcaacaaatgttctaagaacggttttgctagttttttccctcgagtactttctgctaaagcaacacgatgaatcgataaataaggaccagttgattctttccaactaccatctatttttgtgtaaacgggatccacgcctgagactaatgcagctgttccaacaatttgatcttcgactattaatacatagctttcttttctttcaatatcgttcaaaatcgtttcttttgttggtttctgcccgttctgccattggggagagccttgcgaagcaataaattccgctgcagcatcaataatttttaccacttcttctacttcttcttttcttgttagccgaatatacacatccagttacctcttttctgtttctttttcatttatattctctaatttttgaatcacttcatacagttcaggaacttttgaataacttctaagccaattttttggatgatccagtagttgactgataagttccaaatgatgcattagcgaccattttttcaatactccgagtcctggaaatttttgttgctggtagagagccagtaattcaatcattcctgaagtgattaagagctgatgatggtgacgcatgatccattttttcattttatctcctgcttcaagaaacttcaatgcttgatctttagcggaatcattactgtcagagacaaaatgctttacgcggatattaccgtaagcatcgatatacgttagatggatagcaagcgctcggctaggaaaccctttatcgaaataacggctgccttcgatcgtgaaatcagaaaatccactatatccgtcttcgtggaaaaaaagatagtcatcgctaaaaaagtcgtccgttttatctgcataactttcaacatgctttctcgtttgaaaagagtcacggatcacaattttgttttcgggcagccagatgcgaaagcgactagcatctggtatcaagaatttcgaatcgactcctgccagctgtttccatacctctgcgtcttttgggtagtgttgtccatcgaaaatcagaaacgttggaggtgaatccagtacgtcgttaagattttctggcgttaaaatctgtgcagagacgacagagctatgttccttgactgtccaactgtgcacatgctgatcgaataatttaaattgtcctacttggggattttggatcacagcgattggatggtgctttttttgaaataattcgatcacgtttttaagcgtagcggaatcacgtactggttcgatcaccggttggattttattggagagcaatcctcgcgacaatgcttcttttaatgctaataggtcaaattgttttcctcttaaataaggatagtacatatttttcactccaatggctctgtgggcaaccgccggatctgctgttgttgccttaagtattcataatcatgttgaagcgccgcaacttcttcttgcaactcattgattgcctgactagctatttcctctaaaaaccgttcataatatcgttcgttagaaaatggatcttggttttctgaacgtcttttcaattctttgtacaattgatctgttggaaaatattttacgcctcgctccatttgctttgcttttcttacttctctgaataaagaagccataaaacggtttgtcaaagcttcttccggtacagcaagctccttctttgctgcttttttcgcaatcataaatgtaccagatgcaggcatttcctcttcgatcgtgtacgggcgatatactagtacacctattcctgtagggatctctgttttcacttcttcatatagtttacttggcaaaacaaaataattataatgcccgacaaatgacagtttggctgtagaacgaaaatctgcttttgtcactttcagctcatagcatcgccattctcggcttccatcaaattttgtcaagcagctaagcgtatctacaattccttggtcatcaggcatcgtgacttcttctacgactaagccgccctgctcgatgcaatattggtataatgaggattctatttcgatggttagcggggttttcatgtttttacctccgaacatattttcgtcttacattttacatgaaatgattttaaaatactagacagaatacacaagaaacaaaaatagaaatgatgcttgccacgctagcaccatttctatttttcagattgactgatggacggaacgtttttctaaatactgttgcactttttcgatcccgatacaaatgacccaataaatcagtgcaactaaaatatagagagaaaaataatcgaatgtccgaccacctatgatctttgctttttgaaatatttctggcactgtgatcgttgccgctaacgaagtacctttcactaaatccatagctacgttactgagtgccggtaccgagattcgaaaggcttgcggcaaaacgatatatttcaataccccaaagaaagaaaaaccggaagctaaaccagcgtcccactgacctgaagaaacgcctgctagtgatcctcgatagatttcaccaataaatgcactgctggtaatcgtaaagcagatgactgaagccgttaaggcacttaattgataaggtaacccgaaatatagcaagaacagcaagactagtgcgggaatacctctaaagaacgataaataaaaacgaataaatacattcagaggtagccaatccaaaagacctagaactgtcaaaagcaaccctaccaagtttcctaaaacaaaagacacgaagccgatccctaatgtgtataccaagccttgcagtacgaaaggaagtgaagtccacatgagggaaaaatcaatgagaggaaagtacatcaatcactcaccgactcagtcatcgtttctttcggtttgactgaaacatcagtttgaaaatatttttcagatattttctttgtcgtcccgtcttctttcatctcttttaatacgccatcgattttctttttcagagcatcatttccttctttcaataaaaaaccactttcgttttcattgaaataaacgttctccaagatttttacggggatatctggtaaagcagatacggccattttctgtaaataataatcatttaaaatgacgtctgttcgaccgtttgctacatcgcttaaatattgatcattcgtggcgttatcgtaagtgactaatttagctccgtatttttccgctaaacgcatatagctagtattgggttcgccagctgctttttttcctttaagatcatcaagtgagtggattcctgaatcatctttttttcgtacgatcatactgtcaaatgaatatttgaaaggctctgaaagggagaattttttttctctttcttttgtgataccaaaatcgttcgcagcaaaatctgattctccttttgaaacagaagtgatttgtccatccacattgtattctttaaaggagactttgacatttaaacgtttggctacctctttcgccaagtctacgtcataaccaactaattcattttgatcattataataagaagcgggaaatagtgtgccagaagttgctactaccaattctttctttttttccacattactccagctgtgatcttcttggttagcggcagctgtaccgcaagcgcttaaaataaaaaaggcgctagttattagagcaaacaatctttttttcttcattttttcttctccttgtttctgctatttccatggatttggtaaatggaactggtgacttgcttcaaatagatagccgatttgaagcagcaaatcttctcttcctctggcggacataaattgaattccgagaggcatgttttcttttgtcaaatgagtaggcaagctgattgctggttgtccagtcagattagccaattgtgtataaggtgtgatcttcaagctgtcctcaaacatagaagaaacaacttctaaagcttgtacttcagaacaatcatggatgtgttccatctgtgctcttatcgtatcactttgcaaatcttcgctgattttaggggcggtaaatgcagtcgttggtgaaaggaataaatcatattcttgatgcaagttttccatggcaattgctgcttcatcccatacatgcagagaatcgatgtaagtagcggcagaaagtttctgaccatattggaacaaagtccaagagatcggctcaagttcttcttttctgacagttcgttggatgcctgcttcaatcgagtggatcattgctgcagtctctgcgccattcatctgataataagacgtaatcagtttacgaccatctagtggataaggaatctccgtcaaatcatgtccttctttttcaaggaaatctacagctttttttaaagcaagtactgcctcttcactaatctgtgagtggatcggtgaatcgatacaaaaagctatcttcaaacgtttttttcttggatgtgtttgccattcaactggcgatacttgatatggcgcaccggaatggatacttctcatcccataaaataaagcctccgtgtctctcatagaaaccgtcaaaccgaaatcaatagcagctccttgccatcctcgccaagcatatggaccaactggcatcgtccctcgcgaaggtttcagcccaatcaatccgcaaaacgaagcgggtattctaatagaaccaccaccatcactagctccagctaaaggaacgattcccgctgagactgcagcagcagcgcctccgcttgatccgcccggtgtacattcaaggttccaggggtttcttgctgggccatagatgacggggtctgtaatatttttgaaaccaaactctggcgcattggtttgtccaaaaggaactagccctatcgcttctgcttgctgtacataattggatgtatgagaagctcgatgtgtttcaaataaacgagatcctgaagtagctagccacccctttttttcttgaccgagcatttttaaaggaaatggaatacctgccaatggtcctttttctgactggggaatcaatcgttcagtggaactattctcgaatggttcaagtgcaacaaacgcattcaattcatgattttgtttctttatttttttctgtacgtcagcagctaattcttgaaaactaaattctttttctttaagtcctttcgctaattctgttgcatctttcatattatcctcctttttgcccctgttattttcccacaacttcgtctaacatacaatgagtacgcttgcacagaaatgaacagacaaatgttttttataaaaaaagacgaagatcatgatcgatcttcgtctttttactaagaaatagtgcgtaatttacccttaaattcgtcaatagacgcatatcctttttctgacataatctgagttaattcgtttgtgatcctagaaaagatttccggtccttctttgtgaagctcggtaccaatctgcaacatgcttgcaccgcatagcagatgttcaaatgcatcttgtcctgtccgaatcccacctgtaccgatgatttggatttctggtttcaaacgcgtataaaaagcgcggacatttgctaaagcagtcggcttgatatactctccgccaatgccgccgaacccttcttttggtttgatgaccacagcttctttgtctgtatcgatatacaacccgttacctacactgttgatagcattgacgtatgtcaacgggaactgattcaagatatctgccatctgatcaaaatgagcaaaatcaaaataaggaggcaatttgattcctagcggcttagaaaagatgctgaatacttctttcagtgtttcataagtggcctcaaaatcgtaagctagttgtggtttaccaggcacatttggacaagataaatttagttcagtaatccccttgaatccacttttttctattttcccaagcatttccaagttttcttggacactcatcccggcgatcgaaaaaaataatggttgatttgggtttctctgcgctttttcatacgcaagagcatactctagataataagaaaagcctaagtttggaagccccatagaattgatactgcctaaaggaacatcaaaatagcgtggttcgggatttccttttcgtgcattgattgtacagctcttagtgataaatgctcctgcttctgaatgagccagctcgtctaattcctgggtagtcatgcagtgtacaccagatgcattcataaaagggttagcaaaggtatgattggcaaaggtcgtttctaaactcaagtaaatcgctccttcaaacaagttattttatctagtgtatcatgactaaaagaaaaatcaactcttgtttttcaacgaatttcttaatcatcctgttcggttgatagtacttcccctgtttcactattgatcttgactgacatactttgattgccatcttttactttgacttcccaataagtagtacctagatctttatccagatcccaatctgttgctgtaccgcttcctactttatcgacagcaatctttgcggcttcctcaatcgtgatcaatttatcaacagctagaccatcttcttttttcttttgaccattttgatcctctcgatctagcgtttctggattctctgtttccattttttcattctgagcatcgattcttgcttcatattctttttgatcatcgacaccttctatcttgtagaagtaagatccccaatcactatctagttccaaactagtaatagcagtatctggatacttatctttaaacaattcaatcgcacgagctgcagacactttgatagctgactggcccattgcctcgctcgaattctttgtttgactagacgaagatgtacttgcgtttgttgaggattccgatacctgagaagagcgtggttcactgctggaagatgtattcccagatgttccttgattggtgtttgattgacaagcagctaaaaacaaagccgcaaataaactagtataaataacagttttcttcattgattctatctcctttattataaaatagtattctatacaagtataacgaagaaaaaaatttctgtcatgtttaaaaattaaagaacaatgtttttattatgaaaataaaaaagaagctaagttttagagacaaccctagaagttagactaacatctcacttcgggagcatcataaaacttagcttccatttattaaataattaaatagcttttaaactgcctttttatatcaattatgcacgatgcattgggatatcattatttccaggttgaacaagcaaatattgaattacatcgatattgcttgactcaaatgaagctgcacaagcttgtaaatatagatcccacatccgatagaaggaatcacccatttcttttgtgacttgatcttgaacttgatggaaattttttgtccaatgttctaatgtcaattgatagtcacgacgcaaactttctaaatcgatcaattgcaaatcgttttttgtaatattatcaactaactccgtaacaccaggaacataaccgccagggaaaatatatttattgatccaagcgtttgtcgcaccgccttgttgtcggctgattccatggatcaaagctgttccttttggtttcaataaatcttttacgactttgaaataaccttcaagattttcagaacctacatgttcgaacatacctacacttgtgatatgatcaaacgtttcgccttttagttcacggtaatccattaataatacacggcatttatcttctaaatgttcttctttgatttttttggtgatcaaatcgtattgttcttcacttagagtgatcccagttgctttgacgttatattctttggcagcagtgaacatcaatgttccccagccacagccgatatcaagcaatgtttcgccttctttgataaagagtttgtctaaaatatgatggactttattgatttgtgcttgttccaacgtatcttcaggtgtgttgaaataggcacaagaataagtcaaagttgggtctagccaaagtttataaaagtcgttacctaagtcataatgcgcatggatatcttctttgtttttttgttttgtatgtttttctttctttggcagccattttagataatcttttcctcgtaaaaagctgtttgcttgctgataagcatcgttgatcaatgcttggatacttccctcgatctcgattcgatgatccatataggcttctcctagtgccaaagaagcgttgcttgtaatctctttcattgggatttcttcatggatattgattttgatttggggaggagtgtccgtatctccgtattgtttcgttgtaccgtcccaataatttacttcgacagggagcgagaaagaacgtgaaaataattgattgtataaagttttctctaacatgattttcctccttaaaaaaactaccctattacgttaatactaaaaaagaaaagaatcaactaagaagtttaattttttcagaaatttttcaaaaactactttatttttcatttttttcacattcattgtcgcacaaatcgcttaaacttgtcattcgacacgcttatctttgaattttgtcttagcaaaaacccatagaagcagcaagacagttatcattgtttggacacttagcatcaagataaagtcaaagtggataaaccctacaactgctgctaccatggatcctatccccatcacattcagcatcaaatttgcactctctttgaatgtatgaatggatgaaagttggctttttcttgtcatccacaagaaaaaggaagccccgaataaaatgagactcgtcatgacaaataggacaataccaagacttaaactataagataaaatgattgttggacgattactggcataaaattctctttctaaaaatcgttggaaatcttcgggcgtacgtacagaatctggttggaaagatggactataattcatcgtatagcggcgtataccagatttatccttttgttggatcacccattgttccttctcaaaatcaataaaagttccatgatcggattgttgtttctcagataaagacacacctaccaaaatttcagaggtcacagctatcgtttgttgcgatgattgtaacccagtttcagataattcaagttcagaaaattttttggttccttgttcatcgatcagcgaatgaacggatagaaattgttctaatggaatcgcttggatctgattggcataaaaaagagttacaggcatgaccatcaaggaaactaaaaatacaaatatcaagaaaaatttaggccatgataatagtttgcgtcccgcaaacacttgagttggcgtacgtaaagtggaaaaataatttaacggaaatgtttgcatgatcctctgctcctatccttttgttccgccagatgtcaggccggtaacaaagttcttttgtaaaaagaagaataatagacaaatcggtagggcaatcaaaattgctccagcagcaaacaaggagaccctttgatttgtcacatcagaaataaatgtttgcaggccgacagcaacagtctgattttcaggtgttcgaagcaagaacttcgctaacatgaagtcgccaaaaggtcccatgaatgcccataatgcttgaacggcgagcattggtttgacaagaggtaatacaatctggaaaaaaatcctgaaatgtcctgcgccatcaagtttagcagattcatctaaatctattggtactgtgtcaaagtatcctttcatcagccaagtattcattggaatcccaccgcctatatagatcatcgtcaagaaccaatacttatctagcgcctctaataagaaagccatgacataaaaggcagtcaatgctgccatagtcggtaccatctgaatcactaaaaagaacatcaaacttgatttgcggccgataaaacgataacggctatacgtatagccggctaaagttactacagttacttgtacgatcatcgttaggacagagatgattaacgtatttttataccaagtcccgtaaagtgtttcactgaacagccgcgtgaaattccctaaagtccagtcgcttgaaaaatccaaactgaaagccgcaatgtttcctgacttgaaggcagtacttgctgtgatcaaaagtggatagataataatgactgataacagcaaaagaaaaaagtaagtaaaaaagtgagaaagccgtttttggaatcgtgcactcgaatgaaattttttcattgtttaatcccccatattgaacgcatttgtctttttgaacactagcaaagatacgcagataacgatgatggagataatcaacgtgatggctgaagccatagaatactgcggagaagttccagtcgtaagtttataaatccatgaaatcaggatgtcagtagaaccagctcctccacccacgcttccggggcctccattgttaaataggtagatcatagaaaaattattgaaattcccagtatattgggtaataaacgttggtgctgcaactagaaatacagctggaagtgtgatatttgaaaaacgttgccatgcatttgctccatcgatttttgctgcttcatacaaatcttcagaaatcgactgtaaaatccctgtaaccattacatagatatagggaaatcctaaccatccttgaactaagatgattgccacttttgtccagttcgggtccgttttccaagagattgcactgatgtctacaaaaggaagctggtttatgaaaggaatcacttgagtattgatggcacctacgctatcgttgaatatattcgaaaaactcatgatagtaataaaagctgggaccgcccatggtaataagaaaatgataccgaaaatacgtttgaatttaataaatttctggtgagcaacaaccgctgtgagaataccaagggtgatttgcaaagttgttgcacataacgtccaaatcacggtccatgaaaagactgcaaaaaaagtattgcgatatgaactcaagaagaagatgctaaaaaagtttttagcccctacccaatcaatcaaactagctggtggaatatgattaaagtcataattggtaaatgcagtaaataatgtgactaagactgggaaaatgatggtaaaaatcatgagaagatacgcgggaagtgtcaatagataaggaaaaccttcatcacctatattatgtatgacttccttcatcgtccgattgatttttttgccctctttacgcatccttgctactcgataggcgtctaaaagattcaaagcgtaaaaaatcaagaaaatgatcgtaatgatgaattgcaaagtgccttcaatcaaaataaataatgaatgatcttccattggtatacttcccaaagtaaccaatcctatcaatgcatgaaatccgcccaagaacatctgaccaatgaataggacgaatatggcgaaaaaaacgatacctttaaaagtttggccatttacaaactgccccatccccggaataagtgaacaaagcgtgatttttttttcgttgatctggcttgttttatcttgctgcatctgaatgccccctctaaacttgctgaaccgcaaactacttttaagataatggcaacaagagcaagataattttccatctcgctcttgccacctctatctgaagcacctgttccattttttataaaaatggacggttatcattttaatcagtatttttgttctatggcttcactgattgttttcactgcttcatctgcggattcttttggtgtttttgaacctgatgctgcatcgaacatcaagttttctgcacctgtccaaacttcacccatttctgggatgtttggcattgcttgagctgtttcatattgttcgatcacagctgttgttaattcatcgtttttagccttggctgtttcccgagcttgttgatttgcagggatttcatttaccatttcaaagaatttctcttgattctcctgattcgttacataatcgagccatttttgagagagatctttatttttagcataattgctgactacccatccttttcctccgccaaatggttgataaggctgtccattgtttagagtagggatttttgcaacaccataattgatattgttttctttgtatgtttgcgcttgccatgggccgtcaataattgctgcagttttattggacatgaattgctggctggcgaagtctcctgcactttttatgtcttgcattcccttaggccaaacattttggaaccaatctgttgcataagaaattccttctacagcacctgcattattcaaaccgatatcagaaggatctgtaccatcatcaccgaatacatagccgccgtaacctgcaatcaaaccataggaataataaaagtcagtccatttagctaaaaatccagtattttttcctgcttctgactcaaaagcaaaacgactgtctttggatagattttccaaatctttaaacgtcgctggtgctgtatcgactaaatctttgttatagtacaaaacaagggtctcgattactgcaggctctccatagatttttccatcataagtcacttgggccttgtctgtttcatcgtaggctgattcatttcccagttttacttccgccagatgtccttgctgtcctaacgcaccgatccggtcatatgctgccatcataacgtcaggtccctttccagcaggaccatctaacgctaatgattctaactgatcgaacatgtccttttctaccagcttgattttcacatcgttttctttttcgaatgtatcttttatttcgtttatataatctttatatccagaatcaacggagactgttaacgtttttccttcttccgtgtccccttctgctgaagaatttccattgccacaagccgctaatccgcctaagattcctaaagagactaaccctaaacctaattttttcgcgtttcgttttttcatcttcatttcctcctgtgtattcaacgtgctgttacaccattattataatgggcacaaatctttatttgcaaacgctttcttattgttaccggtaacagtttttcaacacataatcaaaaatccgtattgctgtatctctgctttcccatcttctaataactgacaattttgactaagaataacctcattttcctgttctactatccaaggttcttctgactgattgaagtaaatatggataatctgcccctctagttcacgtacaaaatagagcttatcttcacgatcatttactattaaccattgggtagccccttcagaaagaatcttagacaactgtttcctaagagaaacgagttcttttataaaaccgaacagttctagatcttgtttttctttttcccagatcatacattttcgacaatctgggtcttctccaccagtcatccctacttctgtcccataatagatacaaggagatcctttttgaagaaacataaaagtcatcacagatttcatcaattccttgttcccattacaaagagttaagatccttgcagtatcatgagaatctaataagttaaatgtcccttcgttcacctgatctctgtaaagcatttgctgatgattcattccactgaccatttgcgaagctgtaattttcttttttgcaaaataatctttaattgaatctgtaaatgcgtaattcattactgcgtggaattcatccccttgcagccaagcttgtgaggaatgccagatctctcccagaatatagatatcaggtttgatggctgtaacttcttctctaaattttttccaaaaatgatgatctacttcgttagcaacatctagtcgccatccatcaatatcgaattcttttatccaataggtggcaatatctagtaaatatttttgaacctctggatttgctgtatttagtttgggcatgaatggagtaaaagcaaaagtatcgtatggaatattttcagcagtttctggcacatcagtcatctgataggaatctactgggaaaaagcggatatggaaccagtctttatagattgaattttctccgttttcgagtacatcttgccattggggggaatggatccccatatgattgaatacagcatcaaacatgatacgtatccctcttttatgcgtttcatcaattaagttttttaaaagttttttatttccaaacgcgggatcgacttcataatagtcgatcgtatcgtacttgtgattggatgtagctttaaatatgggacaaaagtatattccattgataccaaggtctgtcaaataatccagatgatccatcacaccttgtaaatccccgccaaagaaatcttcacgatctggatctttgcttccccaagccaaagtatgatcggggtcatttgctttatccccatttgcaaatctttcaggaaaaatttgataccatactgtttctttcacccattctggtacaacgaagcgatcaatttgatggaaataaggcattcgaaaataaaaatttggttcagcaatcacattttctcgataaggaaaaacaccttgatccccatagaaacaatccgtgctgtcttctccaataacatggaacgcatattgtaatcgtcttgtttcacttgtcaattcaacttcccaataatcatgaacatttgtacttagacattttttcattgatcgttctttttgataccatttttcagttgttatggtatacggatctccgcttaacacatatacttttttgatatcattcttccgagtacgaagccggatacggaattttgtattcgtatatagaaatgcatattcactttccggtcgatgataaattgcagctgtgtccattgatttcctccttgcgatttaatattacgtcctcactataagtgatagagatagaaaagacaacgctttcaaagatgttatcggtaacagtttttttgacacttttctattactttttaaacgaattcaacagatagtcctaaaacttttaaaagtttttgaatctattttctacctatttcgagttctatagttatcttagtttctctgtttctctgctctctatattcgatcctcctaattgaaaaagttttttaagagtttttgtttgatcaagtgatttcagataagttgaacatcctgaattagccaagcctaatttttttcttaaacgaagttaacttatagtgaaaaataagttataataagataagaatactgttaatcaactaaaggaagtggataaatgaaagaaacaagacaatttatatggacatatgccaagattatttttgccctctttatattaggagtcgctatcaatatgtttttagggcctcatcatatcgctgctggtggtgtcagcggactaggaatattattggaagctgctttcggttttgaccgtgctatagtcattttagtattgaatatcgttatgttagtgctagctcttctgtttttaggtaaaaaaccttttttcaaagtgctttttggaagcttagtttttcctttgatcatcgcggtagtaccagagatgatgattacttcagatcggttgttatctgtcatttttggaagtgcgatttttgctttaggagtggccatcttatataaaaataactcttccagtggcggcacgacgatccctcccctcgttttttaaaaatatttccacttgaacacttcgatcggcctatttcttacagatgctttcgtcgtttctctcaatctgtttgtttttggaatagaagaatttctttacgctatcttatctattgcaatcacttcaattgtcatgacctatatcgaaacagggatcaatcggaagaaatccgtcatggtcatgagcgaacattctttggaagacattcgccttcgcttaagtgctgaaatcggacgcgggcttaccttgctggaggcaaaaggcggctataaccgaaagtcaaaagaagtgttattgatcgttgtgaccgatcatgaattctctcgaatgaaacctctgatagaagaaattgatccaagcgcctttgtcattgtcaacagcgtagcagaagtaatgggacgcggatttacttatcatccaatcgaatgagttggtaagtaatcaataccattattttgaatgcgttttctttaactggtataataatagaagaagtaagtaaatgttcgattgaaaaagagaggagaattttatgcataaaggaacagaaatcgattttgtagtaaatgacagtttgaaagctctaaaactttatcaaacgatctttgatgaaatagaactgattgaggcaacagagtatcctagaggcaataatgaagtcattttttccttgtatggcacgcggttccatatgctggatgaaaatccgccccttggtctgactgcccctactgctgaacatccaaatacgatctggttcaatatcatcgtctctgacattaaggacacacataataaagcattacgaaatggctgtgtagagatccaagaaatgacagaaatgatggactttggtgtgaccaattcgatgttccgggatccttttggttatttatggatgcttcatcaggttcatcgtgaagtaagttttgaagaaagaaaacaactttttgaaaaatatatgtaaagtttatgatgagattagttcttgtcactgatatttttttgtaaatgttcttattagaggaagcaagtttgttccatgtgctttctcttttttcttgaataatcaatttctttgcttttcataattaaattttgtacaatctaattgtacaaaatttaataaaaggtggtaatcttatgaaaaaaatgtattctacaaaaatgatcaacacaggcggacgttctggagaagtccataatcctgatcacacattcgaattaaatattgcagctcctggtaaacgtgttgaaaacgcaacaaatcctgaacaattgtttgcagctggtttcagtgcctgtttcaacagtgcattggagttgattaaacaacaaaaaaatatttctggcgcttctactgtcagcgcacaagtttctctttattccgaaagtgaaatgagctttgtcttaggcgtagagattgaaggatctatcgaaggcctttctctagaagaaacccaagaattattagaagctgcacataaagtgtgcccttattcaaaagcgacagctggaaatatcgaagttactctgaaagctgttagtgaatagacttttttgtgtaaatccgctatgatacactatagtgaaacagcggaggtggaaaaatggaagatctatatttagctaatcaagtatgttttcctttatatgccgcctctaaggagatcatcaggcactacactccccttctcaaaccgctggatcttacctatacccagtatcttgtgatgctagttttatgggaaaagaaaaagactacagtgaaagagctaggaaatgatttgtgtctggattctggtacgctaacccccttactgaagaagttagcagaaaaaaattatatcaagcgtcagcgtgaaacggatgatgaaagaatcgtaaatgttacgctcacttctcaaggagttgcgttgcaaaaacaagcagaaggtattccacaaaagatcaagtcttatcttccacttgaacaggaagaattggatacactgcaacatctgacccgaaaaatgctagataattttcatcaagaccagaaaaagggctgaaactgctagatgaacgattttatgaggaaaaccaactcataagataacgtcatttagcggtttttctttttgctctttccctttcttattttcgtattccatcatataatgaataacgtgtttatttttgttatttggaggttgtcaaattgtccgtttatcagcgttttttggcgaatgaaaaaatacgccgcctcacggttttattatctgtcatttttgtacttttcttagtaagaagtatgattacaaccattttactcacatttatctttacttacttgatgatccaccttgttcagatcattcagcgatttgtccgaatccctacaggtattttagccatcatgatttatacattgatcgtttatcttatctatctggcattcacaaagtatatcccgatgcttattcatcaaacattcgatatgattcaatctgttattgatttttacgagcatcaaccaaaagatgcggatccagttttacaatacatccacaattatatcgaacggaacgatttctttgaacagcttcaaaatggtgcgtcaattgcgcttggctatttacaagatataggaaaactggccgtggcgttcgctatgtcgttcatcttaagtttcttttttatgattgaaaagcaaaaaacgattttattctcacggttatttctaaaaagtgaattttcttggttctttcaagatctatattatttcgccgataagtttgtcaatacatttggtttagtattagaagctcaatttattattgctcttttaaacactctactcacaactattgccttggccgcatttggctttcaccaactgctgagcttagcaattatgatattcattctaagtctgatccctgtagcaggcgttattatttcttgtattcctctatctttcattgcttattcccaaggaggaatcagagatgttgtttatatcctgatgacgattttggttgtgcatctgatcgaatcttatgtactgaacccaaaattaatgtctagcaaaacagacttgccgattttttatacattcgtggtcttgcttgttagtgaacgattctttggcgtttggggattgattgtcggcattccgatcttcaccttctttttagatgtgctgaaagtgaaaaagattccaaatcattcaccaagagaaacagatctcctttaaattaaaaatgaagaaagataaaaattagaacgaccctaaatatcagatttagaatctgttattcagggtcgttttattgatactttttttcgtttgaaaaaatgtgttctccgacattcttcaaatgtcagtgtcatctattttgtttaaatctttttacagaaaacatcgtggttatacttaatagaatgattccgctccacagtatgactttattttgtacttctccagtttttggcagctgtttatttttcgtatcagaactagcaaggattatatcttttctagtttttatagtctcagctgggtgagggctatcaaatcgttgcgtgtgtgtattccgcttttcttcatttatttgtcgaatggttgtatttattttttgactctctttcttttcatccttttgggtgcttatctcttttgctgttatatttgtttcaggtgttttttctggcatttctggggccacatctggtttttcttctggaaacccatttggtgtttctgggttctcaacctcattatccgtgtctggtttttcttctggtcttgcttcgttgctagagtccgtatctggttctggagtcacatctggcttctctggattctcggtttcattatctgtgcctggttttgtttccggtattgtttcgtttccagagtctgtatctggttctggactgacatctggtttttcttcgggagttgtttcaggttttgattcattgtctggctctggcttcatttctgtatcaggctcttcaccaggttctatttccggttgctgttctccgtctggattttctgtaggcggtatatcaggcttgttttcattttctggtttatccgttggttccccaataagatctcctcctcctgagtcgatcgatgaatcttgctcaactgtctgccgttgactatacggcgtcagataatgaagatcgttcggtaagccatctgatactttgacagtaaacagtgctggttttagcaagtcctgatttaatgtgacggtgaaagtaaatgttgcttgcttgtgttggatagacaaagtattctcgtcgtaactgatcaataaagcagggtcaacattctcaaatgtaacagctgattgtcgtatcggtgctaagtctcccgaataatcaactgttgctttgatggtcgctgtttgtcctttttttaattttgtgacacctgaattgaaggaagaaaattcatcttggaaagtaattcgattgacattggcccatttggtttctgcccaatttgctgttcctatctcttctgtatgcactgtctgatttatagtaagcgataagcttaaggctgtaaatgttgagattaagatgattggatatctcataactctctcactccttgatttttttgtatgcaagaaataagatagtagagattgtgcctatatgtttactgtctttttgtctagtttcatgaaaaaaacagtaatattttcaagttttaacaatttaagtaaaaaggagcgcccttcatgcaaacccaagaagcgataaaaacgtatcttttgaagaaaaaaagcaatacaaaattagatatttttcttttcctgtctgaacatcgtttctttattactacacaatatttagcagatcatttccatatgtctgaatcaaattttctattatacatcaaagaattagaacaagattttgagcgtctcaatctaacaaaactgcatattgataaacaaaaaccttttttgaagttgaattttgaaggaattgatccggcttattgctactatcgtctatttggaagatactgcaacgaatcggtcagttatcagatcttgacttctttgttcagttgtcagacaaattcgattatcagtttaagtcagcaaacgaactatagtgcctcttatctgtatacgaaaatgaaaaaaatcaatgcatttttagcattgtatggtttgtctgtctccttttctaataatggaagaaagtccttttctggaaaagaagtacaaatccaatatgcagcattagatatttattggaatatcttttcaagtactgctacagatttttatgatgaagaaccacaggtagttgcttttatgatgaatactttttttaaaaaagaggtacttgaccgactgaatagcggtatgatggataaattatatttgctgttgaaaatatgtaaagagaattttccggctacttctgtgaaaggtgtacaaagagaatttgaagagtatgaatatattgacttttttattgatccctctgtcgatattttgcgccccaatctgccaatttgtcgcgaacaacgcatcttagtgaatattttagctcggctctctattacgaaaatcgaatcagaaaaaacaagtttggagcaatacgaacttttaagaaaagcaaatgttcctcatgttctttattcaagaaaaatggtggaatccttttgtacagtatttgatttgtttatacctgaaaaagaaaagattctttactcgttggcgttcgcacgaaataaaatttataatggatttcttaacttcaatcaaccaaatacgccccttcctacttttatgctttatcaagagcacaacgtattgaaagaaatccaaacagctatcgaacgattttacatggatttcagagaacaaaatcaacatatgctgccagatattttagaaaaagaaaatgtgctatggatggtcgaagatctagtacatttatatgatcgttacaaaaaacaaccgctgatcgtgattggtgtgaactatacgcgtgatttttacatcagtaaagatttgattgttaagatagaacaaattttttcaaatgaatcgatcaaaatacaaaacgattttatggagaactgtaacatcgttatcagtgactgccctttgaaacaattgccttcccacatcaaaaaatatatattttaaagggaatcatcacaccagaagattggaaaaaagtgattatgaggatttcagaatatatttttgaattaaaagaagaggctcttataaaccaatcagaaaaagaaaatcaagataacctctagttcctagaccaaagaagtgacataaatccgtatactgttaaaaagcatacggatttatgtcacaaaagtttgaatatctttttcgtttacataataaaattataaatcatttactgattttctttatgttcatttcctttttcaattgcttcccataatccatttagatataccgcacctaatgctcgatcatataagccatatcctggtcttcctgtctcattccaaatcattctgccatgatcagggcggatgtatccgtcaaatccgttgtcatacattgtttttagaatacggtacatgtctaatgaaccgtattctgatttatgcggtgcttcatagaaatctcgattatctaaaaacttgatatttcgaacgtgagcaaatgggatccggtctctttggcaaaattctgctaaaatttcatacacatcattttctggatcttctgcaatacttcctgtacaaagagtgattccgttagaaggactgtctactactcggcacaaccaatctagatcttctcgattctttacgattcgaggtaatccaaaaatcgagtacggcgggtcatctgggtgtacagccattttgacccctacctcttcacatgtcgggatgatcgattgaagaaaataagcaaaatttcctcgaagtttttcttcgtctactgatgcatacgcttcaagcaaagatttgatatgagctaagcgttcaggttcccaccccggcaactcgaattcattgctggactgttcgatgcgttcgacgatttcttttggatcatctggaatatcagcggatataaaagctaacgtagatgagccatcttctaagcggtaatcaagatcagatttgacccaatcaaatacaggcataaaattatagcagatgacgtctattccatattctgccaagtttcgaatcgtctgcttatagttttcgatatactgctcacgggacggtaatccaattttaatggcatcatgcacattgacgctttcgataacctttagtgtcaatccacgagactcaatttcttcttttaattctttgatccgttccctaggccacacttctcctactggtatatccatcaatgtgcctacaatacctttgactgcaggtatttgtctgatttcatctaaagtaatcttttcctcttgtgaaccgtaccatctaaaagtcatttccattataaagttcctccatgttcttgtaagtaattctgtaatgtttttcgtacggcattgggtcctgccaacattttgatgaacattccttctatttttctgccaatctcagcttgataaagatctacaccaaaaatttctttatttgacaaaataggagcaattttctcttggatatgtgagatatcttgcgtacccaattgaatgtcagaaagcctttgctgaagttctatcagcaaaggatctggactcggtgtgaatggttttccttgatcatcaaggccaataaggtatcgaagccaagcagcgagaatcaatgggatgaacacaagagtctgcgggtccttattttctatttccatatattttttaatcgtctcaccgtaacgaatcgccaccttttgagaggtatccgtggcgattcgctgaggcatgtcaggaatatttggattaggaaatcgcacagtgactacttcttcaagaaaggtctttggatcaatgattccaggcgattctacgactggaagaccttcattgtacccgatttcagaaactaacagcgacaaatctggatcattcatctcctcagctatactcctataacccagtaaacaacccataatagctaaagccgtatgcaaaggattaagacaagtcgtcactttcatcgtatctgctttatctaccgttgcacgatcagtcaagaacactccagctttttcgaatctcggacgtccgtttgggaaatgatcttccatgattaaataatggatgtcttctgtattgacgaatggcgcaatattggttccctttgcggtttgcaagatcgacatatttgaaaagccttcttctgccaacattctgctaactgatatggaaggattcggagtgatacggtcaatcattgtccatggaaacgcaacgatttcttcattcgataagtattggataaatgtttctggtacataaccttccttttgccattcttttgcgatcgctagcaacgaagtacgtaattgactgccgttttgtgaaaaattatctgtagagacaagtgcaatcggccaagctcccgataaaaaccgtctataaagtagtgcagtaagaatactcatcgtatgtgatggctttttcggaccattttttatatcaactgcaatcggtcctatatatttattacttgtatctttcaatcgataacctttttcagtaatagcaaaagtaactaattgtaaactcggattttcaaagtgcccaatcatcttagaaaagtgttccgagcaatctggatgacaatacagactgtcagctgtcgcagctaatatacgtttgacaaattttccactgcttggcatgaccacttcaagaatcaaatcatcaaaatctcggtaagccttttcaattatttcttcatcgaatgtttcacaaacaatgacaccagtgggcaattcgccttgatccgctaaacgttgagcgatttctgcatgaaatcctcgataaagatttccgccaccaaaatggatccagacaggatttctttgtccagtttctcttaatgatgcacggtcaaaatgaggtatttctacttctttttgagataattcaggaataaagttcttccagttgtttaaatcaatcatttttcccctcctaaactaacatatcagtttttgccttcaaatgaattttatgtaataaaaaccgctgtgtcaatcaaaattttactttttatacaaatttactagtttaagtgacatatcagattgtttttcagatctcttctgttatactacgttcatagaaatgattttggaggtataaaaatgaaaagtagcttgcaatctcaagcttatcaagcgattcgtaaacaaatcatctatgcggacctagaacctggaagaaaaatatctgaaaaagcgctggaggcacatctttctatcggccgaacccccattcgcgaagcattgattcaactacgtcaacaagaactcgtgtacacagttcctcaaagtggtacgtatgtttcaagaatcaatctctattctgcagaaaatgctcgatttgttcgagagcagttagaacagcagatcatgatcgaatgctgttccaaattggacaatcaaacacgaatagtgttagaaacgattttagaagaacaagaaaaagcagccaaaataaaggatgaacgtgcgttttttcgtgcagataatttatttcatgaagcttgtttcgaaattgctggcagaaaagaagtttggaactggttagatgaccacaatacccatttagaacgttttcgttggttaagagtgaccatacaagggcttccatgggaaacgatcatggaacaacatgaagatttattcagagcattagtcgataaaaaaccagaagaagctcgttttcaaacgggattgcacttgcacatgatgctgaaagaacaagaaactgtcactcaacgttatcctgagtatttcaagtagttgtattttcttatgcctcttccattttataattaaccagcgtttttgagtaatctttattaaataacaaaatattcattgactttctaactccaactaaattacaatcattataaataaataattattattggaggttttactatgtcattgattgggaaaaaaatcgaagaatttaacgctcaagcttatcatcaaggagaatttttagaaattagcgagaaagaccttatggggaattggagcatcctatgtttctacccagcagatttcacttttgtttgtcccactgaactagaagacttacaagaacaatacagcaccttgaaatctttgggcgttgaagtcttttcttgctctacagatacccattttactcacaaagcatggcatgatacatcagatgctattggtaaaatcgaatacacgatgattggcgatccttcgcatcggatttctcgtatttttgatgtgttggatgaagaacaaggattagctcaacgaggaacatttattattgatccagacggcatcgttcaagccatggaaatcaatgcagatggaattggtcgtgatgctagtgcactgattgataagatacgggctgctcaatatgtacgtactcacccaggtgaagtttgtccggcaaaatggaaagaaagtggcgaaacattgaaaccaagttttgatcttgttggaaaaatttaggtggtcgacatgttagataaagaaactaaacaaaacctcgaacaatatttagcactgattgaatctcctattgttttttctgttagtttggatactagtgaaaatagtcaaaaattagcagaatttacgaaggaaatatcagaaatgtctcctaaaatctcttgggaaaaaaaagagttgacgcggacacctagtttttctatcagccctcttggcaaagaaagtggaattgtttttgctggtatccccctcggtcatgaatttgcttcttttttactagcactgttgcaaattagtggacgggcaccaaaaatcagtgaatctttgagtctcaaaatcaaacaaatcaaacaaacgctgcattttgacagttatgtcagcttgacttgtcataattgccccgacgttgtacaggcattgaatatattagctgtattaaatccaaatattactcatacgatgattgaaggcggtatgttccaaaaagaaatcgatgataaacaaatcatggcagtgccaacagtgtttttaaatggtgaagaatttagtagcggacgcatgacgatcgaacaaatcgttgaaaaaatcactggtcctttggttgaagaagaattagttgaaaaaaaaccttatgatgtattagtggtaggtggcggaccagcagctagtagtgcagctatctatgcagcacgtaaaggaatccgcacagggattgttgctgactccttcggtggacaagtcgttgaaacactgggaattgaaaatatgattggtaccccttacacagaagggccaaaactaatgcagcaagtagaaaatcatgtgcgtagttaccctatcgatattatgatcaatcaacaggctgtttccttaaataaagagcaagattttatcaatatcggcttggctaacggcatatcacttcaagcaaaaacggcaattattgcgacaggtgcgcactggcgttctatcaatgtaccgggcgaaaaagagtttaaaaataaaggaattgcttattgtccacactgtgacggccctctattcaaaggaaaagagattgctgttatcggtggtggtaattctggtgttgaagcagcaatcgatttggctgggttagcaaaacatgtatatgttctagaattcttaccagaattaaaagcagatcaaatcttacaggataaactagtctctcttgcgaatgtcactgttatcaaacatgcagcgacgaaagaaatcagcggtacgaatcaggtagaatctctctcctatatcgatcgccgtacgatggagatgcatacactagctgtttcaggagtattcattctagtcggcttactccctaatacggattggctagatggaacgatcgaaatgaatccaagaaatgaaatagtgaccgagaaaaatggcgcaacgaatatccccggcgttttcgcagctggtgattgtacagatagtccatacaaacaaatcatcgtttcaatgggttcaggagctactgcagctttaggagcattcgattatctgatgcgcacttgagcgatgaagattgtaaaaaagtcagatagaggttgtgagcctgccgtttcgctccgagtcacaaggaacaatttcaataaacagtttctcatgtttgttgaatattgtgacttgtgactgaggagttagcaggaaaacaccgtttattcggaaaaaaggattgtgataagaattttgtcacaatcctttttgtcttttttttttgaataatcactttttcttctctttttcttatatactataagtagtaaatagtttgagagaagaaaggtgactaattatggcgcaaaatcgtatttttaagacaagttttgcaagcgtttatcccatgtatgtagcaaaagcagagagaaaagatcgtacaaaagaggaagtagatgaaatcatttgctggctgacaggttattcccaaacagaactagaagatcaactacaaaaacaagtgactttcgaacagttttttgcggaagcccctgcccccaatccttctcgttctttgattacaggtgttgtttgtggtgtgcgagtagaagacatcgaggataacttgatgaaagaaattcgttatttagataaaatgatcgatgagctagcaaaaggcaaaaaaatggaaaagatcctcagaaaatgatcttccttaagaagctcttctccttcactcattttgtaacgtttgatttggtaaaatgactagttcacgttaaaataagtcaaaggaggttttcttatatgtttgagacgattaaacaaaatattcaaaaatacgccttattaagagctgctgtttatattatttctgggattgcgattgtgctaaacccttctgctgtttttcattttatcggttatctgatcactgcctatcttgttttgcttgggttgttgaatctttttgaggcttaccgttttaaaaggaaaacaggttcttggagtatcggtctgtttagtggtctttttttcctgatctgcgcgctgatcgtttatgcttttgcacctgcaatcgtttctatcctgccgattcttcttggattagctgttatcatcaacagcttgttccagttgttcttcagcatgaatacaaaagctaaaagttggagtgtttatagtattctgttgttgattggcggattcgtcttattgttcaatccattcaaaagcttgatggttctatttcaaatattcggtttcatcttgattttcatgggcatccaggagatcatcaattttatcagaataagaagaatgtattgagttttatgctttaaaaacaattccattgactgtagtatacacaagaagaccttattttataattacgggactgatgaatcagaattgattcttcggtctctgtttgtatgttatgaaaaccctagttatgctaaggtctgcagagagtttcccgcgtggtagtaaaaaaactcgttaaactattaagttgaagtggatttccgatgaaaagaaaacctccagttcacactggaggtcttaattcacaaagataaaaaaatctcagaatttttctttttataataaaagaaaatgaacaactccctatctttcgctatatgcctgaacagttctgagctgtaatctattctgctggcacctttggacttccttttttatagtatccattgttttttttatttcatgatgagaaacgatagttccaacattctcgataatcttttgcttatctaaatctgttaaaaaataaatactagtagagtcatttgttttatttttacccaaaagtttttttaatttattatatttagttccagtatggttatgtttaagagaggcatttaacataggtaaagcaatccgatcaagcggaagcttatttttagtttcagtaaaatattgattgaacaacctactattttcctgtttttttgaaaatttattattcatatcttttctctctattttattataactgtataagctgttcaattctctaaaatgatagattgttttgggaccataacctgctttttctaattgacgacaggcaatttctgtaagtattttattcaatgactcattactcggcttactttgttctatacgaaactgttccaatttatctttcaatgctcctgtccatgattttacgcaacaatttcctataatttgcgcacttctgatcttatcaccataatattccttggttgctactttactgaggagtcttaaaggaatatactctttataatttagttttttattattgatatccaaaggaatattgaattctcctctgccgttctcaagggcataaatcatctctgcaaaatttttttctgtgtcttttatttcataaatgtaacttactttcctcttcatctgttccctatttttaacaactaaagatttctctgatctttcaggaggagctattccagctttattaaaaatttcaatctgaaaaaaaccagcttttttctggatggatgctgttacaagatgtgaacttttttcagttttgaaagaaagaggtatcataataaaactactggaatcattaacaaccaattcattggtatatttgcgaaataattcagcattttcaagcgcataagtacttcttacaagagattctttcatattttttgtatctattttaaattcatcttcacttaaatcaactaagttaataaataaagggtcaaatctgaaataaaatttgttttattaaagcgattaatatcgtttgctttaaaatgatattgctgagcaaaggcattagcaatattgttaacccattgatcattttcgatacgtgctaatctttcgttatctatttcttgtattaatttatgctcgcccataagcttcctccactgtgataaatatttagacgttctgataagtcatcttaacatatttatccaatccataattttagtataaaaactatttttttctattaaaagaaaaaattgtgactataagatttgtttacaagtatattgtccgaaaaaattaataatatatgttatgctaagttcgggctatattttatacaaaggaatgatgagaatggaatttattggtattttatgcctgatattgatttcaacaacgattggctcacatatctctaggagattaggtattccagcagtaatcggacaattacttgttggtgttttgctaggacaagctggattgaattgggtcaaaccggatattctagtccatgacttctcggagattggtgtaatcttattgatgtttttagctggtctggaaagtgatttatctcttttgaaaaaatatttccgaccaggcatgttcgttgctttacttggaatcatcttccctgttgtttttggctggctaacaggcgaagcattccaagtttcgggaaatgaagcgattttctttgggattattcttgcagcaacttctgtcagtatttcagttgaagtattaaaggaactaaacgtggtgaatacgaaagaaggctcaactattttaggcgcttcagttgtagatgacattttggtcgttttagtcctaagtttcagtctatcttttctcactggagaagcttctagcaatgcttctttaccgcttgttttgattgaacagctcgtttactttgtttttattttcttattagtcaaatggattgcacccttcttgctttcatttgcagaaaaagtgtacgcaaattcttctattatcatcgtatcgctagttatttgtttaggtatgtcttacgtagcggatcttgtaggtcttagttctgtcattggtgccttttttgctgggatagcagtcagtcagacaaaggtcaaagaagaagtataccacaatgttgaagccttaggatatgcagtatttataccagtattttttgtcagtgtaggattagaagttgatttttctgactttggtgagcagctgctctttatttctatattgacgcttgtagcgattttgaccaaattgcttggggggtattttggtgctcagattgccggtttttctcaacatagttcattgatggtcggtgctggtatgatttcgcgtggagaaatggctttgatcattttgcaaattggacagcaaagtcaattgatcgaaccacagtactattcacctttagtaatcgtgattttattaagtacacttatttctccacttgttctaaaatattttacaaaaaaagtttatgaagtgtgagtgacccagaaagcggtcgtgaacctgtcgtttattcgaaaaaaaggactgtgacgggatcgtcacagtccttttactatagttaagaagtcgttctttattgataattttggttgaggtattgtaatagttcgggtgctcgtttagttgctgaatcatcatcttctttattttccaacatgctaaccatcatataaccttggttatcagggttgaaagcaaacaagaaactgttctctttccctttttcatcctgtttttctttgatttccgctgtaccagttttcgctgccaacggaatccctaaagcagaaagagaatgtgctgtaccatttacatcttgcacaacttctctcagatctggcacgatcgtctgtaccgctgtttcgccgatgacattcttcttatcttttgtctctttatctgcaatcaatttaggatagacaagtgtgccattgttggcaaaaacagaatacattgctgcttgctggataggattaattagaagttcgccttgtccatatccagtatcagctagcaagatatctgaattaaagctctcttcattagaaatttgtgctgggttcatactgattggcaaatcaaggtcttcaccaaaaataaatttatccaaacctgcacggaaattcttctcccccattttcaacgtttcttgcgccatatatatattatcggaataaatcaaagcagtttttaagtctacttgtgacacatcactaacacgagttacttgatacgatccccaagaactgtctttttgccatttaagtccgttgatcgtcaacacttcatttggatcgatagtgccgttgtcgagaccgattgctgctgtgatcattttaaacgtagatccaggagcataacctgtcgcaaatcggctgatgaatggttgttcaggattttcttcataagctttgtagtcttcttgtgagatcccgtttgtcattttgtttggatcatagcttggagagctagcaagcgcaagaagatcaccggtttttggcgttgtcgcaacagtcgatccagcttttcctcctagactgtcgaaagctgttttttgtgccttcgcatcgattgtcaatttgatatctttgccgttttggacttcatgctcgatcagaacctttttctcgacaccgtctgcatctgtgatgcttaattttccacctgtagtcccacgaagatccttatcaaaagccatttccaaaccagatcgtccgatttttccattactgcttaattctggatttttatcaatatcttctgctgtgatatctcccacgtaaccaatcagttgagcagctgcttcacccaaaggataatatctgccgtctacttcttggatggtagctccagctggaagttctggcgttgctccatcaatgattttcaatgggacaaaataatcgggttgtacccagctttgtgaaatagcttgattgatagcatcttctgttaagtcgaatgcggaagcaatggctttgatattggccgttttttcgtccccatctccaagtttgcttggaacgactcctaattgttttagtttgccggttgttgctaatggttccccatttcgatctaaaatgttccctcttgttgcttcttgcgtggtcaggcttactttatcatttccttccatttctggaaaaaccaagttaggctgccagttgatcgtggtttgaccatcatttctgtctaatgttcctttataagaaagatctttcaattcacctaatgaggtattcatctttgctttatatgaaaagctataagtagaatcatcttttttatctacttttagatttgatatctcaagtcctttgacatcggcagcgccgtatatattttggtatttttctaagatctctttttcagataatgcacttttatttgtggcctttttcgatgccattcctgcagctttgttataatctcctttgtttaaagcttggacaaattgctcaaccgtcttttctccagcttctactgcttgtgtttcttggtagtgccggtagtaaaaataaccgccacctgcagctgctattaaaatcactgcgccggcaatataagcgcctgttcgatttttgccgcgcttgtcacttcttttcattttttcctccttcttttgcttgctattcctttatttacactatttatacctgtttattctaacataataaaagaagtcagaacataacataaattgttatttctaacttcttttattttcttttctttacttaattattcagaaattttttgattgcttcttggtttttggtcaaatctaattccagaacacttccggaaggcgtattgtcgttgaagtcccaactgccgtctactggtacggataatgtatcgatctttttattatcgtctttgaggaaatccataccgcaatccagtagcacactctcaggaaggttcgtttggatactgccaagtagttttcccactgctttcggtaatttaaatatcgaagtgacgtctttcagctgctgagagatcgctttaatcacttgttgctgtcttctaatcctcccaaagtctccttcttcgtcttcacggaatcgagcatactgcagtaacgtattgccatccattacttgcttccctttttttatatatacgccatctaaatctaaagatttttctgcatcaatctttactccatcaggaaacagttcattgacgcaatcgataaaatcttgaaatgtgatacttgcataatacggggcttcaaatttgaaattttcctttaatgtttggttcaataaatcaactcctccgtaagagtacgctgcattgattttatccattccgtaacctggtatatcgacatatgagtctctcatgatagagattagttttgcttgttgtgttttctggtcgtattgtgcaaccataagtgaatctgagcgaccattttcgtctttcgaacgggcatccgaaccaatcaaagccacgtttagtgtggtagggacacttttcggctctaccttttttacagttgaggtctgttttgcagacgaaaatccatggacaaattcaatcgaaaaaaagccgactactagtgtaagcagtaacaaaacagataatatgattttttgaaatactttcattgcgaattcctctttctaaaaagaatctctcgcttgaaaaataaaagatagtcctttatgataattcaaactgagagattctcagtttctctttattgtttttcaggtcgatagagcggcaactcttcggcctgtatcttcgaagaaatattcaacgtgatcccgattcctaaagaaaggatcagataacttgttcctccataactaacaaatggtaatggcacgccagtcattggcataagccctgcgatacttcccacattcattatcgtctgaacgaatagcaaagttccgaatcctaaaagaaacaatccagcttgctgatttttacaacgactacttaaacaaaagattctcatgcataatgagaataataagaaaagtacacacaatgcaccaattagcccaagctcttctgtaatgatcgaaaaaataaaatctgtttctgtctctggaagatatcccttttttgtgatactgtttcctaatcctctcccccatatgccaccattgtatagtgcataaaacgaatgagtcatttgatagcccgcaccatgactatctatgaaaggatctcttaaagtcgcaatcctttcataagcatgattgaacatctggggaagccagcctttgtttcctaaatataatactccgccggctgctccaatcaataaggcggaaaaagtaacaatcagatagattccttttttaaatggaactgctgctgcccaaaaaatgacccacgcaatcgaaagaatcatcaatgctccagcaatctttggctggaataaaatcagcaaagttatgcctactgtaatcaggaaaggtttttttaggtcttttggcggattatttccgtcacgaaaaaaccagcttagataaaaaatcagaaaaagatttgctaattctgaaggctgaaattgaatgccaaacagagaaatccaacgttgcgcgccattaacagtgacaccgaatatccctactcgtactaaaatcaaaaagaaaatcgataaagctaaaccatatcctgctattttagggtgaagtaaatagtgcagtttgattgaacgagctaagaagattacgccccaactcaaaaatatgaaaatcagttggcgcaataatagactttttgtattttcatctgcttgcaataagcgataagaactagcactgtatacttctaaaagaccgatcatggacaaagtcaaataaggacccaaaatccaccaatcgatcttttttctttttttcaccgcatctcctcctcacacagtaaaccacttgtcaggtgaggagcgagtttgtctcatcaaataagtcagtattgaaaatataaagaaaaggtcagaaaccttttcgaacaagaattctgacctagcatcatctcatcgtccgagttttagcactatacaacgtaaagaaaacattcttagctattggaaaaagccttaatccgacagtttctgttttacccattggcgactttcgacgtttctgggcaatagcctatgtttgtataggagcctcacctaacaaggttattactatattctatttacgagtccatgatagacttttcctaaggattaggcaatggaatttgaaatgaaatagtgaaatttaacaatctttaatattttttaggaaaaaataacaaataacgtaaaagaatcccagcgcagtttcgttcaattgtgccagggttccttgataatttttttatttttggtgtttttttatatggtttccacttttcggaataaatgtttatttgttgaagtaattgaataacccgctaatcgtgtggtctattactcctatttctttgccatctaaagtaacttttgtgacgacaaaataatcttgcaatggcggaacttctaaatattgcccttgcaaaaaattattcactgtttcgtattctttttccattcttattggggacgtgcgatcgtgaaaatttctcctattgctgcataatcatttcctgccaagcggcttacagcattcaactttcttgggtcgatccttcccgtcttttcatcatagactgtttcattcaaatgatatttctgtacttctagcaaaaataaatcagctgttactttatttttattccgtatctcgacatgttcatataaggttgtctcaaaacgaacttttgcttctgtcaatgctggtactgaaatgattgctgaatccgttaaagtcaattcagtcaagtgtagttcgctttcctcattaggcagattagctgctgttttatttgcttcttctacgttgtcctcatcaaggatatgaatgaccgcttctcttgtctcaagaatgttttttgctgtgtcttttactgtatcttgttttctctggatcgccaaggataaaatcggtggattcgaactgacgatattgaagtaactgaagggtgcgatattcactatattatttacggacttagtcgttactactgcaactggcctagggataactgaaccaatcagcaacttgtaattttcacgttctgtcaattctgaaggacttcgttcaaacatggtctcgccttctttctataaaattcgctaaaaagcagatctgcgaagacaaaaggaaaagcaacgctttcctcttcttcttagaatctgctttaaactatctattaatttttcttttttgtcaagaatctgtgccgtacgtgttttttagttctttgctttattcgcggcttcgacatatcttttagtgatgaattgcggacgggtgatgatggatccaatgacgactgaaaaagcacctaattcataggctttctctacttgttctggagagtcagtatggccttccatgactactggtatattgacttgttctatgatctgattcaacaaatcaaaatcaggcgtctgtgtctttcgagaatattctgtatatcctgctaatgtcgtagacaagagatcaaaaccatcttcttgcgcttgaagcgcttcctcaaaagtcgaaatatctgccatggctaatcgactgtgatcgtggatcatttggacaagctcagctgttgttttttctgtcggacgtttacgagaagttgcatcgagtgcaatgatctcagcttgcgtctccaaaagttctttcacttctttttctgtcgcagtaataaatacttctgacccatcgtaatctcttttaatgatccctatgactggcaaatcaacgattcgcttgatttcattgatatcttctgttgtatttgcgcgaataccaactgctccgccttcttttgcagccaaagccattctccccatgataaaagaactgtgtaatggctcattttccaaagcttgacaagaaacgacaaccccaccttttattttttccagtacatccacactatctcctccaatgacgttctctagaaatacatcttcttataaaaatgtaacccttttctatctaggagtcaataaagtagctatcctttttcttttagcaagcctttcttgttaaaagaaaattacttcaaactcttcatatacgattagcttctcttctgtaaatgccgtgttcagtgcttctttgtagacatgcttgaaaaagtcagtatggactttccgccaataagctaacgttcgatctccttctccttctttccaagcatgttcttccgtgatttcactaaaaggcaagatagtcacatttatatttttgatgatacaaactggttcattttttccattcagaaccacatctaactggcccacttttggtaaaggttccttctcttttttgtataaatcgtatccgcttgatgtaccggtttttattttttttacaactaactcactcaattcatctgccatttcttctgtattcccaaatgaaaaaaagcttagtttttctgattgatacctaggatattcttcttgaaactttttgaaatattcttctactttttgatacataagagcatctactcctttgtttcgtataataaaaaaccatccagatactagtataaacgattgtctggatggaaaatacgatgtattattgaatatttaagacacgtagactatcctcaacgatttggcttggtgtcaaatgataacgttcataaagtttaactgttggaacactatctgtgaattctttctttgcaccgaaattcagcacatgcattgaagaatcaccataataacgactgattttttcgccaaatccgcctgataaactaccatcttctaatgtgatgactaattcatgggcttcttttaatttatctaatgtttctacatcattttctgtgattgttcctggattgatcaatgttgcttctattcctttttctctaaaagcttccactgtttcttttcctagtccaagaaaaccacctaaagctaaaattgccactttttcgcctttattcactgtctgataggttggaatactgtaatcatttgcgatagctttaccatgttccacaccatgagtagggattcgaatagctacaggctgttctgtttgctcaaaagcccaatctagcatagagatcatatcttcttttgttgctggagcaagatatttgatgttcggaatactggataaataaggaatgtcaaatgttccttggtgtgttcgatcactagcagagatcgttccgccaccgactaaaatgatgactggattctcgttgattgctaaatcatgtgataattgatcatatgcccgttgcaggaaagtgctcgattggaagacgactggacgtactccctgagaagccaaagcagatgcaaacgtgatggaatgctgctcggcgatccccacatcaaaataatgatctggatgtttttcttggaatgttttcagtccaaaggcgcctggtattgctgcattgactgcggcaataggtgctatacttgtttgcacttttttatccagataatccatgatgatcgtattgaatgtttctccagaagctgcctgttttgcttctcctgtagacagatcaaatgggacgtgccaatgatatttcattttattatcgattgctggctgataaccgcggcctttttccgtatgtacgtgaagtacgattggatgatcaatatcttttacttcttcaaataaacggagcaccgtttctaggtcgtttccattatccacatagcgataatcaaatcccatagctttaaataggttattactgctttcaccgtgagtttgacgaagctctgctaagttctgatataagctaccgtggttctcatcaatagacatctcattatcgtttactaatacgattaaattggtctgtaaagcgccaccgttgttcagcccttcaaaagctaagccgccacttagtgagccatctccaataaatgctaccacatttcctgattctttcttcagatctctggctttagccaacccagtagctaaactgatagatgtagatgtgtgacccactgtaaaataatcatgttcactttcgtgtggattggaatacccgcttacttcatggtaatgtcctttttcaaagccatttttccgaccagttagcagcttatgaccataagattgatgggaaacatcccatacgattttatccttaggtgaatcaaatacataatgaaaagcaatcgttaattcgactacacctagattcggaccaacgtgcccacctacatcgctgtccttttgcaagattttttggcgcatttcttctgccagctgtttcatttcctccacagataattttttgacatctgctggactgttgattgtatccaatacatgtaatgctgtactcatcatacattctctcctccgtactatcttctttttagttgaaaatagatttgtaacactttatctattctactccttagagttgactctaagtcaatagtattttaaaaaaattcggagaaagtttgttatataagtagtttttcgcacaaatcaggtcacaaataaaaaaacttctacagtcttttaaaaagctctgtagaaagttgatgtttgtcttgctttaagatctcctcaagaaatatgtttttttaataaatgaagctcctgagcaatacgatacaaaaggatgtttgcaccttttaacgagataggatagacctttgttttttcagtttctaaaccagtttgatagctagcagcatcgcataaaactactcgtttttttgaacacaaacattcatcaggtaattcttctaaagaacgaaataaaatgggatttatttcagccatatcttcttcagcatacaaatgaaattgggttcgataaaaaaattgtttgactgaactttctgaaacaacaaatatttctatctcttgctgtatcatctgttctctggtaatcaaagaaagactcttaacaaattttcggatgaaattatcattccatcttagatgaatttggtttttctttttccaatcgtctagcacttctactatttttctgtatagaagctgttctttttctgacagtagatagattcgttccggtaaaaatacttgaccgtctgcccacaacgtacgaacaaattgtaaaaaggattgcttaaaaataaaattgtctgcatcgtcgatttcagcgactgggagaatctgtaaaatcaattcattgagtgacaggtcattgagaacaaaatttttatacacaacttcgaaatcttttcttaacagctccatgttctcattggtataatttctgctattgaacaaagagaaaatataatagacatcttcttcctgtaagtctaacatcccttttcgctcttccaatccttgacagactaattgaaataacggcttcgtctccgcacttttcttatcttcttctttcagttcaaggggaaacgcctttcttccgattgcaatctctattccccgtatgataaaggacttttcatcttccgaatatctccttttaaaaaaatgagtctctacataatcaatcagctcgttacaagcttcttctacatgcggatttttactctcatatccttcccaattgatataacgtactaaagctagcagaatattccgcgaatcaaattctggaataatgatttctttatttttcaaataatcattttctttaaaaaaatccaagacgctctttttgatcgtatatactttactcaaagaaataaattcaagatcagccagttctgtactcgtgaatatacccttgaaataataacttaaaaactttaaaaaataagattgaccatacaaaaattgcgtaagctcagaaagagcaatccctcgtttaaatataagtttgtacttatgcttctctcttatttgttcttttatgcaatattccaaacactcggctagactttctagatcatgaaggatcgtcggtgtggtcacccctagtgaaatagctgtttgttcgatatctatttcttggaattcaaataattgttcgcatagatacacttttctaaatatatttcgctcgatgtatttttccagcattcctgatacacgcctccagtttttttatagttttatttaaacatatccacgaatcgcttttttatttactttttgtttagaaaacccctttcaaaaaccaataaaaaaagaagccggaacaaaagtcgatcaagcttacaatcccagctatcgtttagataacttggtgtcgcttggacttttaccccagccactttcaagaaaggctattcgaagatatcagcatcgagttctttgactacgtccttcagtaattggatgccagctgcgctgttaccgaatggatctagtgctggactgaagacgcctatgccgtaacgattgggcacagctgccatcaagccgccacctaccccgcttttggcaggtacaccaacatgaacggaaaactcgcctgattcatcatacaaaccggcagttgtcataatcgatttgacgatcgttgcactttcttcagtaatgagccgcttgccattccaaggagcgatccctttatttgccaatacagcggctagttttgctatacctgtagcggtgacattgacggaacattgtctgaaataggcatcgagtatctctggaacgtctccttcgatcatttgattgcctttcatataataagcaagagaacgattgatatcacctgttcttgattcagaatgatagatttcttcattcaatgtgatatcaggatcatcacagatttctttcataaatgatatgatccgttcaaatttttcatctgcatcttttccggcaatcagagaggttgttgcaatcgctcctgcattaacaaaagggttcatcgggtgtttgcgatgattgatctccatattcatgatagaattgaaagcaaatccggttggttccgtgttgattgtttgaaagactttttcaattccgttatctttgattgctaataacaatacgggaacttttgacatgctttcgatggcaaaacgtacatcggcatctcctccctcgatcagttgttttgtatccagatcataaatcgccatacctaattgttttggatccacttcagctaatgctggaatgtagtctgccacttgtcctgtttgataatagtggaaattttttccaatcaattgttctaattcttttccttccatttgaataaccagctttcattttttatttttctgcatgctggaatttatgacggcatgcgtagatcgtaaatggaataactaagacgataagataagaaacaataagaatcgtttcataaatcccatgctgtccagctgcgatacttgcaggtggaacaaatgagatacaaaaagcaaaaagtgaagtcaaaagacctaagcaagcaacgattacttttacaacttttcctcctggaacctgataggctctttcaagactttcatctttaaacactaacttcaaatagccagcgaaaaacataaagtacaacattaggtagatcacaacagtcaatgacatcgctgcaagaaatgaaagattattccccccgccacttaatgtaaagacggctgcccagattgtcgcaacaatcccatttgcgatcatcaaatgcgcaggaacaccatgtgcattttctttcgcaaaatattcaggaagtaatccttcttctgccgctacgtgaagtgcttttgaaggagaagttacccaagaagctatttctccgatgacacctaaacaaacaaggatcgcaaggattttcgcaacccatgcaagacttggatcaatgtgtcttaataggaattctaacgattggatcactcctgtattaagagacaaaccctgttgaggtactgtagtagccacagtcaatccgccaaaagtgtctaaaatgatggccagaataaccaatacaaacattgctaatggataatcctttttagggttttccatttcatttgcatgactagcagatgtttctactcccatatacgctaaaataaaggaaacaaaaacaaccagcgtaggtaattttgaaaaatcaggaatcaatgttttcatagacagtgtcgtttgtagtggagcacctgaagcgacatagtggatccctaagccaaacaagactaatgcaggcaataagatcccagctacaaaaccgattcgagcaattaaagaagtgtatttggttccttttagctgagagagcaaaatagcccagaaaataatcaataagatggccaatttcagaaatttattgttttgtatagcgtggatccccgttgcataggataatgcaccagttaagaaatacagcatagtcaagtaaccaacagttatctcaaaccattggaaaaagatagcggcaaaaccaaatcgttttcccaatgtccgactgacccaagtatagacaccgcctttttcccagcctttcaccgttgccatctctgctgcacacaatgccacagggataaaccatagcaaaccgcctaataacaagaaaaatactaaactgaagccagaggtcgcaaatgtgggatattcatatagtgaaacgaccattgagatcgtcatggccaaaaagccgaagaacgttaatttctttgcaggaattttcgttttgctttgttgcatgaatcttcctcttttctatttgattttgtttcaattgcgtttgttaccgaagaagaaaaagtctaatccttcttcctgctcttcttttgtagtagtgatcgttgtgaaatgcatggctgattttagaatcgctgttgtcagcacataggcatacacggcagtaatgatgacaccaatcacttggattcctaagaagtaccagctgcttggatttgttaataaatggctgttagttgcaaaaattccgatcagaatcgtccctgtgaatccgcccattccatggacaccccacacatcaagtgcatcgtcccattgtttctttttacgaaaatcaacagcagcatgacagacgattccagcaatgattccgatcaacatggcactttttgcttctacataaccagcacaaggcgtaatggctgccaatccagcaacggatcctgttagtacgtcgacaaaatcaaagccatttccttttacttttgcaataatcaaccaagtaaccatcgcaaatgcaagagcgatgaatgttgaaccaaatgcgttgactgcttgatcatctgctcgaagtgcaccaccggagttaaaaccgaaccagccaaaccaaagtagacctgtaccgatagcagctgccataagactgctatgctgagttctttcgcccataggaatctttctttgtccaagtgtgaggatacatgccaatgaaccgaatccagctgtcgtgtggatgactgcaccgccagcgaaatctctaaatcccatctgatccaaaaatccgccgccccatatccaatggcaaacagggaagtaaatcagcaggttccaacaaacaacaaggataatatagccttttaaattcagtctccctgcaaaagctcctgtcatcaaaggaacagtaatcacgataaacatcagttggtaaagaaagaacatcaaaaatgggatcgtcgctccatggaacatgttggggaagcttgtaacatgtctcatcaaaaagaaatctgccggatttccaatcataccgccgatatctcgtccaaatgccaatccgaatccaccgaatacccacatgatcgttgttatcccaactgagagaaaagattgagtcatgatcgtcagtatattattcttccgtgccagtccgccgtaaaaaaatgctaaaccaggagtcatcaagcaaaccatcgctgtacataaaatcatgaatgctgtatctcctgtattgataggtaatgtattcattttttcgcctcctttctacgtttacgagtataaaagaaaatctacttgtatttttcttctgtttttttgaatacattcttgtatttataaaagacagacaatcaataaaagcttggtgtgctatgcttttttatcgttttgaccaaataaagacaaaaaaataaacgatcttcttttatagaaaaccgtttattttcgtctttttttatttttcaagctattttttcataaggaataaagaatacttcatataaaaatatattaaaaaagaactgcagcaagtttcactacagttctcaaatttgttcttcatttcaacataagtttttcttcaatttgcttataatttacgtgcaaagaatgaaacgactaatactaaaatgattgcaccgattaatgatggaatgatagccattcctgcaattgttggtccccaagttcctaataaagcttgtccaatggctgaacctactaaaccagcaatgatgtttgcgatgattcccattgatgatcctttattcgtgattgctcctgcaattgctccgatgatacctccgacgattaatgcccaaataaatcccattttaaattcctcctaactgactttttacttcttattgtacacgtggttcgttattttctttgactttttgtgcacctttgcctacagcagcttttgctttatctgtttggcgtgaagcaaattgtcctgttgattttgctgcttctgttactttgtcttgtactgtttcttgatctttttggtattcttcttgtgttttgatgtctgcaacattcacattcacttcgataacatctaaatgtgtcatattgtttacttcagtactgatcaattctttgatttggttgtagatgtcttcgatgtctttaccgtattctacaatcacgtctaaatccacagctacttgtttcttccctacttctgtattgatacctgctgttacattatctgtgttgactaatttttcagccatatttgaaaagaatccgccatctaatgtcaatagaccgtctacatctttcaatgcatagccgatgattttttggataactttgtcttcataagtcaattcaccattcatcatacggttttcccctttttcatttgctaaaactgatccatttgttgtgttcatgtttttgttttccatctttgtttcctcctatgatttaaaaaattgatccactattcctgtctgtttcaaataaaatccgattcctacgccaattgctgtcataatgatgattaacaatgttttgaaaaatccaattgttaaccataaaacagctagcagtagtccaagacccccaaagataatagggagcttgtatgctgaaaatagttctttcattatttggccctcctattccactcgagagtgcttgtagtctcttgtatcttcttgttcttcataaccgctgtatgtgactgctactttgactgtttcttttgttccaagtactctagtcacttcttcttcgatgtcttgcatcagtacacctgttttccctactaatgaagaagttcgcttcaagtctccgttgacatggatatggattcgatttttcgttgaacgtatccgtactttaggtgaatgaatgaactcttcttcgtgtaaatgggaacgtaccagcccttcgatcgcttttttgtcgatcgtcaatttgccatcttcccgtttcataacgaaagttcctcttgattttggatagaaaagaacgactagcaagatgataatagcaagaacggcaaatactacagctgcccagaaaatatattgttgcatgtagtaattcgttaaggtaaagaagcgaaatcgttccaattgttcaggcataatatacggcgcattgattaacgcaattgctagaaacactgaaagtagcagcaaactcatgataacaccgattatttttaaccccttattcattttccacctcctataaacttatttttaccctgtaaataactctaccgacaatcacagtatagagagcaaatagttagtttagcaccaataaataaagcgctaccaaatgatattggatcataacggcgttttattgtcattctgatactgaaataacaactaatcacttattctctatttctttttgattgctggctatacttaaaggatattattcaagattaaaaattgcaaagattatgctcagttattattacaaaattctatttatttattaaaattttccagtgaagaaaaaaacgcaataaaataacttaagttactttattgcgtttttactttatttttctattatcatttttcttattttcttctttggtttatactattcttataaataaaaacgaggtatgtcctatgatgaaaagattgtattattcattgatcataacgattggctatttgattgtatcgaatcttggaaatatggtatttggtatcagtaaagaattcagctggactactacactatgggaatctttattctttttcatctttgtatttttgttacaaaactatcgaaaaaaataaaactgtgccaacgatctgttggcacagtttttaggacttacggtactttttattcggcaatccattttatttttacttatttttctacttctttttttaatgcctctggtacttttggttcataaactaaaccaatacaggtacttccgcttattacagccttttcggcaacgctgatagcaattgttgtgattgcatgtgagagactaaatttagtttgtgtgtgtttcatttgatgatcttcctttctttttttggaatgaatacaagtaagattgcggtcaacatacccagtaatatcatgactcttgaatcatctgctggaatcactgaaccgatcagcgtgaggcttattcctgttataactagcttgtttcttacgcttctccttttttgttggtcttgtgcgataaaggaactaatgattcctaaaaccatactaagaatagctgctccgatgaaatattcgtagcgtgtaagttccaaatggtaatgattagccaaaacaggtagcgccaccaataatcccatactatagagcgtgcaggccatgcttcggcttgcatgatatccttttgcgtatcttcgtacagcaataaaagacaaatgagtggtgatcacagcaagaatgctatgtaagaaaaacgctgatacgtaaataagcatgaacttgaaaagattaatgaacaggatcgctaatccatagttgacttttgcttcatccagttctgttaacccatatttctctccgagttttctgctcatcttgcttgacagcttctcttcaagagacagatattcatttggcatatcgttcacccctttctcacttttgattatactaaaaataaggatgcatatattaaaaagtcaaaagtgcgcgttttttttacataactgcagtgttatctttcttaataacccccttatattctttagatctaaaaatattctataaaaaaagaacgtgacattcgtcacgctcctttgctaaatgcaatcaataatttttttaaacttcgtgtggaaacaagacacttttctccgttagacataaggatcgttctttccttcttgttgatggaacaaatattatctacatttacaacaaacgattgatggcaacggtaagagctcgggctaaacgattcaatctctttgatttttccattatattctaacattcggttttcaagatgaacgatcactttgtgaggaacaggactggattcaaaaaacaagatttcgtctacgaacaattttgtatttattggtccactcttaatacgaatctgttctcttgtaggtaaaattgtatcaagatatctttggttagccacatcgatacattttgtcacgctttcttgcagcagtgtatcgttccccttcgcaatataatccattgcttctactttatacaaaaaagtgagataagctaaatctgtgtaactggtcacaaaaataatttttgctagtggatcgtattctctaatcgtagcggctagattgattccattcatattggaacttaagtcaatatctaaaaaatagatgccttctgttttatttgaacgtatatatgaaagcagcacttcagggtccgaggtatccatttgaaatttgatgtcataatcttgcatcattaaataattttggatcatctttgttaattttaatctaaatgttccgtcatcttcgcaaacaaaaattttcaacataaagattctacccctcccaaattgtcagtatttgaataaactgtccttcttcgattttagtatctaagtacacatttttattcacctgcactaattcatcaagattgcttagaccaatcccacgttctttcccttttgatgaataagattttttctttaatacatgtaaatcaggtatatcagaacgacatttattggcaataataaaggttatcgcttcttcttgtctcaatccggcaaacaagattttcggcttatctataatagaagattcttcaactgcattatctagaatgatccccagcatccgtactagcatgatagaaggaacggagaaagaatccaatttttgtggcacatttacgtctatttctattcctttttcatgagctagatacaacttgctcaacacaatgctttttatttccttgacttcaagatttcttatcggtgacatttctaataattcctgatcaaaaagagttccagtttccttgatatgggagtaaaaaaaatgtttcatcccatctatatcattactttggatgtaattttccatagaaaccagtatgtttttgtagtcgtgcttgaacttgcgtatttccatataacttttttcgatttgctcactatattcgataagatattccattcgattcttttcttctttacttttatattctgccttttttatataaacagctaaaaagctgataagaatagcaaaaaggctatatgccagcataaaaatcccatgagcacccttcatgaaacagtataaatctgaaaagcgttcaatcataagaaaaatgaaataaatcaaaaacgtagcaataacagtatacttactaatatcatataccatcgattcaaggggtactttttttaatatatgattccttaaataaaatgcgaaacataaatataaaataattgataaaaaacatatacccaaatcatgcatcattatagataatgattttaagataacgtaaatcagataattagaaaaaataagtaagataatagataacgaagcatagaataaagctgattgaagcgtctcttcatgataaatcacgagagcacacatgactagccataccaaaccagtggcaattacatttatccattgataaagcaccgatattaataggataactaagattgataataaagcatactttttatttcttagtttcttgttcaaatagcccaatccaacaaacatcgtcatcagctgccctgatatgagtagagaataacttaactgtaaaatattcaattttagaacctcactttatgcatgttttacataacaaaataaacagcaattatgaataaaaaaatttattttttaagtttttccccataaaaattgtaacatagtttactaactatttgtaaataacatatttaaaagtttccttataaatcaaaaagaatcaaaggttaacttcaattaaaactctcaaatactataaaaccacatttgctaaaaaaggcaaaattttattgtttttcgataaaaattaattgcttttcaataattatcctgctatattttagctatcaaagataaaagagggataaaaatgaaattaaaaacattattattaaagtttgttgttttaggtataagtgccgtatttattttattcggtatacttttttatactcagattgctacaagcgaaaaaggattcacttttgattggcagacgactttattcgtttctgtcatctacttcgcccttctcttagggattattattgcttatttcttattgagactgttgaaacaaatcgaagaaaaccaggccttttccaatcaaagcttggacattctcaaaaaaatcgaacgaacgattttgattattggcttcgcctttttcggcttgcttcctaaatttttgaaagtggctgatttagatgatgctcctggtttgatgttggtaggaattgctgtcgtattcattccttttgccgtatatactttgacaagcgtgttggaaaatctgctcgaacacgcgattttacttaagacagatcatgatttgacagtgtgaggtgcgacatggctattatcgttaatctagatgtagtattggctcaaaaaaagatgagtgtaacagaattgagtgaaaaagtgggtattacgatggcaaatatctctattctaaaaaccggaaaagcaaaagctatccgtttttctaccctcgaaaaaatctgtgaagtattagagtgtcaaccgggggatttattaagttaccaaaaagaccccgatcctataccaaaaaaaggaatataaaacataacaatcagtaaaaaaataatctgaataatagatgtacgagaactttagcggtcattacatctattactcagatattttattttgatggaatatcctgttgtctatagatacgtatttacacgtagagagacttttcttctactacttggtacttctcctgataaaaatggagaagattttggatctcacgttgatttggaaatagagaaataccgaagaccggaatgtttgtctcatcatcaatcattacatttgtaataatacagtcgatatctagatgatatgatttcttttctttctgattaaagtttggcatgacactaaattgataatagtctcccaattttttttgcaatctttttgctatgtaatccgcctgtttttttcttgtatttatgactatcactgcttttaatttattttctttcccttcaatgtatgatagcaataacggccagtcgaaaagaatttctaagatagcatggcgaacaaatgaatcgagttcagggatgacgtatcctttttctctgcagtcatcaaccatcctgcccttcagttcttcatataaacaggctaaaatcggcggatcgactatcgttgtcttgcttggatcatttaggatatattctggaaatcgtggttgtgtcagtatctctttacatcgttgaacgatcagatctttgttctcacattccaactgatattttttttccaagcaatccatccatgtcattaaacaattactgatacaaaaatgatactttctttgctcgcttgcatttcttattttcaaagcagtatggatgacttctgtatcaaatatccactgccagattttttcttcccatggcaaagaaaaatggctcaagtgatttttctccaagaatgaaaaggtgaaacagctgattttcttttgctccatttccattttatttttgttgaatcgttgtatacgacatgcaataaaaaaatgtaaaaaacataaggttttcggatcattttttgctacctcatacagctgattttcttttaaaaataggataaccacgtcataaattgcttcgctaaaagaacgattaaaaatactagcaggagaaggatacttttccatcagcaaacgagctgtaagaccctcgatcacctgaccctctccgacaatccgagtcaaccctttgatcctcaaatcgtatttttttaattttgattgggttttctttacgattcttcgcaatgtactttctgaaataaacagatactctgctaattctaaataattctcttttggatgtagcagtatggtttctaaatatttatattcagtagattgggagatcacgatctgataaatatgatcttttgtgaaagcaggtgaaaatatagctgtcacaccagcatcccgatcagtgacgatttggatatcggaagaatatgtattgatttctataaaatcgttccgcaatgtttttccagaacttgccaatcttttttccaattgactaagacggcaacgttcctcctcgaatagtatttctaacagattcaactgacgttgtaatttttttgagagaagattcaacatgtttccatccctttctaacaaaatccttttgatacatcctgatagataaatgtaaaagcactcaatgtcggtttcccttattgagtgcctttaattatattatatcgtttatctgttttaggaataggaactttgagaactattttttcttacttaagcaaaaaacggttattgattttcaactttctcttttgcttttcttctcataacaatcgtccctatgcctgctactaacgcgataccaatcaacgtccatgcagtattcctagttgcattggtttgtggcatattcagtgaagattcattatctgcacttgttgttggatcatcttggatgcttggtgtcgttccttcatttcgttccgtactgccgcttgttccatcattattcgtgttattattttgtgattcattcgtactggattccgtcgtgtgatcacgtacttcatacggcatattcaattctgttgaaaaaccgccataagaactgtcagtcgtcacgttgactgcgacattgttccgaccaggagtcgatgtgtcgatttcagaatttaaagagactgtataaagattttctggaatgaccttgtcatttacttttacatttttgataaatgatttaagatcgagatccgttgcacctcgtgggatttctactttattagcttctacatcaattttcccgcttggttcgaacccatattctgtgacttcataataagcatattgagaaccgtaagtgaagttcttctcctgctcatcttccatcaacatatttcgtctaaactctttcgtatgatagatcctgacaatgtctcctacgttgacattcaatggctgtccactattgaatcgagacaatgcttgttcgatcgttcggtttcctgttacatcatatgtgaatctgctagtggtattatctttgttcatcacatcgaattgataataaatcgagcgatcggaataatcatgcactactttggacaactctgtatttgccacaccttgagatgctcggatcatcatttgagtattctgattgttcggatttgtctgtttaattagactgaatgcgccaatcgttgcgccgtcattgtttttgactcggatcgtacttccccatttcactacataagggatcttcacttctgtgaacccagtaccatcagtcgtgcttactctcacacgaacccctttttctcccactgttgtcgtatcgaagttagacaattgttccaccgtataaagatcactcgttagcggacgtccgttgaatgtcacattttggatcaattctgccggattcactgtattcgtctcatgtcctaacagcagttcttgtgaaatcggatcagccttgatatctgtaaatggctcgaatccttcttccgttactctgtaataggcataattagaaccacctgtgtaatctctgaccatttcatccatcatcagaagatttcttccttgtgtctccgcgtgatagactttgatggtatctcctacattgactgctaacggctgcccgttgttgaagccgtttactgcttgacggatcaaggtattccctgttatttcatagttgtattttcgcgtgtcattttctagcacttcgatggcataatagattcctctgccgaacggattgttcactggacgattcaagtccgtgttgcttgaaccaggagaagcatggattgctaactgatcgccttcttttaataaactaaacgcgccgacggtcatttcttccagtcctcgaagaacgaatgtacttccccactgtacttcataaggcacttcgatttcggtttcagctaacccatcattcatcgtaatctttacttttgtcgttcgttttccagttgtacttgtgtcaatctctgacacttgttcgatcgtgtaacgatcttctgagatactttgatgattgatcgtgacatctttgactagttctttgacatctaatgtgctgacgtcctccctcaaagagaatgtttgcgaagtcccttctgcttccatcactggaatcggttctagtccgaatgcagtcactctgtaataagcatattcggaatcataagtgaaatcccgttcttcttcatcgatcatgacaactgagctgttcggtgatctctgtgggtgatagatcttgattacatcatccaatcgtacatcatagtaaccattcccgttcccaaagttattgatcacttgccgcagagttcctctaccaagtacctcataattgtagattgactgattgtttctcaggacttccaaagaataatacaaggcgtgcatcgattcttccgtaccgacccgttcatctaatgctgaaggcaacccactggtaacggttaatctagctgcattcccacttcttagatgtaaggaataagctcctgctgagccaccttcgcttgacttgatcatgaatgtatctccccaaagataattgaccgatgtttcggctgttcctttgatcgtctccccagaaatcgggtgtttcgcttgtaccgtgatccgaatatcttgtttgccagcaatcgtattcgtcggctctgtcgattctgctgcgacgaattctaaatcctcgatcgcaactgattccccttcaaaagtggcttcttcgatataatttttaaacgtacttgccagtgacgcagaagtttctcctaatgtacgttcttccattggcttcaatttcagttggatcgccggatcagggagtacaggaagtggttcaaatccgaaagctgtgacacgataataggcgttatctgttccgtaagtgaagtcctgttcttcttcttctaccatcaagactgagcttcctgcactcttttgtggatggtgaatattgatgatatcgcccaactgtacatcaaggtatccatttccatttccgaatgtcgtgatcacttgctgtagagtagctctccccggcacctcatggtaataagcttgtcggtcatttcgtagcacctcaatagagtaatacaacgaatcttcaagaccaatccgttcatcgagaggagaatctaatcctcgagttgccacgattcgagcattattcccattcctcaactggaaagcgtatgctccagctgatcgtccatcatgggctttcaataagaacgtgtcgccccaacgaatattgactgttgtttcagctgttcctttgatcattcgacctgtaacagggtgtatcgtttgaacagtcagtttgagcgcctgttctcctacgatagaagaatctggctctgttgattcagcggcgacaaactctaagtcagctgtattaagcctttgcccttccatcgtcgcttcttggatatattcacggaatgaagaggaaagtgcaggataatttccaccgagatgtcgatcttctacatccttcaattttagttctaactctggttgaggaagaatatccatcgtgatcgaaccagtagcttcacgtccatcagcagccgttgcttttgcccgccacgttttcgtaccaactgagctcgtatcagcatcgagccactctaactgatgggtctgtccaagagggtctctcacttcaaagtagtcagcaggattagggattgcttcgctcacgtaaatggaatgcggaccagcctttccagtgatttgtagtgctctatcctgaaccgtgatcggcacagttacagtagtcgttctgccagaagtatcttcagttactttgattctagtattttgagtaccaattgtatcaattctaggtggagtttcccattctgtcttcagatcccatttgacattactccgatcaatcgtcacataatcagaaggatctggtaccgtatcgccttcccataaattatgtgtgccagatttggcttcgactccaagctctcccattgattttgctgcagagtggaaatttattaatctgtgttgtctatgagacgcattaggtccggaaagatacacttgaacacgtagctctatactttcattacctaagtttcgttcgtcgcctatcctagttaatcttatcttataggggtcgccccaattaaccgtcagcgccctaaatctccaattcccgctctttgtatctacaaaagcagaaaaatcatctgaagtagatccgattgctatacttgtgctagttatcccaagtgaagaaagtacattggaagaaaaacttggagaatcaatttctggtacattatgaacatccatatattcgtcatatgttagttctaaaaattccccacgcgtaaaggaatggtcatgatttgccatcgcttcattgaatctgtatacaaaatatcgttcataaaaatccattaattctgttaccacttcttccattgtccatctagtcaatcgtgtctctgggaacatataatcaacttggtttgtttcttttttttcttctattggtaatcgtggcaaggtagatgctcgtggtttattttcctctttctttgtttcttcctgttctttctcttcctgagggcgcaattgccttaatactggtaattcgatcgaatgtaaggcagaggcggcttctactacggtaccgcccatattccctagaaccagtcccaaagatagtgtactagttaatagcttttttatttttttcaatgaacgttttacctcctttatttttcctatacagatcaaaaacgatctgttttaaaccgtcagcaaagaaggtatgctattttctcttgttttaaacataaataaatagtgtaaaaatagttttgtctgtttctaacctccgtagcttttgctcaattgacacaagtctgatcgatcaaatagtattgattttgctaaacacctaacgatcatttgttgtgacaaacttgacggtcagcattgtacgtgaattgcttctgttccccttcttacgatctttgaatatgtagttctctccccaataatcgtaactgggtgtctcccactcctttctttttgtttttatgcgggagcaaactcccacatttatactgtaaaggggttctttctattatgtaatgccactttttaccatttaatatggagtttttgacagaatgtttcgaataacaacgatccactactcatttttctttttaacgttaatttgataataatgattatttatttaaaaatacattagataacatttgttacgacacgaaaaagcttcacaaacaaatgttgttattttaaaatgaggacgaattcacacaattaggagaaatagtatgccattcatcgtttacttttttctttcattactcgtgatctacattccattaccaacattctttctgctcgtcaatcgtctagctgagcaacatgatgcgattactgctcttacgaaactttgtttacttctatttgtttgtctagattactttacgagctattattggctaaaacagacaagagtaaaaaagagatattatttcttccttgtctttttcaatctctttgagtttctgatccattgctttttacttcatcagtatcatacgattcatttgtggatcatctgggtctttcaagtggtcgtactattttgtatgttcaccttccctctctcaagaaaatttagggagacattgttttattaaaaaaaggtggagaaagcttctctgtatcaataaagacacaattaaggaaaaactggtcaacatactggtttttctttaaaaaacttttaaaaatctaattgggaatttacccacacaaacaaggggctatgacaaaatcttgtcacagccccttatttcgaataaaaagcttgcatcttcgataataagcccaaccaaacgaaaaatatgaaaagctatttttgtttggttgttcttattacttgatgcagaacagctttttcacgacctttttattaaaagtctttttacagttttctagcaaaaaatgagacaatcagtactaaaatgatggcaccaatcaatgatggtacgattgccattcctgcaatacttggtccccaagaacctaataatgcttggccaagtgctgatccaactaaacctgctacgacatttgcaataatccccatagaagaacctttattcgtgattgctcctgcaattgctccgataattcctccgacgataagtgaccaaataaatcccatgtttcgttcctcctaatgttttgcttccttattactgaacgcgtggctctgtattttcttttactttttcaacgccgcttccagctgctgattttactttatctgtttgattagaagcaaattcaccggtttttttcgctgcgtcagttactttgtcttgcactgtttcttgatctttttcaaattcttcttttgttttgatgtccactacgttagcgttaacttcgatgacgtctaagtgtgtcatattttttacttctttgccgattacttcttgcatttcttcaaagattttttcgatatctttgccatattccacaatgatatccatgtcaactgctacttgttttttaccgacttctgtttcgatcccagccgttacattatctgtattcacaagttttcctgccacattagagaagaaaccaccgtttgcagataataaaccgtctacttgttcaattgcgattccaatgattttttgcaccactttgtcttcataattcaactcaccgcgcatcgaatcttcctgctcagagccatggttttcttggtcatttgtatgttgtgaaccaaatttttcttgtccatttgagtgttcagaaccaagtttttcttgtgctttcgcatgatcagaagggtgcttttgttcctctaatggtttagaaggatcgattgcatcatgttgttctggaactttagattctggagagccgggatgatgaggcgcatgtttttctgcgtcatgtttcttttcttctacaccttgttgaacatttggcacgactggatctggatgtgcagatactggtgcggttttgttcttttcatcgttcacaccatttgattggtttggtgtcgttgggtctggatgtgcagacactggtttttggttgttcattttattgttattattatttttgttattgttattcatggatgtttcctcctaagatttaaaatagtgatctaagattttcgtttgtttcaaataaaaaccgatagcgacaccgatagcggccatgatcaagatcaataaagtcttgaaaaagccgacggttatccataaaacggctaatatcaacccaagtaccccaaagatgatagggagcttgtatgtcgaaaatagttctttcattttggtcccccctattctactcgtttgcggtcattactttgtttagcgggttcttcaaagcctgtgtatttcacggatactttcactgactcttttgtgcctaatatgtgttgtacttcgttttcgatttctttcatcaatgttcccgttttaccaatgagtgctgaagttcgtttcaactccccttttacattgacggcgatcttgtttttcgttgctttgacatttacttttggtgaatggataaattcatcttcatgcaagtgagaacgaaccattccttcgattgcttttttatccaacgtcaactccccatcaccatgtttcagtaaaaaggttccgatcgtttttggataaaacaagaaaacaagcaacgtgataatcgtcaaaatagcaaatgcaacagcaagccagaatacatattgttgcacatatgaattagtgatggaaaagaatcgaaacttctctaattgaaaaggcagtggataggctgcacttaatagtatcgcaaacaaaagtatagatagcaaaagtaacgttccgatcactccaagcgtttttactcctttattcattttcgcacctcctcataggggtgaaacgatcaactttttataagttgatcgcttctccaccagttactccgtagatttgagctgtgacataacttgctttattcgatgctaagaagacatagaccggtgctaattctcctggctgacctgcacgttctagtaaactttgctgaccaaattcaggaattgaatcagaaggctgaccttcgtctagttgtagcggtgtccagattggaccaggggctacgccatttacacggattcccttaggagcaagttgttttgctaagccaatcgtaaagttagcgattgaagcttttgttgctgcataatccaataaatgttcacttggattgaaggcttggacagatgttgttgtaacaatcgctcctcctgctgggatatgcggaactgcttctttcactaaagcaaacatagcgatgatgttgaccatgaatgtgtctttgatttgttcaagtggcagttcaacaatggactggcaagaaatttgctgtcctgcattcaataccatcgtatctagcccaccaagctcacttactgctttttcaatgatttctttaggtgcttgttcatcacgaagatcaaatggtagtaagacgattttacgtcctgcatctttgacgtatttagctacttcttctgcatctttttcttctcctgggaagaattgaagagcgatgtctgcaccttctctagcaaatgcaatcgctgctgcacgaccgatccctgaatcgccaccagtgatgagtacacgtcggttttccagctgattactgccctcataggattcttctccgcaatcaggaacaggaatcatgttctgttgtaaagctggcgtatcctgatcttgcttaggaaatttctccgtatggtacagatttcgcggatcgattaattttggttctgtcattgctgtattcctcctagtttttctaaattgtattgccaaaacaaatttctttgtttgatacctgttttaaatagtttgtttaattcgtataatcttttcgatatagatggtagcctaaaaccgccgctgctatcaaagagccgaatactacgaggataaatcctaaagcagagcttttacccggcaaccctcctgtattcattccccaaatccctgcaaacaacgccggaacggagatgattagtgcagctgaatctagatatttcataatgtggtttagattattgtccatcatcccattgaataaatcaccaatactctccaataagtctcgatagatctcgatcattttttctgtttggcgctgcctcaaatggacatcataaagcaattgttcatcgtctaaacgtttgataaacgtttcagaattccgtaattgatccatcgttttccgctgatctcttaaggtatgatcgatatacacaatgtctctttcaagatctgcctgtttatacagttcctcattctccgtcgttttacgagctgctttatccaaagcgtcaattctatgcttcatttctcttagttctttcacgtaatgggtataaatatccagtaatgtatacgtgatgatcttttcaaacgagtttaaatgatctccatgctttgtcagcaagcgatccacgaactcggtctttctatcaatacatgtaatcaagagattttcggaaattacaaaagatatcggtgtcaattttttttcgatacgattatctgactgatccagattgatcacaaccaaagaaaatggatgcgctaatttggtctcataaaggcgctccatccgagaaacttcttccggatattccgtgcctacgaaaatatcatctggaagctcgaattctttgattgcctgctgaatctcttctggctttgtattatcgagaataagccaattgtatttgttttcatctgtttctgtgactttcttttcatcatccacaaagtagtatctcaatgtatacctcctttctggacttttcaaaaacgattagctgaagaagcagttctttaatttgatattataatcgagtactgcactttcattttctaatgagaagctgtcaagctgtttattaaagtccatgtttagtcgtttaccgaaataactttgttctactttagatgtatagatctccagtaaaggatgctcgatttttgttgcatactctccaaattccgaaacaaaaggaatgatttggaaaaagctgccttttgcaaaagcacctttatcccttaaaaatggatcggaatcattgatgagagcgagtgcaatttttgtattttcccccactttttcgattaacgtctctactgcatttttagacagtgtaatttccattcctactccccctgttcagttgtagtcttgtattatttaacaactacgtctgttttttgttgaatttttgcatattttggatatttagggaatttagccacacaacggaacgccgtcatccctgcatatttttcgtaatatttcttcgttggtccttcaaaatccttgctccaaggtttcacatgtcctgagaaatggataatgtaaggattgttgcgtgtttcttcgtattcacgttcacctgctgctgttggatgtttctttgctttagccatgatatagccttgtgcattccaacgcggatgaagcggaagccaacgatcatgtaagattgcatttaatgcatcttggtcatggaaccttaatttttctggattatgttcgatgaagtctaatactttttgcgtaatattttcatctaaccatttttttacattgatcagcatcaatcctgagttgaagtaacgcattgatttagctggaatctccattttttctaatcgttgatggaacccagcgtcttcaacagctgctacgattgaatcaccgaagtcaagacgccataatttagagatatcttgtaaagcaatcatgtcgcaatccatatataagatacgttcaacttccgtgccgcggaacaattccggaatcgctatgcggtaataagctgtttctggaatacgatcgctgattactacatttgtaaagaattctttattgattttcaaaaattctacatctgaattcattcgtgcatttttcactgagaaacgtaaaagctgtttgctttcaaaatcgatatcgtcgtcaatcacatagaaccgaacaaatttagacgggttgcaattatctaatactgagacaaataacgcagctaaatgcggtacgaattttgtgttacaacttgcgactactgctatttcttttttattcattgatctcgcctactttcgttagagtactgtgtgctaatttttttaagtataaattggtatacggatgatctttcaacgtattccaaggtttatcatgtcctgtaaaatgaacgattgaaggtttttcatttccttctttatacagacgttcatatttttcatttggtgctgggtgtcgttcaaaaatcaaagaagtctgcatgttccattttggatgaagttgttcccaatcttcataaaggacagcattcaaagcatcttgatcgtgataaatgattcgatcaccattttcacttaaataatggatagttttttctgtaatttcttttttattccattgatcgatgtcaatcaccatcacccctgaattgaagtacaagtcatcggaatctattcctaatcttcccaatgctttcacttgtcctggatcgataatggcgccgatcgtttttccatttaatggttcatcatatagttttacgatatcgtctagcactaacacatctgaatctaagtaaaggactttcttataatcctctttagctaataagttgggtaaagaaattcttaagtaagcggtagttgtgatatggtcgctgactaggaagtcttcgtagatatctttttccactgtcaggaattggatacttgcattacttgaatatttatttaccgtttcttccaatccttgtttactatattctgatagaccatcgtcaatcacataaaattttatgcgtcttgctttattgcaattttctaatgcagttgcgatcatcacgctcaagtaaggagcataattttcgtctgaagcagtcaccacaggaactacgccgtatctcttctccatcaaaatcactcctttttctaatctttttctaacctgttctacatctagaatattcctcatttggctttaaagcaaaatatatgctttgttttcattgaatattttaaaatttttttattacaaaacgcattggtaagcgctaactattcgtttttcatggctttttattcaaaggtattgaccaaaaactactatatatagccacctttttcttaagaatgttttttgaaaaaattcataacggcaaagcaagttagtttcatttttttaatttctcatttaatcttaaggtaacaagaaaatagatatgtaaaaagaaagtaggaagataaaatgaaactagcagcgattgatttagacggtaccttgcttgatcgaaatggaaagataccagaagaaaatatccaggcacttcggaaatttgatgaaaatggcggaatcgtaacagtagctacaggaaggaacagcatttctgctaaagatattttttccgaattagggatcggcggctatttgatttcttccaatggttcgctgattgctgaaatgaaggatggaaagatggcaaaggttctcagacgttcgaaaatagatatcgatactctgaaaaaagccttcttctatgctcaagaagcaaaaatctcaattattgccagccgagaaacccaagatgatcagctgacattcgatgagtcaaatcttgtcaaagacgacccctattatgaacatttcaatctgcagaatcattcttttgatcaaattttaagtatgttagaagatccttctcttagctatcttaaattagcgttaacagataagagtgaagaaaaactacagaagttacaaagagatctgcaagcagacggcatcaattcagtattctctgatccgcatttcttagaaatcacgcctacaggtatcactaaagctcattcacttgtttttctggcggattaccttggaatcgagtcgagtgatatcatggcttttggcgatcaagaaaacgacattgctatgttgaattatagtgggttgagtattgcgatggggaatgcacagcggcaagtaaaagaaattgcaaaccaagtaacactgacgaatgaggaagctggggttgcttatattttaaaaaacttctattgaaaataaaaaaatgacgtcatgaacgcaggaggaaagaaaatgttagttattatcgatatgcaaaatcatattcttgatccaaatagcgaattttatattccagaatcagaccaattggcggaacgcattgctaaacgattagctaaagcacgcaaaaacaaggaatatattctattcacacgggatattccagtcgaactgaaggacaaagaagaggaacgggaagatttgcaattgatccctcttctttctccccaaggaaatgaacgagtgatcaaaaagtattactttacgatcccccctgaaactttagctgaaatcaaggagactttgtttgaaagcaaagaagaacaaaaagagatcgaagtggttgggatcgaaacaaacttatgtgtgctctctaatttgataggcttgcagagtgcgtttcctgaagctgacttttttgttgatccaacgttagtttctagtagaaaacatggagaatctgcgttggaacttctgaaagatttcaatgtttcgatcattgaacctaaaaaatagacagtcacacgtatgctacagtctattctttatataagttctattatcatttagcaagcaaataaaaaagaaaaagcacgaagaactgttttcagtcttacgtgctttttctacaaaagtatattggcttttccatgacaccttggtaaacagtgttctcctgccaactcctcagtcacaagtcacaatattcaacaaacatgggaagctgttttttgaaattgctccttgtgactcagagttaaacggtaggctcacgacctctttcttaaatggtgttcaatcagctgactctcggtattagcttaacaaacggcaaaatatgaggaactatttttccgtttgtttctctaatactcaggtcaaaacgctgatttcacaacctcttccttaaacggtgttcaaaagcttgcatctgcggtaataagtccaaccaagttaaaaacataagaagctgtttttacttggctgttcttattagttgatgcagggcagctttttcacaacctcttatgtaccttgtaggactcgaacctacgaccggacggttatgagccgtctgctctaaccaactgagctaaaggtacatcatcatgagatatattttagttactttttaactatagcacgaattatagacgctcacaagcttcaaaatataaataatatgatatatttattcttatttacttgacttgaaacttgactattttttacttgcttattttagaagaaatgctattcttttaaaaattctcaatgataggagtgattattttgccatttattgcgattttattcgatttggttgcggcagcagcttactttctccaatacaatcatcaaagttcagaagtcctgtttgttggaatgattttccaaggtgtgatcacccttctccttctcatcatgataatcagctacaaaggaaaaaaatatgcacgtgtccagacagaaatatttgttaaatatgtttctattcgttacgggatcatcattctttcctttttaatgaatgcaatcgtcctctttttatatgtattgaattacttaaatatcaatccattgattttttctagatagataacttgtatttagcggaacagttctcgcgtatgagcagagagctgttccgctttttcatcggtctattcttctttgattttcctagcatttcatttgtgatgtatgcaataacatgttatcttttattagaagaaacgttgaggagtccgttacatgattacgttggttagagttttattttggttgccttcggtcgtcctgatcgcaattattttttatcttatgcattggaacaaagaacggctttatttagctgttttgactcttccggttatttattttatgtggaaggtttttaattacaactactttgaacctgatagtgtttttgtagaagaattatcagggttggttttgtctctattaatcgtcattctttatttgatacgtttaaataaaaaacattgagtcctattgattgcttgtgtagctttctatggtcattacaactatcctattatgatgaaaggtgattaaatgagtatcgaagaagctattttactggatactttacgttgtcgtctgaattttttaagaactggccgatctttatcccaagtagctgtttctagcgcgttaagtattcctttattcaaatatcgtaaatacgaacaaggggaagaaattccaagtatcattgaattgatctacatcgccgacttttacgatatttccgttgactacctgattggtcgctcagaaacagcaagcaaactgaaatgattttttccagccattgtgctggttttttcatttaatgtttaaagtgaacaaactatgtacaaaaaggagatgtatctatgcgtttatggcatgaaaaattgatttcaaagcttcctcgtcagcagcttttaggacaacatcgagaatgctgtgcgttaagaggaaatggttggggaaagaaacacgctactgtagattatgtcttccactattctccttataaattatttcaatatcatcaacttgtcatggacgaaatggaaaagcgtggctacagcccagcaccagaatggacagatcctatgtaccgtggcaaatcatgcgaagcattttttgatttgcctactgtagaacgtagcgttccgatttatccggaacatgatgaagtgtatctagcagagtgtttagcaaatttggagcaaaaaggaatttatcttacctaaaaaagaggctgggatagaagcgtttaactccaagaaataagaggtaattcacgaaaattgcttttcaaatctttgtgaatttcagcttatttccgaaggagttgcttctgcttccgccgtttacacatgtttagagcgtgagacaaaagtttttctttacttttgtcccacgctctaatataacatgaaaaactcttctactctttactcatcgaaaaagtcttaaccaacgtagggtaagctcgaatggtgcaagttgattctcaggttaccttcgtcatcacgtataaatccgaaagtatattctacttttgtttcatcacccgttttcccagaagtaaagtaatattctcctgatgcgattgctgaatccgtatcgatgatcgtttcatgattgtcgaagcggatgtctgtccaaggttctaacgcaaaaccagaatcttcgctgatatcaccgccaacgaaataagaaagtgcttcttcttttgttgccctgaatggtaactctgcagctttagttggtttaaaaagcacagcaccttcgtcgtatgcatacaatgtctcgatgacttcttctgctttttctgttgcttcctccataccttcttcgcttgctttaccgatacttatgattgcttctgcccagcgttcccgtgcttcgtcgacttcggcttctgtgatcgtctcaacttttacctcttctgtcgtgtcttcagttgtttctgttgttgattcagttgccgaatcggttgtagaacaacctgccattgctagtgttaatgttgatagtaaaaatagtttttttatcataagattatcccccctgaaaacagactaaaataataacatttcgtttttttattttcagttaaagcttaataatttctaaatgttcttaaattttatttaaaaactcttataactttcataatacacaacatagttatttttaaataaaaaaataagctcaatacatttaaaataaaagacataattaaaattaatcaaataaatatcgttatctaaaaacaaaaaaatccttttaaaatcttactactattaggctttttcgttttaattttctttaaataattatgcaaaagtaatagtttatctgtttttttattgttttaataatcgatacaccactttatgtaaaatacttctcgaaaatacctattgacaaacaaacacagctatgaaatgaaaaagcaaaggacgaagcaaaaaagcaccaagaaaaacatccttccgcctattcaacgatcaatgaatttcttcgtacaaaaaaaaccgtcttttcgaaagaaaagacggttaaaagtcaatttttattaagctttaacaatgtttattgcttgagggccacgttgaccatcttcaacatcgtaagacactgcttggccttcttctaaagttttgaaaccgtcgccttggatagctgagaaatgtgcaaatacatcatttccatcttcaccagtgatgaagccaaaacctttgtctgcgttgaaccattttactgtaccgttattcataaataaattcctcctgatacgtatcaatgtacgttttttcgttgcaataaatatttgataggcaaaaggagttttatctatgtagatatatcgctcaaattacgtttcaaaatagattacttatttaatatatcatgctttttctaataacacaagaataatgcaataaaatataaaacttattgtcttcgaatcgataaaaaagttggataaccgcgtttgagccgcctattgttctccatttatttgtttttatctactagcatttgtttaagttgtctgtttgcttcagagatttgtttcttttgatatagtattccttgtgaatccatcatgaatcgtttactaatattttctagcattctctctatgcctggtatggcttcttctggcgctgctccttggacgatccatagtactggtaactggtgcaatggcgcgttttctgaatcaagtccgatttggaataattctgtccaacggtcaataaacgttttaagcagtccactaatatcccaccaataaatcggtgtaccaataactacgtagttcgccttcgccaatctatccatgacggcatcaaaatcatcattagctttgacttgacctaattgagcaatatgaaaatctacaagatcgatcctctcataatctattccttctagaactttcgctccccacttactagtcataccttctttgtttggacttgcatttataaatatagttgtcattgtgttccctccccactttattttacaacatgattgctaaattttgactttaaactttcttaactatgaaaacctttcaattggtgatatacttatatatggaatttcgttatcaacgtgttcgttgcctttcagcaagtatttaaagaaaggagaatggctatgacattctataacaaagatatacaatatcgagtaaccttggatacagatttgaatctctttgtcgtttttgacaaagaaaatagcaatcatgtagcaacaggtgttacgatcgaacaagcagtgcaagaattaaaaaaatctgcataaggagtggaaaccctcatatggacgattctcgttcttctctttaaacgcatctactggatgataacagtaggtgcgttttgtgttttcaataacttcttctcatctgacaaccctccatctaattgacgattgtattcgactaactcaatcaactaaatcttttttaaaaaaaggaagaatcctactataacagaaaaagtaaaaaatccattaaaacctaaaaagccattaccaaatatttggtagtggcttttcgggttctgtaagggtggtacagaacatcaatagtcggtgggttagaacgtatgttatcacatctttggagaaggttgtattggtattattcgagtgacttattagatgcgataacaaggatagtatacagtagggaaaaaatttattttttcttttttttattagttttgtttcttattttctaaaaaataaaaataaatatttgatgaattaagcattctccggataaaactggctttcgaatacatattaggttatcgtttgtaattttatttcacagttgttatgattgttatgtaaaataaaaaagtttaggatacatcgaatttttggggaaattcttttttgggggtgtcctaaaccttttctattattttctcatatttcccattattggtctagacatatactaatgactttctatctatatgatggatgaatcctttttcatttatcatgagataactttgctccaaacttacttatgatagatggatggtattttttgttcacgttctaacaaacttgacacatttatgaattcttaatctatctatcctataattataaaaaaaggaggtgctgcgtatgaaagctattcatatttctttgctttttttcgctagtgcattgattttatttgctattcatctttgctcccagccttatatcaataacaacggaatattagtagaaccagcattcttttgcttaccgctcggtcttttatccctttttgcctccgctggattcggatttgttgccttttttaaacgatcgaaacaacaaatctgactataaaatttacgtaaaagagaccgtaaaaaaaacatatcacctttccttattccgaataaatattttccataaacaatcttttgacaataggctggacgtctctttcgcgagaactgatacacggtacctacaagctcttcagtcaccagtcccactattcatcaaacctgagaagctgcttagttccttctgactcggaactaagcagtttcttcacatcctcttttacatcatgagcgtttattccttgaaaaatgctactaatttttggtatgtttcttgcgcttgtttattactaaaatcaaactgatattcatggttcaagacaacatttttcttcgtatagtctacttttgtgactttcactcctactttttcaaatgcagaagctgtttgttccatttgtttcgtaaacgtatttgtgttcccatccgtcaagaatgttttttgcgtccaacggtctgcatgtcttgctaaagctaaatgtttgacgtcttctaaacgttcaaagttcttactatcaaaataagcccatccacattttgcataaagaaagctagaaatcttatcacttacttgggtaaatgcagaagggtctagtagtccagacaaagaaacaaattttgtgatctgcttgttctccaaagttggatcaagttgatcggcttttttgatttcttcgttttgaagtgctaacaaatactctccgctaatttgtgcgcctgctgaatcgccaccaatcgaaatattcgaccaatccgcttgctcttttatctcttttttggctgcttgaatggcttcgttcaattggataactggtgtaggatgctttgcttcaggtgatcgttcataatcgatatttacgacgatctgctgcgtgtctgaacataggtattccaaataatcacgacaatcgtttttatcccctcctacatatgcgcctccatgcatccagaaaaggatgggcaactttttcttctccgttttcggtgtgtagatatccatatgattgtttttgtactttgaaggataagttatttctttatttctatcgatttgtttgattttttgctggaaatcgtctggtctggcatatacttgttctttttcacttgtgtcaaattgttttctaacaagcaaactaatcggctttggtgtgatttgattaatcaaaaatacagtgactaaaataactacgatgataactggcactgcaatcactattcgcttgaaccatttcattcatttaccctctctttcttcgccaaatccatgtgataatcgtgctagcagataaaaatccacctgaataaatgagaagcgaatgtttcttttccccagttttcggcaacattcctttttttgtatctgtctttttttgtactttcactgtcatctgaatcggtagcgtatcatcacttgattgatcatctcgaggttcatcctttcccttattgtctgcattctctgccggatcttgtttttttggtggaactactgggatttttttgtaatggtgaataatagttggtgccgtctcgttaaaaaccccttcagtcggtccttcaacatttgctaattcgtatccttcgaatgtcttttgctctgtcacataattctctccataagctccgtaaagccagatttcgtcctggtctttgagtagacttttattgttttcatccacatatttcacgtttatctgatcatggaacactactttcaaaaagtccgttacatgtttcgtgtaggcagcatggtcaacttcctgtgcctttccatgccctgctccttctaccaataaaaggtctttataccctcctgctaactcatatagtttttgcacgttagacacaggtactacatcatctgccgttccatggatgatcaatttaggcaatgaaccagacattccaatcgtaggtagagcggctgtcggatccaaatgcatctcctgatcaaaataatattgtttcaaaagccccataaacaaatcttcatgctcttgatccccaatgatgtctaactgattttttatggcagacggtaatgcagggactactgtctggctatacgtaaaacgtagttgttcatcgattgatgcaaatccgcaattttcaataattcctttgacattgactgggatatcttttgctaatacagacatcatcgtagctgctcccatggaaccaccatacagcaggatcttttgagatggacgttctcgaacttcttgattgatccagtaaaggacatcatctgattcatattgtccataggttacataatcgcctccactgttaccagttgctctggaatcaacaaataataaattataccctgccttataaaaatcattgtattcttctgtaacgatcccattattccaattccctctaaatccgccatggatcatgactgttttatctgaaccctggtcgacatagtaagcatacacatccatcattttgccatcttgtttgtttagtacagtttgatgaagttgttttgtgtttggatagaagcctgtgttttctgtaggcgtcgtaccatcatctgtacctccaagcattgacatcaacacactatttttagaaaaagcgatatcatacaatagataagtagcaatcagatgtttgataatctctttgtctacaccataatccttaccaaaaagctcacttaatactaaacctattagtcgtgcgttaatttcatctactggtccattaagtatatctgtcatctgtttaccgaagtaattaagatatttcttaccattgaagttttcgcctttaccgatatcatcattttctgtcccattctctttgtcacttactttagcagaagaggatttgtcgtttggcgtttctgtagctgttgtttcatctgtttgttggttatctgtggtagcggtcgtttcttgatctgtgctagtaacagatgtctcagccgttgtttcagtacttgtttctgtttgtgaagtactcgatttcgtttcgtttctagcatcagttgtttccgtggtttcgacctccctagatcccgattcggaaaagatactctctccatatactgaccattgcgggacgtttgtacttacagcaaataagacgaccaacgctccctttaacacttgttttgttctcaatcgattcactcctttttatgattctaggagaattatatgtaaacgcaaacattttttatacaaaaaacaaacggtttatcccataaaaatagaacaggattattttctcaatttacgtaacaaagcagaatggatactggtttatccattctgcttttctttaaacaatgaaacagcttattgctccaaaaatgtcagaaatcgtttatcccaaatattctcgtaaaaagcgattgtttcctttgctttcataaaaggatgatcataagtcgtcgctgctcctctgcacatcataagctggtatcctaatccatgagcaaacttcacagtcgtatctatacaatactctgtttgcgccccacataattcgatcgaatgacagtccaattcagttaataacatactcaaattagtcttataaaatgaattcgcatgggtttttctcacaaaataactgtgttcaggaatagataattccgacaatagctcccatggttttgtttttggtactaattgatcatcttcgtgttgaacgaaaataactggctttccaatcgtttcgtatgctttgattcttttattcactaatgctgtcactgtttttaatccgtgtatcgtcgaagaatcaaaacatacccctttttgtaaatcgatcactacgaatgcgtcggctgtgtttgacatacgtatgccttctttcttgatttaatagtatttcttatctagttagttcctttatacgtgacaacaatttcttattttacacctataaatggcacttttcgactatttcttcatgttattatttcataaatatttagctattggaggaatgtatcatgattaaattatatataggttctagttgctcgtcttctagacgcgcaaaacgttggcttatcacacatgatataccgtttatcgaacagaacttaattcgtcaaccactaaccaaaaatgaatttatccacttactaaaattgacaaacaatggcgtgaccgaaatgctctctactcattctattagttataaaaatcttgttcacagaatagatgagctcagtttgagtgaactatatattgagattcgtacgtccccttctttattgaaaaaaccgattatctacgaccaacctgcaaaacttttgactggatttagcgaagataaaatcaggatgttccttcctaaaactaaaagaaaacaagagctcaacgaactcttgctttctggtcatcttgttgattttaaagaaaataatctttgcgttcctgttatttcctgtttctcaaatatgttagtaaacaaaaataaacctggcaaagctacaacttcgccaggcaatacagcactctcgaatgaaatattcactcaaaaatctatcgttttattcaattttaaatctgttgcttttattctttatttcactcgatggaagagagaacgaaaatagcttgctcctacaatcaaaatgagtaacacacccatccatgtaattagcttgtttatggttctactaccagtttctggtaaatcgctttttctcttatctgtttctttcgctttttcttgatgatcaattccacgagaaacaaaatcagactgttttagcacactttttaggttgctccctgcatttctcttttgttccttagttggtatgataggtaccaaatcaagttcattatttacttttcctgtgctgctttcgctacttgtgtttcctgtgctactttcactactcgtactatccgtactgctttcactgctcgtactctctgtactgctttcactgctcgtactatccgtactgctttcactgcttgtactctccgtattgctttcactgctcgtactctctgtactgctttcactactcgtactttctgtactgctttcactactcgtactatccgtactgctcgacggtccaacaactgtccaactacttggtttcaaattctccgtaatcgtcatctgtccatcataaaaaacaatcaaatcaactttatctttactcttgatctcatcaatcgatagttctgcagaaatcattattgtatactcaataccagcggtccattgtacgtcctttaaataaacttccccaataaccttttctgaacttccattaccatcccaaccatatgttagaacagcatgtatatcactagcattcacgcttttatttgttttgatcagaatagtaatgacttgttgtgtcacgtcataaacgatccgatcagttttcacagtaaatgaaagattttcatttgtccgttcatttgcagaagtactgattccaatcattgctgcaattatacttagcccaagaataacaaataatacggtcgctgttttcttcatttcaatcactctccatataattaccttctatttgataaaggaattatataaaatgaaaatgatgagaacacgacagtcagttgtgaaaatctaacaaaagatgtcgtgtattcgtttgaatctgtttactttttcgtttaatcaatgaaagacttaaaaaagcaagaccgatatcagccttgctttcttcatcttttattgataaacagcagtgtatttcttcatccgctttgttttatatgcatagagtaacaaaccaacaatcaagactaacaagaataatgtagtcgatatagacgcttcagccctaaagtttccccagtaattattgtgttttgcgattgaaccagagtggagaaaaaaccttgttcttgcgttccgctgactggtatacccaaaatagctccttgagtccaattccaagtaatgtgagcaccgatggccgtaaataaactttctgtactgtagataagtgcactgaaaaagcaacctgctaaaaagatattgaaaactgccagaaatgtcatgttaggattcactccgtgcaaaagagcaaataatgcagcagatccaatcattgctattaatggaccaaaactaagcagctggtgctgaaaaaagccacggaataaaagctcttcggataccccactgcaataaataaaataaaactcgtgatcagcggcacaatatttgcgtttcctgaatctaaccgatacgcccctatcaaatataatggactagtaataagcagaaacactccaattccaccaacgagacctcccgctaaatatccccagtcttttcctcgtccagaaataccataatcttccacttttttcccttctaccttactagcaagaaataaagctagtaaaaaaacaactaaatgtccaaccgtaccagcaattgctccaatccattcactgtctccaagaaacatatccgcaagtgcattattgacaagaattcctaaaacaaaaccaactaagactattaaaacagatccaatcaatcgaataatcctgatcatctttcatccctcctttatattaagtgtaataacccttttctttcttgtctcgtgaaaaatatctaaatgttctccatcatagagagaaaagatttttacgaactaagaatgtctacagcaaccttacgaaaatgaaagactgtctgcctggttcttctgttagactgtctttaataaggaaaggatgggaaattttttgaaaaaacaactactgattatgtgcctttcaggatttgctattttactattctcaggttgtagcaagtccaatgaaacaattgcaacgtttaaaggtggaacacttacagttcaggatttttatgataacccaaaagttaaatcaaacaatcaaacactattaagaaaaatgatcgtcttcaaagcgtttgatgatgtatacggaaaagagatttcttcaaaggaagtaacaaaagaatataatgagcaaatcaaaaaacttggtccaaactacaaggaacaattaaaagcagttggccaaacggaagagacatataagaaacttttgaaacagatgctggctttccagtacggtttgaaagccaatgtaaaattaacagataaagatctagacactgcttggaaagagttccatccagaagttagtacacagatcatcccattttcgactaaagaagaagcagataatgcaaaaaaagaagtaaatgaaggggaaaatttctccaagcttgttcaagcttatggaaaaaataaaacactaaaggaaactgatggaaaaatgaaatttgattcaaccaatccagggattcctactgaagtaaaaaaagcagcatttcaattaaacaacggggaagtttctgatatcattcctgtaacagatccaacgacttatcagcaaagctattatctagtaaaaatggtaaaaaaacaggataaaggtgccaataaagataaatacaaatcagagctagaaaaaatcgccacggaaacaaaaacccttgatacggaattcatggataaaacaatccataaagtgatgaaaaaagacaatgtaactattaaagatccttatgtaaaaaatatattcaaataaacaagtttgacccgattggggatgtggcaagcatgtttcggaaattacttcttatttcttaaagatgaacacttctgccacgacctcatgcgggttatttttttccataccaaaacaagtaactgaatttatcacaatcatatcaatataaaataaaaaagaagtttttttatttatgaacatgctatataaaaaaacctaagtcaacttgacgacctaggttcaaaaatggatataaagatgaataattacataaaatgaatatattatgtttataaatcactaggattgatttcatccgtttctacgattggaacggatgatttttttaacacttcaaatcgtttaacgtcattcaccccatacacttgatactcgattccagatttatttagtttattgattgtttcttctgtagcagcatcattagatactgagagcaacgcttttttataactttttacttgttcaatctcatcttcaagtttatttttttggtcatataaccaagatactgtgcagtcaggatgattctttacgacttcgtctcggatctttttatccgtcagtacaaaaaatgaacgttcatacacactattttgttttagcgtgtttacgatgtcattaacaaaatgttcatcctgccagtttccttttgaaccatccacgttgacaatcaagttattttttttgatttcctttacggcttcttcaaaagtaggtatcttaacttttttatttacgtattctggatagtttttcgtatctaaattaaacttctttagttgtttgatcgtgtatgtctctggtttccccgttccatctgttgttcgatccaatgtgtcatcatgcatcaaaaaattcacgccgtctctacttgtccgaacatcaatctcgactgcttggtagcctaatatttttgcttgatggatactctccaccgtattctcaggcgcaataatgtgtgcgccacgatgagccactaagtaagtaccttcatgttccaaccaattatttgctaatgaaacacatcctgttaataaaacagtgaatagcattactattccaatcttttttttcacttgccaaatcacctcaaaaacaagtatagcaaacttaaacctgtttaaaaagttattttaaaacgagctaaaaatatcccttatggactttttcttcttgttctgttatactaaagaaacacgaaagatatttttatgcgacacttttcatttgtttttatgaaatttattcaaaactggcgtaacttcagagttacaaggatgtattagaggttagggaatacatcgtttaaatgagaaataagtaatagttagtaatagtcaccgaaactttaaattaatgaatattgaatcgtcagatagccttctcgagttttcgagaaggctatcgtttattttatggataagtgagtccgcaagtcattcctcatccctcatcggagctcatcaagtatttctgactgtcaatgttgaaaatcagacgttttgtaagtctatttctttttttgattgaaggcattatctgcgatacctttacttgtttttcctctttttgcatcatttgctaaaatccctgagcgttatataagcaatgtttctctttttgatatataattattttatcatttaagaaaggagaattctaatgaaaactttagatgctattgcattaactttattgattgtgggagggctgaactggttgttggtaggcttgttcgaatttgatttagtagctatgattgctggtggttcaacaactatttttgcgaagatcatttatatcatcgtaggtatttgtgcgatttactgcttgaaatttttccctatgattactagaaaagttgatgaaagatattagaaagctataattattaaaaaagcaattatcttcatgaaccttcccattagtgggaaggtttttttatttgaagtcatctgattccacatggaaagtggtatactgaatcaagataatctattttaggaggtaccatcatgaataaagggatttacgtaggattgttaggggttgtactacttttttcagcctgtggaaatgctacaaagaattctatcaatgaatcttcactaaccaattcaacacctgtggtcggttcaactaaaagtacttctactgcttccattactaatacttctactaataatgtagattctcaatatagccaatcaagcattcagtcgtctaccatttcttcaacatctgaaatgcaagaaagaactgaaccttctcttccattggaaaactctgatgaagtacttctatttcttattgcccatcgttccgaattacaaagtgaagatatcgttactagcttttatcaaaaaatcgatcaagattatttattcacgacttctagcaagcagactcgtgcccaaggaggatcaggaagtgtcggtttctatcgagtttcccccgatggagtgatcttgattactgatgcgtacggcacaccgttttgatgatatagaaaatttcacatttctgtctgttcattgtgtgttttaacgctattttattttgaaaaacgcgaacgagtatctcaatcgttcgcgttttctatttcaaaattctctggtacgtcccatttattcgccaccatttttttgtcagatgcagtcatacgatataagtgaccatttgcgtcaactacatagtttgctacagctacttcttccataaaaatatctacttctacttctctaacttgattgatacgaacgtcaaaccaataatggttagcgcttacaatagttggatcttctaacttcaaatgatagtatgcccacttctctacttgctctcttgttaaatttgtggtatctacttcgctttttgtcagttgtgtaataaaattagtcgccggatggttttctaaatccaatttttctacatttgggtaaaagaatttgcttattataaaaaatgacaagatgatgattcctgctatacaacatgtgtaatagacgatttttcttctacgggttttacgtatcgtttttatttggtaatttcgcgcttctcgatctcgccattttcgttgctgcaaagctgttttttctttttctaaaagatagccgagttcacgtttcttttgtggattgcttgtcctagcgatttctaattctaaatgatagattctgctttcttctcgccaatagggatttgtggtttttgccatattttctcctctctaaattattttcttactattattctagcaaaccctttctcaaattagaaagataacctttgtaattcactaaatgaaacattcacaaagacaaccgttatacttgaatttttttcaaaatagagttattacataaatagggataaataaaaaatactctattgaaaggatgatcaaaaatggcaaatgtacctagcattcgcgacatgttccctgatttcaatgatgtgtttagtccagcgttcaatgattttttaggtgtttcaagttatccaaaagtagatttagttgaaaacgaaaaagaatacaaactaacagctgatatgcctggctgtgacaaagaagacacgacagttgaatattcagacaatactttgacgatctccgccaaccacgagtcccatacggaagataaagaaaatggcaactatgtacggaaagaaagacattcggtctcttacaaacgttcattctatcttcctgatgttgatgaagaaaaaatcaccggaacctttaaaaatggtgtactgaaattagcattacctaaaacggcgcatcatccaaaagaaacgaaaaaaattgagttaaactaagaactttcgcctctcaataaatgagaggcgatatttttatttttgataagaacaagtgatttctaattgaaatttatagttattcagaactaattcaataatcctaattaaaatttcaaacgatacaaaaaaatattttgttttggcgataaagatggtatgatctctcttggtaaaaaatatgggagttgatcatttgattgtcttaagtaaacttttattttggataccattcatcataatgaccagtattttcttttacttattcaaaaaaccgaacaaatacttacttttatctgcttgtccgatgatttattttatccataaaatcagaggcttttattattatgactctggtatttcattgttttactacgaaatcggtttattagcttcggccatctttttcatttgtgtgttaggatatttcagaaaaaaataagcttccagtcaaaattggctggaagttttttattttggcgtagaacttttcatttgatattcatacaagttgatccatttttctattattaagtacataccattgttactctttgaatgtgagggataaagaataaaaggagctggtattttgttagctatgagtaaagctttatttttacttccctgcacattcatgtttattgttttatgttacttcaaaggggggggaaaatggtgctggatcgatgttttgctgtttcttcccttttttccgcttatttattttctggaagaaatttaggatgacatggcatgtgattctgcttttctttttagtcattccttggggcttatgctctcacttatgttctttgccattgtgctatttttttgaataaaaaataatgtataaacacgtttgtcccaactaatcttgtaacttgattttttgcattaaaaccaaataaaaagataaaaaagtgcggtattttgcacatttttattatagataaacgtttagacaaattggattacttttaggttcgtgatacattggcatagaaattatttgcaaattataagtttacatcatttaattatagttacatactatttcccccctcattctctgatattccaaagataatttctactttgttttgatttttgcagtgattcacatgacaaaaatgttcgacttttcgattgtatttcttacttcaattcattaataatgtgattgtcacttgtttcatttatttaatcattaggaggggaaaatttgaatactgttcgtttgaaaagaggactttctacctttgacttgaaaattttagggattacattgatgtttgtcgatcacattcatcaaatgttttatccgtttggtgtccccgactggctggattggtttggtagaccagttgctactttgttttttttataagcgttgtaggcttctcacatacacatgataaaaagaaatatatgcagcggctttatctctcaatggttcttatggccttttttacttattttttaggtaatatcgttcattatgatgaagtagtattaatgaataacattttcagagatctgtttattggtacggtcatgatgtatgcaatcgatcttttcactgagggaaaaaatacaggaagttggaaaaagattgttacaagtattctcttattcattttaccaatcttgctctcattatttatcccgttgttattttctagtcctgttatccttcaaaacaaagttgtttttatgctgattacatcatttttacctgcactgcttttggcagaaaatagttttatggttcttttgattcctttgctttatttagcaagaaatcaccgtaacattcaatgtgtcatcatttcgattgttgctggaatattcttctttttaggtacgacccagtggataatgatcttttcaatcatcccaatcttgctatataacggacaaaaaggaaaaggaataaaatatttcttttatattttttatccggcacatattgccctattatatttgctgtctgcctttttatataaatactagactgatgaatgaccatttcgattcagttcctgtctttagtcttttttacccattccatgttacaatcgctttgcaatcgatctcaaaaaaggaagcaggagggaaaaagatgaagcaactattaccgtttttgacatataatggtcaagcagaagaagcaatcaattggtatcacaaagcttttcctaactcccaaatcactaagttgaatcggtatggggatgcgagcaaagaggaatcggatcttatccttgaaggtgaacttaagttaggcaatcaagtaattggatttttggatatgtcaaaagatttccctgcgcctgtctccacctgggcatctaccattttgattgaagtagataatcaggaagaatttgatcaggcatttaatacattaaaaaatagcggaaccgtaatgatgcatgaaaaaaattacgaaaagtatacggaagtttgctgggtgactgacaagtttggctttacttggcaactgttattctagtcatgagataaaacgaaaaagcgatagttgactttccatatttagtggatggcaactatcgctttttctctcgagtagcattacttttctaatttgaataattcgtctaacgcattggagaatgttgttatttcataatctggaaatttctttttaaatttatcagaattaaacttgttatcataatgatatctaggtagtaactcttttagctcttgcatatttttattgaatatagaaccaagatcaaacatccattgtttgatcactttatattttaccggtttgcacaacttttcttccatcaactttatcatctcttcatatgttcgacttacatcacaaggtagatgccaagtttggttataagtgtcaggatgatttgctaaaagtgccatggctttactagcatcaggtgtccaaatcaaggtccttaaagtttgatcagaaattggtaccaaagcagtcttatcgtctttcactcggttaatcaataaactgtttgtaatactttgcgtcttattaggtccataaaattcaggagcgcgacaaatcatcacatcgatgtcaggattctccatttcagtcactagccgatctgccattttagctcgaacagtggatttgataccatcataaataaatttgctatcctcaaattgttccgtgtcatttttttcgtacatataagtgttatcgaaaaaaactaatttcgcctttgtttctttacaagcctgtatgacattttctaacatgatttcaaattttgttttccactgttcggagtccatcggtaatcctgcagcaaaataaacaatctcacttcctgctacagcacgaatagttgcctcacgatctaaaatatccgctgagattagttcgtctgtatcgttgattgatttcggatttcgactaactaagcgcaactgtttcccgtacgtttgattgagttcttttgctaattcgtatccaatttggccattactaccaataactgtttgcatttagataacctccttgatgaatgttcgtgctagttctcttgttgaatacgggttttgtccagtaatcagatgtccatcctttaccacatgactcttaaagaaacgcttcttgataaaatgtccttttctctttacagtcatctcttcattatcaaaaggaactactttgcttttcatcgctaatcgttcctccgttttagtaaaaccagtcaattttttatttgctattaaatagtcattattagcaagtctgatattcaataaacctgctataccgtggcacacagataatacatagccatttgattcataaatatcactcgctattttttgtaatgcgttattttctggaaaatcccacatcacaccatgtcctccggtaaagtaaatagcaatataatcttcactctttacgtttgcaggagacaacgtattcctcaaacctttttcaataaatgttgcattagaataaatgtccataacatcagaatctagatttttcatacttctaggatcaatcggcacatagccacctaacggactaacaaaatcagcttcaaactgatatttatagatttctgctaaaaattctactgtttctcctagccaaagcccagtagctttatttgttcctttatattgattgacgtttgtttcaacgatcagaattttcttcactgtcttttagctcctctatttcagttattacatcattcaaaaaatctcttaatttgtatatatttttattttcgtgttttagatagtaaaaatttttagttccttcttctctgacctctaataaatcggcgtcttttaaaattttcaagtggtgtgatactgctggtcttgataaacctgtatcgtcagttagttctcctacttgcaaaccatgacagcttttttcatttaatagtctaatcaagatcaattgtctttttgtgtcacctaacgctgctaaaaaaccactcaatgattctagttctgtttttaaacgatcatgtctaatcattgtagctcacctctttggtttatatgtttaaaccattaaaccatatttggtaaaatatgtaaattcctttgctcagaaaagtatcttctttatgatttgacggtttcagaaaaaaatatcaaagcaagtaaaaactgagtaacagaaaataaacaaactaaatcaaacaatagtgttaaacttaatcaatgaacgaaaaaaatccctcacctaatattacagtgaaggattttttctaccaacataaacaaaaaaaccacctcatatgaggcggttaacattcaacattattttacgatatttactgcttgaagaccgcgttgaccttcttcaatatcataagtaactgcttggccttcatctaaagacttaaagccttctccttggattgctgaaaaatgagcgaatacgtcatttccatcttcaccagtgatgaaaccaaaacctttatctgagttaaaccattttactgtacctttattcatatatatttcctcctgatacgtatataatacgtgttttattgcaattaatattacttggtaaaaggagtttttatagtgtgaatatatcgctcagattacgtttcaaattagattacttatttactgtaacacggatataatactaacacaaggataatcactcgatataaggtttaaaagatgtaaaatttcagaaaaatcacaacaattgtttaatgaacgagtatgatctccgattaaaaatctcatatctatctactttctttttgttcttcgttaactacttactttttcaacctgaatgatggccggcaatacaattgctcgcaattttatccactgcttctgtaggaacaccgtattttttaaactttgcttttatttcagttagttccggttttctgactttttccattctggtgtgtttgtagtccattcggaactattatccttaatatttggttattagttgataaagtgctattatcctaattgacataagacgatatgggagatgatacggtggtcacatttagcatgcttttattttggattccagtctgtattggtatcagctcttttttttacttcactaaacgttctagaaaaacagttgtattaatgctttcttttcttcctacagcaatttttatcataaaaatagtgaaatatacattttatcaatcgctttcagcattatttttttacgtagttgggttgtttttatcacttattcttttcatcattgttttgcgatatctttataagaatgattaattattatacatcgaaatgattcttgttatccttaatgctatttttttagatttcaattttttataaatattttaggtcttgctcttatcttattttctagcaatattataaaattgattggtaactttctaaaagacgatcactagttgattgtctttttttctgaatgtctatgtaactaaaaaataaaaaagaagctgtttatcttttcacctagcgatagtcgctaaactttccttaccttattttctcttcagcaaaaaaatggatagaaacaaaagtatcatgtataattaaattaaaattaaaataattagagaaggtgaaatcatggatgaattccaaatgataaaaagtactcttatgtctataaaagaatatgtatcgatgataagtagctttcctaatgaaagtgatagaaacagtgtaataagacagtttaatattcagtttataggaaaagaatgtaaaaaagttatttctatagagattgctaattatttaaaattagaaaatagtatatttaacaaatatattcaagaaattgccaaagaactccacatcaaattagaaggactccataaggtaaattctgctacttcggaagctgatgcgtattatatctatctttgacaataagtaattgatgtgttttaaatattcgtaactccgatgtttataaattaatagacagcaacggaaatagtaaaaacaaggatgtgaatttcaactcttcataattgttcttactatttttcaaccgttgctgtctatcgcatttcatcattctttcaatccgaattaattagggtactttatcggcatatctagtattaaaccgtctataccatgactactagcgtaacatctgtcttttattttcattccgctccctcccattgacgagcatcattttatatagaaatccaagcttacgaataacctcacttgcaatagcaacaccctgacttgccactttatatacttcttctgtagaaactccgtattctttttcaaatgttgccttcagtacgttcgattcttgtttactcgatttattcattgccgtttttccaattctcattaatcaataacattttaagtcgattttctgaacttatgtatcaatgatcatatagcttgaaaccgttcttattatactgtagtaatctacgtatctaagcaacccttcatttttgtataagtcttttattaccgactccccccttcaatctcatttatttctcataatcaatgaataatgataagataaatatattgcaaaagagaaaaaataaaggggatataactttgttatttattagtaaaattttattctgggttacttgtgcatataaaattattgttctacattgtttaaaaacatggcgtaaaaaagattgtttactgatcgtctcatccctctcgtttatctatttcatgattcagatttgggatgattcagatactgatcccctttttttatccaattatttagttgggttagtattttcgatagtattttttatttgcatactaatttatctgaatacaaaaaattaagttttccagctcttagggctggctttttttgtttttagtctattttttctgaaaagttacttgaataaatacactttttgagagattatagccaaactattttttaaaacagctaggaattttgcgctaacttaagcgacatcactcagtttatacatgttttcttttgattaatctaaagttgtttccgactaaactactgattccagggtatacaagacatgattagatggacacctattctcatattacaaataaaatgagaattgaaatggtagatatcatggagaattttaccaacaaaaaaaccaccggtgacattccggtggcaaacccatgtaaatatggtgtttttttcagtattgtcaaatagacctcttactacttcttactttcttcttcgtccattttcagaacggccatgaaggcttcttttcgcaataatctaactgtactattctctattaatctaagatagtctctaagcttttagtattaaaggttataaaggaactaaataatctcttctatctttaggtcatttcaaaacacctgagaaaacctcagtcatcggtggcaaaatggtggcaatatttttttgctgcattattaaaaatagtaacaaaaactttatcacgatctttccatttatatcattatcttaccaatttcattttcaattctatctagaactctttgtatttcagatctaacattgtaaatatcttcaatgtactgttgcgctgtataattatctggtattttattatcactaggactagtgtctttaatttctaacaaccctaatatttggtcgggatacatatcaattaccttaaatttcaaagaagatgcgtataaccaagatattttaatagaaggaaagacacaattatggtttaaatttgatccttcgaatagatttgtcaaaggtttttataaagtatgggattcagaagttttctttttagcaatcgaagatagtttattaatcaatctctactattcaaataaaaactactttaaaatccctgctgcgaaaactagaatgaagaaagatgtgtattttttgtttgatatcatgactgacgtaccggacgcacggagcgatcatcggcgttatgactatttgaagtatactttcgttgatccagaaaggtataaagattaaagtaggctacctaaaaaggtagcccggaacggattttatcaccatacttatgaaaggagatattttttaagttagtattaagattgtgtaatatgatgatatctatattttatagtatcagtgctataaaatcaaaaataagtcactaattaactaccactccaattataagtctttttcccattattttttacagttatatggtatgcttttaatggcttcaaatataaaagagtttaaagcgtaacacacttatgggggagtggtttttggggaacgctttaaactcttctttattattatctcacaatataacccaaatgtctttctatttaaaaatcaaagtaaaacttttcaaatatacagaagtataactatgtgaaacatcctttcattaattaaaaggatacataaaaaagccactcatttgagtggcaatgaagaaaagctttagcttgtataatactcttcaaaaaattctaacacagaacgattcaaatggctacattaatgtaccctgtaggactcgaacctacgaccggacggttatgagccgtctgctctaaccaactgagctaagggtacggaaagccatcacaactactgcaaacaaaaaatggcaagaaaaaaatcgtgaacatgctcgttatttacggaatcgcagcaccgctcggtcatttattcggaaacaagctacttttgaagatttggaagaattagaacagttgattgtagaacgtaaaaaagacctcgatcgacactagtcggctaaggtcttttatatatcctgtagtcctcaaatccaccgtttccaatttaaaaattagtttaaatttgttaaatcccaaaatatcatgtagatatgtcgcattatattaatttaatttttgctaagctacttaaaagattattataagcatctatcaataaagaaaaatctccaatgatcattaacgtgataaatattattattatagaagaaatccaaagaaagagtatattttttcgtttttttaccatgattgctttgcttaactccatgtcattggcaaaaatgcgctcaatgtctttttcatttaatatagaactataatattttttatttttttcgtattgttcgtttaattgatctatttgattgtttatttcaaaattgcttattattaagtaaataatagatattattagcatagcaactgttataatcgttatctcaggagtaaatatattttctattttcccagtagataacgtattaaataatatagtggatattataaatgtaaaaaaactggtgaagttttttttgaaatcatcagaaaaagctgttgctttatcttgaatttctgtatctaaattttgaattagtaaaactacattattcaatatttggacatatctatctacattttcttttagatatatttcataattagatttaattgatggtaagatattttgaatgttattaaaaacagaatttccatcataaaaaagcgttatgatatttctagtaaggctgattttctcatgtgaatctttattataaaaaacccagcaatatatttcataaaaactatttacaatatctttattagttactagagtagaaaagttaatctcttcaacaactgttttttgaccataaaatttaatatttagagtgtcatcttctaagacagaaatatttgccaatgaacttaaagataatagcaggcataatctgtcaaaaacctcagttaaacctatattttcttgggactccttaacaaaaaagtcactaggggaaaaaaagggtaacggagaaatattggtatactctgtcaaattggcaatattttttttctcaattgttaagttttctttttttaattgtcctaacttagaactaaaaataaaatgatcagttctgagttgtatatcatcattaaaaagatcaaacaggtatatagcttcagtatcataaaaatatctttttaattttccaagaatctcatttacattaagttttcgggaacgatcatcattataagttagaaaaagtaaaaaaatttttaaatcatatatagatatagttataaatccttgagattttttttcctttttagaaatataaatctcacataaaaagaaatcttcttcaattagttctgctctattcaaaaactccttaatattgccctgtaaatttttacgaatttcagaaaattcattttcaaattttatatattctttttcttcgccggatttatctgaaaaagtaatagtaatagtatccctggcttgattaatcgattgatataaattttctaaagtatatattatttcttcaaagtttttgttgtcaacaagaagaggttcaaacatcacttcatttagattttcttttttgacagataactcttccataaatttttccatacgaagcaaccctcctaccattttatcacgtatttaccaacgaaaactttcaaaggtcttctcttcggtcgattttattttgatgaatttttcgccatcaacttcttctgcagagatgttattttttatttgatctgaagagccattcaatgtgatgtctacaaattgattaacagtttttgtttcttgccatttttttttatttattgctttggatttaatactaaactcagtatctttaaagcgacgataatagctacgagcgaaattcccctttaccttatcaatatctaattcttcggattctggagtataatcattaaataagctctcaactacatcttgtaatctaaaagttggttgagttttataaaaagataaaagattgtttctacataggatataatcagctggatattttttttctaaagacgattttaaactattagataatacagtaaatgatgctttcgtattttcttcgtctgtagtcattggttccagttcaaggaatagattgtaccaataatctgatattttcttattattgtcagaaactatgacttcctcaatttcattttgttcattaaatttaaacacacaagttttcaatgatttattttcaaaaatcagtccttctcttgaaactaaatcatcctcatctaagaaacggtttgaatcaattttagcaataacaaaatacgtaaattcactgtcacaaaataaggattgaattagactacccttttttatttttttacctaatttactaattttttcttgagttttggtttctatatctaacaatcttttggctactgtatctctttcttcatcaggaagtattttttttatgaaagatgaccgaacaactctaaccacttctgttccatctcttctgatagaaaaatgcttcttattaggattaagtaatacttcatcagttaaatcggatatatatttttgtgcatcttcagcctgaattttcttgaaagttacactagcgcttattaaatcaatatgatgcattgtagtaaaaaaagtttccatatgtatatacctcttttcatatctgctaaattaattaaaccaaaagaaagccctaaagacaatagcctctgggcttcttagcagatataatctttgaggattataaaatcactttaacatatagggaacgtaagttcaagttaaacgtttatgatattaaaacaacattttgtgatattcataacattaattttgtaacaaaaatgttatatatgattccaagtactgcccctcatcgaggggctttttttatcgttgtggaatatttaaataccagcgtttatcatgaaaatcttgtgctccgcctttagtgttcccttctgcatcattcgttgcccgcatcatgacatagactttcttattagggaagttacgcatgttgaaagatacatgatagccaacatttccatatgtcccataagcttgatttacgtctggtctataaattccatcagctcttactcgagctaattcttttccagtattgtagtccataatgaaaatatactcgtatttatagttagcaatgtgccagccagccacatgcaagtttgcattttcgatttccccgaactgatcaatgtgggcgtaatttgttccatctgttagtgtaggatttgcagcacctgctctagttggatcaatgactggtttatcatctgaagttgtcggattttcatcggtaaatccatgagcaatatcataggctaatttttctttacttacgcccatttcagaaagataaccgtaaggatctgtatgatcgccccaaatattttgtgttacccataaatgcgatttgattcctagttggttataaggagtatccaatgttaatggaataccatatttcattgctgaatctctagccaattcaacgtatgccttatagtttttctcaaacgttgctttatcatgtgtgtgttgtaactcaatctgcacaggactgttggcattagcatacgaaccagcaccatactgcacataaccaggttgtccaacttgataaacaattccgccgtctcccacaatgtaagcagtataagcactagtccatgaacgttgcatatactgcgcttcattgcgtcctgttgctgtttcattagccgtttcatgcagtaaaatgtactgattatttgctacttgtgagctaccttcatttacacctaaattaaattcattgttgatcgtataggcaaatccattaattggcaataaaaaaagagccgttaacaggctcatcgcagtaatagtaattttctttttcatttgtttcctccttcttcgctttcagccgagaacattttgtaggttcgatttgatacacccaacacactccctaaaaacgtgccaaaaccagtaatgatgacaacacagatatctgtgtactgccaattgagcgctttaccaactaaccccacgaaagtagctagtgcgggaataattaccagtgcgaaccattttagtacttcgaacgttttattattcattttcttctctccctaaacaaagttttaatttgttgcgtgtgttctaccaatttttctgcatgtgcgtctaatctttcatcatgtttctttagttcttcatgaatagtaatgcgatcagatttgcttgcttctaaatctttagtcaataaatctaaatttcggcttacttttgaaagagtctcagtaattttcgagaaagatgcagcaatcggtctaattactaataaaatcaaagaaacgatagcggttattgatcctgctatcattccccattcccctaaattaatcatgtgacaactccttgaatcaaaataaaaagcacatcaattaagatgcgctctcttctttgctaataattttatctgcttcttcgtctgtaatgcatagtggaacgaatagtcgaacttgatcgtcagtaaaacagccccaatcatacatcattttcacatcgctaaaactaaacatactactcacctccctttgaagctggatttaattgctctttaatttctgcaatatccttgctgtttttaagcgaagcaagcattgtctttgaattgatctgtgttaaactatcagcattttctttcaatgctgtattttcctgtttaattgctacattgtttagcatgagtttggcatttagctgttttaggttgtcgttttcattttctaacgactcatacatcgctttgagattgtttaaatcgttgtgatctagtgcgttcgctaaaacaatccattggttcagtttaggatcaaacatctgatcagcaatcgttagcggttcgccatcagcacgaatcccttcaagcggtggctgatccgtgtagggaacggacacaagcatgtcgtccaatacttttcctgcgtactctccaccagtacgtccgtatttccaaatgtttttcatttatttcactcctttatttttttgtttgcgtgtaccgtaaaggactaatggaacaataagtaccatctgaatcgccaggtatgaatacaaaagttggcattgtggttacagctagccgaccaccgacacctgtacttgttgcgccgtaaccaaaggcggttcggtcaggtttcaactcatttggtatatttgtagcttgattagcacgtccgaatggataataacttgtatcctttgtaaattttgtccctccggtcagttggaactcacctctaaactcaatttcattatcaccatttgcttgatacgtgattttatattgaggtggattattctcagctacttcgaaaccgtccacaagtgtaagagcaagccaacctgtactttctgcaactgtcgcaacttcttcacctgcaatctgcaacccatcctcaaagttttttaaaccttcaactgactgtggatcggtcaaactaaccgtattattcaagcctttttcagtatattcaggcatgatgtcccaactgtaatcattgggattgttactgtctttcaatccttcaccaaagtatttatattcactaatatttggggttcgggtgtcgcctttttcaattttcaaccattttatggtacatgaacctaaagaagtatttggcgtttgaaaaaggtataccccttttgcgttttcccctagctgagttattgacacagtggcgacccatgtatcaaccaatccttcaactggtttaaagtcactgaattgtttttgagctaaataaacccgaatagtttgtgaggcaggcttagtcgctcctatcgtcacagtataagtttcacctaaaacaaaatcctctagtgcattttttgaatagattccctcgctgctacttgagattggaaatttaactgcaggatcagcaatattctcacccaaagccaccttgctcaaataatacggtgcatcgagtagatttggctggtatggggtggctgttgcgcctttttcaagtttgatattttcaagtaatacactccccacaaatggatctgtactagttgtgtgtactgtcaaatacattctgtcgaattctttagggtttgtatttgcactagagtttgcattaatgaacacttttgttttttgtcctggaacagcattactaaatgtcatattaataacgccactcccaccaggagcttttctgtagtacatcctcaaattatccaaactaccactatatccctctaaaatagttgcatcggcactcatggtatattgggtatttgctaaaagtgctggcatatttattttgctatctgcagaagtcattccatcagtttccgtaaatgtaaatttaatcgtacttcctacttgttctactgatccgcctgtaggtgcgttaaaatcgctcgcttttaaatttggcattaaattcggattccccgaataatcatagtccccgaattcgatgctgttactgtacatctttttcagcttgccgagatcgccgatttgctgattggtttgatcaatacgatcattggctttatcaatattcgtattgatagttgcgacatcttgattggctttcgtgattttgttgcttgtgtcttttaatttcgcatcaatctgcgtttcagattccgtaattttctgttcaatctctagctttccatcagctagaattttttcgattttatcaatggtctgactgaaaccattgaagtaataatcttctagttctggcgtactatcatcaattggactgcgtttgatataaaaagtaaaacgaccagctgtatctaacgagcggtcgtttggaaaatcaatatatacgctaccttctactttaccgacatatcctaaaatattatcttctaatacgataaatacaataccattcacaggatcttctaccgtagctagatagtcatgtttaccataaccaccttctgccgttgcagatttgaacatcaagcgaatcggaacagttgtcccttcgggtaagctttgagggatgccgtttttccgaactaacttcattcgaagcttagctgttcctcgatcatgcgaccaaaaaacaacattcgtatcattgggcttaattgcttctgcttgaatcacaatgatcgattcattcattttataaaccattaacttaacacctgccctttggatataattagcccattgccactgatgcttgttggtgtagttgcaaatgctgtggaagccgtacctctaactgtagcatcttcacatttaataccgatgttatttcctgaaccagttagagctgctaatgcttctgacataagccttacgcgcaaagcgacatcttgattaataaatgtagtattaccatacatgtttaatttcgatacgccaccaacatagatggcattgtatcccaaagattttgtattctcagaaaatttacatttatttatcgccatatagccagattgctcgttcatgattccgtagcggttaccacttggatctatcggagcgtttacagtatcaactatttgaataccagaaatctgtgtgtaacctacacacgtggttgtcgctaaactccttactcttactggcaaatctgaagttaaggggtttatactacttatatcatttattggtttaatcattaaggaacgataagacagcccattaattaccacgtcttccaaataagcaccatcatcaatccaaatagtgatcggagcagtagttatcaacggaatggtattcacagccgtttggatagtagcatagggtttttcttctgtgccatcaccagtttggtcacttccgtttttcgaaacataaatatcgatcggttcgttatatccgccgataatttgttggacagagctattcagctggtctaactcttctttttgattggatgcatcatttgaaagctgactgatttcttcgtccgattgatcttcatgcgcttttaaacgagcttgtagtgtttcaaaggtttctcctctattgtttacccgtgcatccactacttcgtttggcgaatccccgcccgagttgattacgagattatcaatacgactgttcgttgatttgtcttggtcagacaatttcttttcaagattgttcagataatcaacattttggttaaatgtttctttccacttcaaagcaatattgtttgataataatttaattaaccccatttacatcagccctttcttagcaagatttgccagtattgaagtgattgttttcttggtatttgataatacaatctctggcgctttattagggatagctggataatcagtaattcccacaacttgaatgtaggtacttatattcaaaggttcataaacaaaaagaaccttatcccctttattaagagatacagcccattttagtgttacggatcctgaaacatctggatagtcgtgtaactgttgttttagatattcaatcatattattttgaatagtgtaacgttcgtcttctattgggtcttgtatcctgattccccatttctgtgattcgggactggtataagtaactggactaaaataatacgagtcgtcttcttttttcttaccaaaccctttaatttgtgttttcaaagcataagtatcaatatcaaacgacacttcatctgtattatatttatatcggatttgttgctcagttatatttccatattctgaaatgggataaaatactaagtgcttattgtttggtatcacaacggcaccgtaatcttccaaaatttcattaataagatttaaataattatcatttccaaagttttcctgttccttttttaaaaatacattgttgggatctacaacttcccaactaaatcctcggtttccagctttaaaaatatgagtcaaaagatcattgattgattttgttccggaaatagtatcatactgtcggccatcttggatggtataataaatgtgggtggctacgatgtctttatatatttgactcccagaagcatatgatctcatctgcttgattgaatactgctgaccatcaaaaacaacatagttttcatagtcaattaaatcaaaggctatttgattcctttttgtttctggtacagtcacagataactcccacgtttcattttgttgccacgagacagaaaaagaatccttatcgtagttaataaggatttcctctttcgtttcttcataattacgtattaatatgtttttcaaagtatcacctacttatacaagaaacggaaatcccaagaagatttcactctagtaatattttgaatttcgatttcattgaccccttcagctaaagtgattagtccatggtttgtatcaataccacaacttacaccattcaattttgggtatacaccatccaaaactaacgtctgccctaaattagttgagagagaaggataataaatgaaacgatcgcctgtggtcttattgaaaatagtcacatttccttctgattctccttcgagggtaatacgtaaatctgactctctcggatcaatttcaaaactgccagcattaaaaatcttaaagaaactagtattgtgtgtataactaaagtcttcagaaactagaccttgagaaaactgccaatcctcatccgaactgaaatcagataaagtcgtaacaatcgattcagaatatcctttataggcggaaaatgatacaacacaatttcctttaaaatatgcctttttggttacagtcatactctcaacaatcactgggtatcttttaccaggttctttcgtatagataaagtagtattcagcttctttattaaatagttctctcaattctgtttcagtcaaaataaggtcattcagattatctgcaaaataatcaaattcaagagtaataggaaaagaatcaaatgagtgtgtcagcagcttttttcctactgaacctgcataggaagaaaattcatttttaggtactggcatcccaatttttatatcaatgatttttattcggtaatttgctaataaatcaaattctccatcactgaattgaagaaacacttgtgttttatctgccatttaactttcctcctgtgtaaagtttgcgattgaacgatgaaccattgtattgatctacacttttgctgactttttcaccatcaagaatactttcgacgcgcactggtctttcatttaacgcttgaacgattgtttcaatatcttttttactcatcgttttgtgctcatttccgccatttgaatgttgatttgaataaactgcttgattcgcttgtacagctggtttgtatctttctcttgcaacaatcgctttttgaatcagcatgtctgcacttggttttgcaggattgatgtttatttcatatggataagcagggtcttcaccaaacatagctaactctggaccaaatacttctcccccatttgaataaccgtgtccgttaccaattaccgaaagcatagatgatccatatcgagttttagcatagttgattgcagctaacatattatcaaagccattgaaaatatttccgtgaccaggaaatttaaatgcattgaacgttgctgtaatagtttgtaaaagtcccttggctagatcgccacttatggagttaatatcggtgtacccaccttgaacggctcgttcattaccacccgactcagtttcaatttgccttaaccaagtattgatatacgaagcattagttggcaatccgttcatccgcaaggcttcttttaattggctagtccaccttgcaacgccagaacctgtaggcgaaccttttccgccaccttcgcctgctttataaatatcacctgagccaagcttacctgtaatgtgtaaatggtcatagtgatcgttatctggccaaggttcccattcacctgtggctggttgtcctgattggcctgttctatctcgaactttcccttgtgtgataacatagccaaccttatcagcaaagtgttcaaacacccagtttgcagggtcaaaatacttgcttgaaccattcattccagcaggataagcaatatcaatcgcttggtgttttccatggtagtaagggtctcctggtcgataacccgaagttattccactcataccaaatttacttacggtctgatttgcaatatcgactaaatatttataaacattatcagccattgctccatcaaaacttccaccaatagagccaaaacttgctattttatctttgatccaatccataacaccattcgttactttcttgacaccacctgttgcaatatcaaatactggatgagtagcatcaaaattcacatgttccgaaatagcttttttaacaaactccactggatgttgaactgcatctaaaatatcagaaccaatgtcttttattccattccacgcagacttgaagaaatcacctagattgcttacgtttccttttgcgtacattggaataccaaaagcttcagcaaacgattttgtttggctatgattcaatacttgggtaccagcttccgcatgcatcaaaacatttttcccttttggaatttccattcttccatcaggatgtcgaaccaattcctctccttcgccatcgttaacaagcatcaatccaccttggtgaataccacctgtagcaaatttaggaacatcccatttatcaactcgaacagaatctggtgcatcaactttttccagtacccagttgattcctttaattacgccattgactccattacctaaaatatcaaccatgtattgcgctgcagctttaataccatcgccgattgcttcttttccatcttcaaaagctttgccgatacggccagggacttctttaacatagtcaacaatttcatcgaatttttcttttgttttgtcctttaaatcattccaatattttgtcacaccagaataaatctctcctactttttcaactacttttttgtaggcgtcctctatcggttcaattgtatagcgtttaattgtattccacgcactcttagttactgattggatacgttcaaatatttccgctattttttcttttaatctactgatagtcttagatacgttttctttagcatcatcaaccggtttctccatcgaagattttatttctctccatttgtactttgtaatattgactaaatcaacaaagaaatcgaccactttatctactaagttactaattgttttaacgactttttttcgaactgaatccacaggctcaataacatattcagtaaataattccattgatttttttactgattttgataaagaattaaagatttcttttattgttgaagagattttatcgacaaccttcccaactgctttccctgctttttcgagtttatcttctatccattcagcaacttcatcgaaacctttttttatttttctacctaataaccgtatttgcccatagataagccaaaaaattacctctgtagctttcccaagtatcttacccgctttttcaagagctttttctattttgcccatccattttgaaaaagttttagctattttatcaatcaaatctgtaattgcatcgtatggtggatcaagaactttctttttaaaagctttcaatccatctttgatagtatcaagtagatcatctacccattttttaaacttcttattgtgtttgtataatagagcaactacaccagcaattggatttagaatgaatgttaatacttctttccagtcctctttaaaaaaatcaataacggagttaaaaactttcttgatgctttttttgatactagtcactttatccgtaactgaatccttaaattcaacaaatccttctgtaacatttttaaaaaatgatttgattttctttaatgatacctctacaaagttttttactgcatcgacaatcccatctataaactcacgaaatggcttgcttgtcttatatgctttataaaacgcaaatccaattcctgcaattgctgcaggtataagaaaaattggactagaaagtaatgcggttccaccgaatatatcaagcagtttcccaaaagccgagaccacaccaacgatttttttagcaataaataaagtagctaatgctttacctagaagtgctattcccttttcatgttttgacaaagcgcttaagacatcatcaaatcgttgtaaggggtctttcgttttgccagtttcttctgaaagtaaactaaaattaccagtgagttttttaataatatcaagaaccgcatcccatgcagcaccgaaaaatattttagaaatctttttcaaattatcaaagatactcgataatttatcctgattatcgtttaaataatctatgcctttcaaaatagaatcaaatagtttagtagtattgtctgatatgaagctgataatatctgtaagcttatctttaccgatgccatcaacgatctcattcaatttattaacgatattcgcttggaggttacccattgcgccctcaaaagtcttagtagactttgcagcttcttcagctacatcagtcatacctaagtcaacaatcgctttactaaattcttcagctgatatttgaccttcttccatcgcatcacgaaagtttccagtgaaagcaccgttgtttttcatcgcttcttgcattttacctgatgcaccgggaatggcatcagccaattgattccagttttctgtagttagtttccctgcaccagccgtttgggtaagcatcattgctactgatttaaatgtttcagcattaccacctgctacagcgtttaagttccctgctgcttctgttaactcttgataattcccaataccatttgctgctagttgtgctgtagtattcgagatatcggacaattcatatactgtgtcatctgcatatttttttacaaatttagcagcttcttttgtttctttttctgtaaagccagcaaactgcatcgtagatttgaatttatccattgcgtcagatgattgagtagtttcaccgattaaatctgaaaaactacctgttaaaatctgcagtgcttgtgaagaagcaccagcaatcgcaccaatagatagtttatctttcaagctgataaacttagattcggttttttcagcagtatcaccgaggtcttttgtttctgtttttgcttgtgaagcatctgcgttaagtattgtttctttcctgttaggtatcttgcttataccctcttttgtagcttttattttcagtgatgctccgtcattatccgccttcagttcagttattttgcttttcggtatgccttttaaaaaagcctttgtctctttgacatctttttcagcatccgaattatcagccttgattgtgaacttaactggtttatcaaaagtttgatcgacatctttttttgttgatttggcaattgttgtaacttttgctgtctcggctttaaatgaatcatcaatttttgatcctgtattcattcccaattttgttaatacgtcatcaacaaaactaacgtctgttttaaatttaggtaaattcgacagcatcacatcaatattaattgttgcatctgcagccattttctaacctcctttctacttttttgcttgggcggctagcatagaaaacatatcgcctagttgatcatcaagactgttaactgttttttcagaatcaagagcataataatttttcagttctaataagctatttagttcttcgccttctaaaccagctatgcttcttgaccgaatcgctagtatccgctgaaattgagtgtcttcgcttaaaccagacatcaacgctttgaaagttagataatgcattgaaccttgctcatttaacaaatcgattttgtaatctgccataaacgaagaataaatagctccagcgtcttgagaatacgaataattcatatttgaatcctgaccagtcgattctccttcacttccaatgcttccatatggattcgattgaatatagtcaactatgtcgttaatagcttgttgcatttcttcaaaagtgaatgtatcttctgctttttttgaatcgatataaaacaatttgaacccaagaattattttttctatagactttagatttttatcgtcaattagttcatagaatcgaataacagtgtcaaaagacaaatcaatttgatactcattacctgaaataatcactgttgtttctggttttttcgttagatcaaacatctaatcacttcttacgattatttttgtaatgtttttttgctgttttactacgttcagaaacaacttcccccaactctttttcaagcaatccaataattgtgaaaagggcttttgtacttttgttgtaaaaattataaacgcgattaccttcaccactcccaagaatcacatctagagtagttacagctttatcttttaattcatccatttcagattgagtaaattctttgaattctttagctccattatcatcttcatccattttttcaagttttgaagtcatattttttaattgatctggaatatcaatagtcgttaaatcggttaaagttttgtcaatttcatctgaaatttgaacttcatatactttgcctgcaatttttacggatttagttagtgataattttgcatctaagtcaattacattattgatagccattattttttcctccaaattaaaagagcaggtaaccataatagcgggtaacctgctctaatcattctaattttatgattcagtaactgttaaagtacatttagcactcttattaccatctactgtgttaactgtaatttccgtggttccggcttttacagctacaactttacccgtcgtattgacggtcgcaattgttgaatcagcggatgaccatgtaacgtttttatttgtagcatttgctggtaaaacggtagctgtaagagtttcatttgccccaacagcgagcgataacgttgttttattaagcgttacgcttgtggggctaatcactcccccgctgctaccgattttggcttgccgttgaatgccattgtgaagctgaacgtttgtttagcattagctgcaccaccaaatggcacgatagatgtcaatgtaacaacagcttgaaccttattccctttggcatcagtccattgtgctaacgtgcgtaattcatctccgattgacaagaatttagacgctacataatcttgagctggatctccaaatacacggtgtcccgcaacttggaacgtgatatttttaccagttacagtggaatcagtgaatccttctccatcgtagtaaggggatgcatctgtagtgtccgctgcagctggagtaatagttgtgatccctgctgctaatggtgcgaatttagccgatgcgatttgatctaaatctgtacttcctgaagtatcgatttccaatttgtttttaaagtttagtaaaaattctttactattttctgccatttaaatttcctcctaatttttgaattgatgaatggtgattttgatgcctaatagataagttgagttcccttgcacgtcctgttcgcttacgaaaggagtctcacttatttcgatacctaaaaagacgaagctctcatcttctgacttcagagttgagaggtcgtctaaatgatttgatatgagccaaagagtttgattggctttttcttggtctttcgtgttaaatccgacctcatagagcatttcacgctctttcgtaccgtcaaagtattcttctactgtccgactacctggcatcgaataaacacaaagcgtgtcttccccattaaggaaccccattgagcatggcattggaagaccctgaattgaatctattgaatcagataatcgttcccataaatccattacaagtttcctcctttgataaatgccctacgccaactatccatatgattagcttttgctctgaggtcccaacgtcggcttgtccctggcgttgtataattcttaactctactaccattgacgatccctctaaattgaggtttagcgtaaggaacggtatatgtgattcggttcttgttaacaaatgatttgtctcttaaatgtccttgccgttttggcgtatataggttcatgtctggatgcatctgggcagtcatatagtacagtgctgaattgatgttcatcactgacaacttacgatcgacgccatttttttcaaccttaacatggagcattacagcacctccaactcatacgagtagacttcgttactgtatggattacggttatctacgatcgtcgtgatagtgtaagtctcaccttcaaagtcaatctttgacccaacatgatttttattaatcactggcatcggatcagatactccagcaaacaaaaaagcgatagcgttggctaccacttgccgatgattattactaccgctgtacactgtttgaggttggaaaatcatatgattaatcgtgattgggtctgaaaagataggcttttgccatttgtcatgtccatcaattaaccataatgtaattgactggttgcaatattgctttggcattaatggaatcatcgatagtcaactcccttgtaaagaagtcctgtataaatcaattcgttataagcctctgttgcaaccatcgttctgccaactgttgctgcattcgtgcttccagattcaatacgcatacgaccaacgctgacacttgatggggaagcatttagtaagtctgataacgaagtaactccaactgacttcaaatattcaatttggacagccattgcgattttgaacttatccactcgatatttgaacgtgtcatcagctaaagaatgtctcatgtaaaaatcgcctgtcactcgattaagctgacgtgcagcacatttttctaagtcatcaaactccgaaactgatactttgttgaatcctgattttaaatattcatcgtgcgtaagatagctcataactgcctcctttcaattaaaaaggatagtttagtagctatccttcgcttgctgcggttaccgtgacttcacacgtagcagttttaccatttacggttgtcgctgtgaccgtcgtagctcctactttaatagcagtaacctttccttgcactggcgttactgttgcaattgtttcatcgctagaggtaaatttgactgatttatcagttgccgtttctggtgatacagtagcagacaatgtttctgttgctcccaccgttagcgtagctgttgttttattcaaagttacgccggatggggctaagcttttggggccaaagaaacagatacaccttctttttgttgttctttgataaagcagtcgtggtataagcggttttgatataagtagccatcaccttgtgaatgttcgcccggtgcaaacaagaagacagtgttttctttaaccacggggataactgcttgtttagcgacaactaagatattgatgtcttgtgcatcagcggcagcagcgtagccatcagtgaaatcgaacttagttttgaaacgagtatcgtcccaaacttcgaccaataacacaccatcaagagaagttacccgagattctagtgccgtttgcccaacattttgattagtgatattacgagtaaattctgaagaacgttctaatgcatccattacggttgttgatacaaacgctactaggttttgtgggccaaatttacgagctggtaaaattgcagctttaatggctgtataagcattcttttcagtaattgtttcttctttagtatttcctgctcctaaagctaaagtagaaaaacgatacgcatcaatttcaggttgcacgtgttctgtaataaatacatttgaaattttagctacagctaagtcttgattcgtttcatcaacgtcttgtttatcgatgtaaaattcaacgtctcgatcttgacccattgtgtaaacttttttgtcatttccataagtaccgctgttgaatcccttgttacgtgtatggtgtttcaaaccagaagttgaaatagtcgttaatgtaaatgatttaccaccgttcacaaattcaacttgtggaatacctaagatcgtcgttaacaatccttgagtgatcttctgatcgaaaatcccattgtcttttgtaatgtaattaattgccatattttattccctccaaatttaatttttgtttggtaaaactcctaatgctttagcgaacacatcttcttccacattctggccagaactagcattcccagaaaaggtagccttcttaccatcgggattaggtggaacctgttcagattggccaaataaataaccgtcgctttctttaagtgcggccagttggtcatctaatccttttaatccctcgtctgtcagttccaatgattcgctgtctagcaaggctttagcagccttaatgtttttagccccggcttgtgttagagctaagtcaatcgctgatgattttttaagatcagcaatttgttgttcagaactcgtcttgatttcatcaaacctagattgtaaatcctctaactgcttagtaagatcttcatttcctttagcgtttgttttgaaatcattcagctcattttggtttttctctaactgttcttgatattgagtggcctgttgttccgcggtagacacccgactattcaactcgttcacagtcacaccatgcaaagccataattgatccaatctgttcatcagttaagccaagttctttcagttcttcacgtttcatttcattcatcctttcgttgtttaacgaggctacgccctcgatggattgaacagtttaacgccgtattcagggcaaaataaaaagactagcgattgctaagcctaaaattattaactttgtacttgttctctactgtaatcacggaccaagaactcattgtcattaataagttctcttaattgtttctgcttgttagcaatcacttgtttgcacatctggacagtttcgggatcttccaattctaacgccgcattcattcgcttcttctgatagcgaatatctcgttccaactttcgttgttgctgttgaatttcagcgttttcttgtgctttttctggatcgtattgtggctgattatttgtattcacatcaggcctaccgagataaagaatatgcgtacagttaattccttgcgttccaccgggctcgccatatccatgatcataaatagagggtaaatgtttgaattcttctggcgcttcatttttcggcacagttaatacccatccgccttggattggcgcacaggcttcgcgagctgctggatgactactcattaatgcagtgacacagtcgaagtcctccattcgtttcaaacgaagatcattaaacgttctgtgtgaggtagattgaatcactgttctcgagtaagcttccatcgaccattcacgtccggctttatcaacaaaacccgatttgattcccatatcaaccattttgtagacgttatcttttacggctttctcatgcgttttaagacctgtcatagattcgatggttgattgtttaagaattgcttgataagctctcatgactgcattctcgttgaaattagtagtgatcagcgtttgattgacattattatttaagtcttgaaaagtttgacgaaccaaagagtctagaattttgtttacgtcgtcagacacagggatacttttatgcaccattcgctcaagctcacggtctatttcatcaacgatcttcacgccgtttcctttaatcaattgttcaatcgcttcttgagtttcgccagtataacttgctaacaaatcaataactttatcgttcagtgtacccattttagaaagttgatttacttgccacaaaagcacgtcttctttagctacatcttgaaaacgagattgttttaacgctttgattatgatgttaaagattcggtcttccagttctgaatagatattgataattgagtttgcggccttttgcattttttctggtgtaatcataattaatcacctaaatcgaataaggcatcttgactacgccgttcggttgatcccgtttctggcatttcatcttttaatgcagctaaccaatcttctaattcatcttcgtttagattgtaattacgtataagaaactgtttcttaggcattacgccagcagttacagcctttagatcattttctaattgtttgttacgatcgacaaatagaccatcctcaaaactaactgttactaaataactatcatattcaatagagaatagtggtttctcgctttcaaacatctcgccatatcccgcaagctcaaaaatagaatggataagttcgttgataactttttcaaccatcgtcaaatagcttgaacgtgtctgataagtcatggaattgttagaaacaatctcagtggccgttttaattccgtcgtctgcatagttcattgagccaactgataacccaacttgcacctcgaactctttaatcagatgactgatagcgtccttatattgaactgttcgaataggtgttgtaatatctttgaccccgatattctcagcgccgtatacaccagcgaatacgttctgatctgtatcaaacattggtgggtgtgattcatctgttttaaggaattccgctggcacaacaacacgccgctgccctaactgaatttcccaagcaaactgatcgtgtgttgtgttaatcatatctaaaatctcttttgagttatccacaatgccggcacctaatgggctctctaacgatttattgttagctccaggcgttctgaagtaagcaaaaagcggtctcttcaaaccttctagtgtgactgtttcagctaagtcaggatatagaatcgacagtggaacttgctttccaacaacgttactgttgtcagatttgtaaagctcattactgataacatacttttcgtcttgccactcatgaaattcgaggagcgtgtagtagtaattcgtgtccccttcagtttgaattgatttagtagcaatagcacactcactaacttcgtttgtatttgaacgtaacgggtaaaactgatctgcacgaatccacgagattttaatcttatctccatcaatgtaaggccgcatagcaaatcctcctacagcgatacctttctcaagattcaattcgaacaaattatagaaattgttgtcgtataatgtttgttccaaaaattcagatgcttctttaatctctttagaaacatcctttttatcagtgggatcgttcagcgtaactttacatttttcattgaaaatgatactagccaatcgtctcgcggcagtcttagtcacgttcaatgatttaaattctcgttttttattgtcgccaaatgaacttttatagttgacatccggaaataaattagcataatatttgaagttctccgctattcgagcgtactctagcgaatcaatcccaatttttgggtgatcagtgatcttcgctatatcttttccgttaacgctcatattcacactatcaactcctctcttgaacatatttttgatcgtttgaattactcccatgatttcacctaccatttcagtcctaaatcacttagattatcttttacaaaatattggaactggtcacatgtatggtcaccaactttgataacttttggatcatcagactgtaaagtatcttcatcccatcgataatcacgatgctctttaataaatattcgatttgcttctgtatccaaataaaaaaacctgccttgtgcaaggaggttctgtacataatcgatcatatccacttttttagctttggccactgcatgaaacctctcattgtaatctttatagtattgattttttagagcgccttccgccgaatcaatagtgattttgtaggcatacttattgtattttgtttgacatcgctcaataaaatcatgcaaatctttagataactcgtccggtgctttcttatttacttttccttcaggagaataataataagtatctaataaaatgacatttttctttttggtaatggcatagcatccacaggtagtcgctgatatttggtgtccactatcgattgaaaagcaaatctgaacgatgtaatcatcatctggtaactcatcaagcggatggaaatgatccatgttatagatgagcgtgcccagaccaatcacttcgcctaagtaaagccatcgatagtaatcttcatcattttctctatacgtttctatcagctttaattgctgaggatccgtaaaacctaactcatcatctttataagtcgagtggtccactaaatgatcatctaggcgtatgcatttctctacccattcattaacccaatcatatggattcttgggtggattccatgaatagtaaacttgtacttgatttacccatggcgaccgttgacggataaaggttgcattcgtctggtcaaatacttcttcgctttcaaagtttgcagcttcttcataccacaaagcaatgacatcgccaattgcatttgattttagttttaagggatcatcaacaccataaaaatagaacttagagccagtacgtttatgaatgattctcaaaggagaagtacgaaacttatattcttttgaaatgcctaacattgaaagtgcccacttgatttgttcataaacagcatctcttaaatacttgtgctgactcatcatgcagacaacatttactttgtgcttagcttgtgtgtgcttcttcatttctgttgctaatttcaaactgataacagatgatttaaatgaaccacgtccgcctttcattaaaatataaggacactttgcgtgccaaactttataaaaatgcgggttaaccaagtccgtagtcttaatttgagtttgtttcttggtcattaatgccattcgaaccaacctcgctttcaatcatcgggatatcatcaacaatcacggtttgttcttctgacgaatcataaccatcatctaactgcttcaattgtgcttttgctaaattgacttgtacatccatgtattctagtttctttctacgttcatcatgttcatcagctatagagacaaattgtctaattaagctagatagcgtgctcatagcccttgattgtgcattcatgaaattagcttgcttgtcccaagcatattgaatagcatattcttctgaacttccagaatcactcgaggaccacttagaaacttctttggacaaactaccctcataatcaacatacatgattttctgtgctcggataatagccgtgtactggatcatgatattattccataatatatcctcaggtttagaggttgcaacctcattcataatttctaatgtttcagaaggtaaccaattggcaaaaaggccatgggtaacagcgtttttattacccactggcggagaagctcggctatttcctttgttacctttagcgttttgattaccaagtggagcaccgccttgattggtaacgttacttttgccattggtaacgttacttttcaattcagcgctccatttgtcttgcgatttccattttctaacctgagaatctgaaacatttaattcagatgcaatttcctttaactgcttttctccgttggattctaaccaaattcttttggcttcatcacgtcttggatcacgttgtcttgccattcaatacacaccacctcgcattctttttacgttgagttttgtttttctaattctctatatctttcaacaaaagcatcttcattgtttcaattttctttctaatcctccaaattccttttgcctaaaagaaaaagaccacccattgagcagccttttaactaattaattttcgttatttacttattttacatcttcattgatataacaattaatcctacttattgatttatcaacgtaattttgtaagatactgatttctttttttatttcaagttccttctgttcaatgtattcaagttgttctttattacgctcaacttgcatagtaatagaagctattttttcgcaaatacttcttactccctcaagattatcaattatttcatctttatagttactgtctggcagtatcaatttgatacttgtaatttctgaaaatgttttttccattccttcattcagattatcaccagcttgaacagcgtgattatgtgcttggttttcaggtattgcattgcctaacctcatcttatttacctcgcaaaattcttttgcagctgtagcaacttgatcagcactcacaagaaaaagtcgagcattcttctcaacactatcattgatactcatctttttttctaattttagtttttttgtttgatatttatgattcacacatacttcaaaagctttcactataagattcattactccaacaacagcagcagtaaataaagctatgaccaatgattctatcatataaatctcttctcccaacaaactttactacagtttaacttaatatttattattaactaatgtaaagtaatcctttttctgttatggcacaacctgctaagctaatataaacattcgaagatcttattggtttcgtaatataccccttatcgtatagcttgccaacgatagcatcatattcatctgaatttaaaccaagcgcatctttttcagcgttttccccattttttatttttgttaaaatcaatttttccacttaattcatctccttccaaattaattatacagtactaaattaaatctgtgttgcgttttaaaacatcaaaataattacttaaataaaaatcattgctatgtaatagcaatctacacaagccagacgcccgcttctcctccctgccacaagcctcgattgctaaagtcgctggcaaggactcgaaccttgcatggttgccgaaacatcgacctagcacgcgtgcttagcgtctaccctttccgccacagcgacaaattgatattgtgaaattttatacatatcgtataattttaattatcagcgagtggtccgctgaaataaattataggtggtgataacatgagtaatcttttcaaaccaggcgaagataataagcctgccggtaagtacaaagaagttggtccaaaaggaggaaatgttcctaaaggtcataatgctactatcgataaaggagacagacctcctccaacttctaagccaggaaacaaatggaccaaaaaataagattacggctagttgtctttagggacagctagctctttttttgaaaaacagtaagatttgttaaatagattaatttgtaaccatgatacaattctcaattttccattttcatcttgatatttagtaatataatgatgcatacaatcccctccttaaataatttaatagacagcagcatacgaagaattcagaaggagttgagttcacatccttttcttcatatttgcttctgtctatcgaagcttaatttaaaacgatgaaggagattccctcccttgcgttttatttttgaagaacaattattcagaataaaagaatgaataaacttgtgagtgtctaatctattaattgtcttcacttataggtggaaatggtttacaagttttagcaaatttcaaatagattgatttgatgaccatattcaaaataattgtcgatcttatttttaattcgctgtgacatagatttaacagtacccacagctagattcatttgttctgctgcttctccataagtacataaatctttattaattaaatgaaataatgtcagttctttattagaaagcaaagattctatctccgtcacttggagcaacatctcttttttcttcggagaaatcgtctcttctgctggcttttctacttcctgtaaataaacttgatagctcataacgtctatatctgccagtttaacggctcttctatgctttggtatcttcttggcttgctcatcatcgaaaggcttctctctgcctgtttctaaccagaataaagcgtactctgtagtagagatagcttctgctattactttttgatccgctatatcttgaggagaacgatcatcaattaatttatgtatcactctcccatgttctttgacaggtgtgcgatatcgtttatttaagattttttgatgttgctttttcaacattttcaagtcattcttgtattcctgaattaaatcattcatatagatagcctcctcaataatttcgcaaacaaaaaagcggacacaaatcaacaagaaagttcttgtcaacttgtgtccgccagttttctggtaggacgatatttaaaataattgtttcacttcttctttaacttgcttgactttattgcaatgggattctataactgttgttccaaacgaaggaagctcgacacttttcatttgaccgtttgaaataatgattaaacaatgttctccttgcattttttcaatgtcgcttaatccaattacctttaactccatagctgcctcctgtgatataatagacttaccttggcaggggcaaatcatatttgtcacgagcagcgagctaataatggcttgctgtttatgtttattaacaatattatgctgataaggaattctctattagctacttcaataattcttcatactttatatttagcaataaactcatcgatatctttgatgtcatattttggacggctgttttcaccgaatatgattactttcaatcctttttttacccactcattgatcgttcctgcagatgtccccgtgtaatgaactgcttctttttgagtaagatagcgtttaggcacatatccaactaacaatgagtctaagtcatttttattgataaatttgtcattcatattgatttctccttatataacttataattctgtttttataatctccatatccaccaatctcaccactgctaaattctctttgcttttcgctaaccgcttgtcacattccatcgtgttttcaatgcgaatgattgctgagtgattatagagatgctctacatatccacgaaatggatagatgaatccttctgcttcgcagcgaaccatgtcaccgactttgaattttggtttcttacgtgttttagggttctttgtcggcatatctagcattaaaccgccgataccatgactactagcgtaaaatccgtcttttagtttcattctttttcctcccatttacgatcatcacttaatatcgaaattccaaactttcgaatagcgccactcgcatcagcaacaccctgatttgctactttatatgcttcttctgcagaaactccgtattctttttcaaactttgcctttaacacattcaatcgaaattcttttaagtggttttctaccgcagaatcagtcacgttaaaacgatcaattaatacaggtgctaccatatctttcaaataactctgcctgatgactaattcagtaccctcaggaagttttttattaacctcccgaccattaataattgactggacgtctgcttcgcttagtggtatttcgtatttcattccgtttcctcctaaatctcacatgcctgttcaaactgtctagtgatgttttctaacgcttttttgtactcgataatactttttatcgttctctcttcacttaacacgtaatcgcgttgtatcgcctttaaacacgatgagaccgtttgaaagtatccgatatctgctcgtgattcttcttttgcttcggtgtagcggatgtttccttcttcatctcgtcttaccttcgataagacaatgtttctagaatcactggtaattcgataatcttcgattttcatgtctagcattttttctcctccacatacctaaactgtcgtccctttgaatcaatccataagctcctagctctatcccagattatgtttttgctcagtccagtaatttcagataactgttcagcagtacctgttactagaattcgatcaccatgccagattgcaatttttctcggtgttctccgtttgggcttttcagtccacattgatttaccgagcttttggacttctgcaactatttctttgtcttcctgccaagattctgacttggttaattcagcaattcgtttcattgcagccttcttatccacgctcattcctccaatctacgaatttcccttcttaaattctctatgtgcaaatcgattgcctttctcgccgtttcattgaccatcactgcctttgtccgctccagatcgtcaatttcacgttgaatgcttcgaattcgcatttgaatcacttcttctgttgtcatgatggatcacctcgttaaaaccgttcttccttgaacgtattccgatatttcttcgctaagatcagcggtactcgatattgactgcagaagagtttcgctttgattttgaaatcttttgtctgcatccctttaacatctacgactttgaccagcttgccgcttttgtaaaatgtgaagtcaggaatatactcgatcttgcgatacttctttccttctagttcaaatttcggcatcagctcaaatttttcctgaagttttactttccagccgttcgcttccgcttgccacaaggctagatcgtaatactctgcttctgcgatagaatcaaacttgatacctcgatgaacagtctttttattacggtatttattcattctcaagaagcgcctccttcttagcctgataagcagcaaagcgagcttctaattctgcttttttctcaggatcgattttttgttcttcttgaggtttgtttacccaatcagggagtttttcacgacggacgtttttttgatatttcggagtataagactgtttcttcttacggttcttatagtcttcttgagctttcagagcatcgtccaatgttttgatattttgcttattccacgattccaatattgcctcaacgtatttttttagaccgggcatttcaacgctattctcaaatgctagtctaaacgcaaacaggatgatgtctgatccccattttttgatcattgggcctaatgcaccttgcaaaagacctgtcggtggtttcccccaactgacctgaataaattcgtacacgcccatattttcttcatctattttatttactttactttcatttactttattttgtggattaatgttgtcattatctctgttaggttgagagttattgttaacattaattacatatttggttggttttggtgattttcttctttttgtcgcttcgaagtatctcgcttggatgttttcagatgtcagcaccttagccgaattgaacaggtcctcattaaagaatccccacgcaaccaagcgggctacaatctgatctaacaattccttacttgctccgggtaggcgttttaaaagggtcgctttggttaaatcattccacacaatgaagtatccttttttgtataccgcacatagcagcttgataaccgcaagctcaccttttatgccaaactccccagcaatagcttctattttttcatcttcgaatatgtcaacatcaagaggaaaataatcaagaccatccttgacaggtcttgccacaaaagcacctcctgatagagggagataactccctcactatttatttaatggtggattcgatgcatcgaacagcgattcttgtgcttcatctgtctgaactgattctgcatactcttcaaaagcagttgatccattgtcagcgtttatttctactttttctgcttcttttctttcaggaatatcttcctcaacttctgtttcagcaataatgctgccatcttcttgaactctttggactctctcatccgatgtggtagcttcttgcatttcaatggataagatcccccatttagaaagaagatttctcaaaacagtttttcgtgccattgcattgtaatcagatgcccacacaccacttaactttgtcttatctcgatctttattgttagcaattcgatgagcttcaatttcttgtttggtccaatagacagttttcttgaatccattcagtaattcaaaatagccaacatatccaatgacttcatcagatgttctaccatttggatcaaactcaaactcttctgtcagtcggttccagctttttagttctccttcgtaaacttcaatcacatttaatgctttgtatttacctgatcgttgggctaattggatatatcctttatagccaagcataaattgagctttcttttcccattttcctgtttgcttgtttttactattgaatggaactaaatatgcataacctaaattcttatctagtccaagatttaatgttgcagcagttaacgcgccgctcatgatagacatcggttcactatctgcaagataactgtcattagatacaagagtcataacattcgacataaaagcattagcattgtcatgaagtacttcttcaaatttctttctcattgttggtgtattcattagagctttaagccctaactgtcctggtgcaacttgtttctgtggcttttctgccaattggttttttaacgattcatttgttgccatattatttgatctccttttcggttagccttcttgattcagtaacgttataaatctcttcatcatttgcgacatctggatatttctctgctagtttcttcgagttcatacgtctcgtacggacaagtttccaactgatgatgtttttttgagtgataccaatactggcttcacgtttacctagctcactgatgatctcgttgtctacttgacgaatagatgattcaatttcttttttcatccgcttaagttctcttttttgctcgataagttcatcaaaacgcgatggtagagctgtttgattttcttctacatctgcatatttttcttttaagaagtcagcagtcgcttcacttccgtcaattacaggctcgataccttcaactacatttgtttcccaaaattcaaccaagcgttctgtaattgtatcgatcaatccttgatctctcacgattcgcttccaaatgaatttttgtccaccgatcaaaacagcgatataacaatagtctttgtttaaaacgttcatgtaatgttgaacttggcagagataactgagtggtacttcttcaccttcccactctttgccgagaaattgattggctgttttgcattccagaatggcattttctcccactacatcacgatcaatattcgctcttagaaacggatgcaatggatgttcaaagacttggtttcttctgcgaacctttttacctgtacgttcttgaaactctttagcaaccacttcttctaaaacattaccccaataagcgggctcacttcctgattcttcaagtactatttgtcctgttttttctaaccatagttgataaggagatttccatttattcaatcctaaaattgttccaacatccgaacctccgatgcctttcttacggtcttcaagccattcttgatggctcatttctaaggtagatttactcatcgtcttcctcctctttatgtggcgtgccccattcaggagtagttaaatactgatctaatgcttgtccaaaatcattcattgttttagccttcctttcgtgctaaaatacagttaagttattttgatatgttgccgattagcgattgccgtcgctggtcggtcttttttgtgttggcattttgaaactttctcttacagcagtaaccgttactaaggttccccaataaataagtgcatatgctggattaatacttgccagtacgattgctactagactcataagcaaagcgctcttgacagtcattttaaatacagttttcatttctttctctcctctctatatttagcaatttcgctagcaagatcttcattcatatgattctctaaaaatcgagcgacttcagttttaggaattctaatttcaccgagtttcaaaaaaccgatgtatcccatctcgatcaaatctttaacattttgaggatttgttgttatagctagtgccgcttcagtaactgagtatgttaatttttcaatgtttcttttattgttgcgcttcaagacaactttttttggaaaaatattttccaatgtttccatttccatcatcctttcatatatccttgtgctacccagtacgacagccgttcctcactaagcttgcgaatatcgattccaagtatttcgcataatgcacttattagtgttacttccaccatgatttcatctaaaaattcataagcatatgcaatgatttgttgacgatcatcaacagttaagtaatttacttgtttaagaagaattttctctacttcttgcttcttctgtttccgctcatctgattcaatcatttgcaacttgtctaatgatgaaggatctttcctataaacatcaccatctattgatttaaataaaccaaagaactcatgaatcacttgaagagtgaaatctgaatctctaaaatgatccgttaacgcctgagcattttccaacgtcacgggcttcgtattaagcaatgttgtccaatcgcttaatgactgttgagagacgttgatttgtcttgctatttcctttttggtctcaccactcttattaattacttcgactaacgattctcgaataacacttgatttttttaacagtttaaacacctcatattcttattcgcccgtatatcaatacgagcaatttttttatactattaatttaaagaatcaaacgaaagctgcttcgtctaattcacgttcaagctctttttggacttcttcaactagacgatcgagttgatcatcatttgcacatttgatgatgtggactagtctaggcctagcatcaagtacgatgtttattttttcttgtcgtgtcatttggaagtcccccttgtttttaactcatttttgtagttaaaagccataaaaaaaattttttctttaggaacatgaaaaatatcttctagatgttgcatctgggaaggcttaggcaaggtacgtcctacctcccaagaactgattgttttttgggatacttttaataaagacgctagttgagattgagagatcccttttctagatcttatttgtcccattttgttttccatacatttccacctctcttttactaccttatgtagttataatatactacaaaatttagtaagtcaactattattactacttttttttgtattaactaaatttcgttgtaccgactacgctttgtagtatataattttattaaaaggaggacttgctgtgttaaaagatcgaatcaaagagttaagaaagcaacatggctggacccaagcagaactagcaaaaaaaatgagcgtgtcccaacaaactataggaagttgggaagtaggtcgtgcagaacctaattcagaagcactaactaaattagctcatctatttaacgttagtactgactatctattaagtaatcataaaactccagaatgggcgactaaagaagatataattgaacttgataaactacttgaatcaaatgctaacatggcttatggaggcgaaactttaacacccgaacagcttcaaagagtcagagatgttttagcaggcatgttttggaaattcaaaaaagaagacaaggacaaagagaagtgattgggtatggaattggatgttatcaatttagttgagaacctaaagcggaagtatcaatccgctaatccattttatatctgtgaaaaaatggacattcaaattgaatatgttccttttattgatgatcctaaaggtcaattccaagagattttaggtcgtgctgtcatcctactgaatgatgaattaaaggattctgaggaaagattttatatttgtgctcatgaacttggtcacgccatctttcatcgtgggttatctagctattatgtatccacacgaacatccagaagcaaatcagaaagcgaagcgaattgctttgctgctaatctcattgtttctctttataaagaagacaacgatcaataccctagaaaagttgaggaattaacaaatttgtatgggctacctgaaaacgtgtacagatttttaaattaaaattggcgactatcactacctgccttcaagtgggagtaaattattttattttttggaggaaaatatgaaaaaaatagttgggttaggattaatcttgttttctagtatcacattaggtgcttgtggtaacaacgattcaaactctgatgtgcctaaaaaaacgactattaatacttctacaatggttactttagagagcagcaactctatggattcaagtactgaagaaaaatctacaagtgatacaacttttgaagacgattcatcaaagattgtaataaaaaacactgaagaattatctagccaatatgatccaaataaaaaaatattagctattgaaattcaatatactaataaatctgacaaagctcaaagtccttggatggcattcgctacatcaatcaaacctatacaggaaacagataaaactgaagaaccattgaatggagcaaatggcttgttccctcaagactacaaaccagatcttgtaaagatgggcgatacagatgttaagcctgatgctactgttgatgcagttgttggtgtagaaattatttatccaggttctcctattatcatgaaagattttatggataatggaagttttgaaaaaactatccctactaattaaaaaagattggccttcgggctttctttttgttaaggctttattaggggcgactatcactacctgccattaagtgggagtaaatatatttttttggaggagaaataatggcaaagaaaaaggttacaggagaagatggtaaaacatatgttatgaaagagaaaaaaccattctataagagagtttggttttggattctagtagtaatcgttgtgttcattgttggtggtgcactaggaggtggtgatgataaaaaagaaactacttctgctaaaacagaaaaagtaagtagcaacgattctgctgagaaagatacacaaaattctagtgatcctttgaaacaggactttgctgttggagatactgtgagctatgagggctatgaaattaaagttaacaatgtgcaatacagtaacggtagtgagttcgatacccctgatgatggaaaacaatacgttatcgcaaacattacaattactaataattctggtaaaaagcagtcatataacccttatgacttcaagctaaatgcagatggtaatgccactaatatggatgaaatcactacattagataatgttaatcaattaaatagtggcgatttggatgatggtgcttcagttactggtgatttggttggtcaagctgctacaaatgttaagttgaagcttcaatatgctacgtctatttggaatgatgaaacagttgatatttctttaaactaatagatcaaaagaacagccttcgggcttttctttttaagcaccaaagaacataagttcgtatgttttatttatgaatacgatttttgctctatcccctatcagattaaaaataaatattataaaatttcttactattacaaatcatctacgaaaggattgataacatgcgcggtggcgttaggaaacgtggtaaacgttggtactattattttgaagatatcaatgatgatggctcaagaaaaaaagtggagaaagttggcggagacacccgaccagaggccgaagctgctttacgaaaagttttatcagatattgacgaaacaggacaatactttttaggtacggatactcgagtaaaacaataccttgatttttggatgaaggaatacgttaaactaaatctaaaatacaatacctatgaaaactaccgatttaccatcaaaaatcatataaacggttatttaggaaagaaaaaacttacggatctctcccctgctcttttacaaaatttcatcaatgctgaatttaaaaagggttactcgaagaaaacaatgactattactcactctgtccttaagaatgcgctgaatatggcggtttatccttgggggttaatcaagcaaaatcctatgctgtatgtaaagataccaaaatacgaagaacgaccaacgactaaaaaagatctaaagatcatttctcttgaggactttgatcatattctagaaatcactcctgaaggccatcctttctatattcctttgaatattggattttatacgggaatgcgcgttggcgaagtttgtggtctgacgtgggataatgtcgatttttcaaatggaacaattactgtagagaaacaaatggtaaagaatgatggcgcatgggtatatggtacaccaaagacaagcagttccaatcgaacgatttttattggacaaaccttgctagcaattctgaaaaaacataagaaacaacaattagaaaatcgaatgaagtatggaaagctctacattgattcaaatgcagtatgtacaaaggaagacggtgggctagttacgccaagtgtagtgaaatggaatactagaaggatatcgaatgcactctccctctcttttaacttccattctctcagacatactcatgctacacttcttctcgaaaatggcgcaaaaatgaaagaaatctctgaacgattgggccacagcagaatttcaattacgatggatacttactcgcatgtaacagataagatgagaaatcaaacggtcgatatcatggaaaatcttagaaagaattcttgatttttgccaccgaaaaaaaccaccggtggcaaaccggtggcaaatccatgtaaacatggtttattttttacactgttttcaaacaaaccttgctacttcttaccttcttcttcatccattttcgattccgacaactagcctctaaagcctggtatatccacatcgaaaattcaaaaaacggttaaaaatagctcgtgacagtaatttgacagcagtaaattgtaaaaaaaattacacttcaaattttgtaaattcatctgccaaagattgatttgtttcaggataaagatgtccgtatttatctaaagttgtcttaatcgatgaatgtcctaaacgcttagaaacagcatagatattcttattgtgttcaatcaaaaaggcaacatgtgagtgacgcaatccatgtaagtgaatcggcttgaccccggctatttctgccaattttttaacacgacctaaaaatgtttttggtgatggtggtaaaccatcaaaggtaaaaacaaaacctaaatcatctccaattgacttttgaacctcttgccattcttttaggtcttcaatggtttgttgatctagtgtgatagttcggatactcgaagtgtttttcgtatcggaaaactcataatccgtccttgtccgaatataaagcgatttattcacactgcaagtcctttttttaaaatcaatatccggccattgtagggcaaaaagctcttcactcctgagacccgtaacaaacaaaaaacgcatcatccttttgtagaacgtctcctgaaaatcgcagagataagaacaattgtatacttttttaaactcatcaactgtccaaaactctaccactgaacgcacagttcgaatctttccaatcgtatctactggattttcttcaatcacttccaagattacagcacgcttaaaaataatccgtaacttgttaaaaatctgtttaatgtaattgtttgataaaggacgtgttgaaccatctctgtttctaactgaacacttctcaacgagatactgttgaaactcttgaatatgaatcggtctgatcttttccatctgcatttttccaaaataagctaacgcacgttttaacgtcttatctgtttttacataggttttttcgactgtacccagcttataccaaggaaagaagtacttcttataaaaatctcgaaacgtaattccttgcagatagatattttgagaatcagtataattctttttcaattcctccatggcttgcttggcctctgtctgagttttaaaacctcttctggtaggctgaattctcttaccaaaacggtcataccctagagacaatgaaaaataccaagtaccacgtttttcatctttgtacacatttgcaactcttctcattgcactattcctcccaagaaatatgcaagacctcttctaaaacagaaataggaatccgctttatctttgaatttcgatagaacgtatagccttctttcactagaagactcttacactccttgaagattttgtcagcgtagtattgagaaaagcctaaatcaattatatcttttcgagtagctgtcttcattataccgccttcctctcgaattgtcttatgctctcgttacattagctaaaaaagaaaaattgatgattctatttttatctatcagctgctttgccaaagcacataggaatttcacctccccccagtaatggcgggccaatttggttacggaagtctcattattgtagtcatgattttcatattaaatttgtcgctcaaatgataatccggtcatggcgtaactaaaaaatcgtaatctacttgtactgatagatttactattcacttgtcaaagagcgttaggctatttttcagcctatggaaatcctttattgttaaccaataaaaaacttccatagaatgaaagggaaagggaaaaaatactttaacgagttgtgtcaaattcaagtatcttgtcaatcaatttcgtttccagttgtctacgcatatattcatctacgtacataaccattcctttttcttcttcatagacaggtttcatggctaatcgtgaaatataattttgatattttgacagaacgatggacatggcaattgaatcacctgaagttgctgctttaatcgtcgctagtggtatgaatggtatatatcgtttattttgcttcataaatgccacccaaatacttccctaactcttccaatgccacttgtcgttggtaccaaacactgccgagacttttcccaataatatcgccaatttcacgatcattaagaccgatgaagaaggacatcaaaatgatttcttgtcttagactaggtaatgctgcaatcgcatttgccaactcctcattagaaataaagattttcatacctaggacagtgaaacttccactactattcaaatttggctctgaataataaaactctgtacctagtcctttttgctctaatatttccattgaaatttgacgttggcgaaatctagcgtatttcttttgaatatttaatgcctcattgcggactactttcttacaaaaactgtcaaacgcgtgtcgaatgtgggtttcttttgaatcgcccataaaattctcctcctcaaaaaattcattcaactcgttttacttctatccctttccattattactacaatttgggagtgagcatttttctaaaaaacaaaaatttttttcaaaaataaaaaaggcatacagacaaaaattgtctatacgcctcacaaatattttcaattatttattcaaaaattagtctaccgatttcaaagcttctaacatatccacattcttcaaacgatggttgacaacaaatcctaagattgtggtcacaattccaataatcaaagctggaatcaagaagcttccgccacctaaagcgggattgaacatgacatcatctggtggtaccaccgtaatgatatattgatgaaggatttcccctacaccaaagcctgccagtatcccaagcatcgttaaaagaatcgtctcacgataaatatacaaagttacttctttgtcataaaatcctaaaaccttaatggtagatagttcacgaatccgttctgagacgttgatattggttaagttatacaaaatcacaatccccaataaggcggcaatcacaattaagactttcatgattttatttaacgaattcacaatggtgtgaacttgattaatcgaagtcgtattttgaacgaccccttcaacgcctgcaagattcatgaatttagctgcttgtttttctgtattgctaagagtgttgttatctaaattcactaaataggcgttggtttgatagtctgttccaaaaatatgctcgtaaccagtcttgctagtaaagacaaaatggcccatatacatctcggtaattccactgactttcatcttgtgactaacattatccgcatccttcagcgtgataatctcaccaatttctacgttcaacagtttcgccaagcgttctgagataatcacaccatcatctgggagtttcaaagaatcgccagttttgcgattatctaatgtcacgtaatttttgaactggtcactctcactaggaaccagcaacttaatttcttgagtatccttgttgtcacctgctattttgctcattgcctcatagtggatgcctaacgattctttcactgcatcatcttgcaactgatcttctatttcagtcttttgtttgtctagtagtcggtcattttcagcgacgatcatatcatagtgaatgatctctccaaattggcgatcactaatcccaccaattgaatgctgcacactaaatccggcaaatagtaaggctacggctccagctaccccaaaaatcgtcatcagcatccgctttttataacggaaaatattccgagcggttactttgtgggtgaagctcatcttattccaaatgaaaggaattctctctaatagaattttagagccggctgctggtggtttaggtaataacaattgggctggtttttcttttagttccttggcggcaactaaccaagcaggtccaattgaactaatcaccgctaacaaaatagctactaaggaaatccaaggattaaagtgccattcgatattttggaaaacaaagccatcgtgataggcattatagacgatgaaaggtaataaggtatggccaaggataatcccaataatcgttcccaagagacttgatactaagccataaaaagtgaatttcttcaagatatctttattggagtagcccaaagcctttaaggttcccgaattgattcgttcttcgtcaacaaagcgggccatggtggttgaagtaactagcgctgccacaaagtacaagaaaatcgggaaaacattggctaaggcgtccacaatttcagagatcgtgctatacatcttgtagccgacactcccaggaatctcacggcgactattcaaactgtaaaccggcgctttcagcttatctaaagtctcttgcgcatcttttagcttttcttctgcgtctttgatttctttttcggcatcgggttctttttcagcaaactctttttgtttttcagccaattcatcttttgcttctgctaaatccgtttctttacctgccaattcatcttttgcttctgctaatttgtctttatttgcttggtattccgctgattttgtatccaatgtttctacgcctttggtccattcggctaagccagcataataggtttcttgattttggttatagcttgcttgaccattattatactgtgtcaaagaagcttgatactgttgttctttttcagctaaaacttgttgatttgcggcaagcgtttctttagctgcgtttaattgttgttccccattattaatttgagattgtgcttcggcaagctgttgttgcccggcactgatttttgttgctgcttgatccagttcttgcttttgagccgccaattcttttttagcagctgctactttagccataccaggatcataagtgttcgttttaaaagcatcatattctgcttgtgtagcagtttgttttgctgtcaactccgttacttgttgctgaacttctgtttttttctgattcagtgcttgttgttgagcttctaattgttgtttttggtcttcaggtaaattaggctgagccaaggctttgtcaatttctgctaattgttgctcaatttgggtcaatccggcattgacttgattgataccatcagctaattgctttaggcccgtttcatattttgcttttccatcatttaattgttgctcattactactaatttctttttctgctgcagcatacttggtcttcccagtattgtagttggcttgagcagtatcaagttcagcttttttagctgcatatccttgttttgctgctgctagctcagagtccttttgggcaatctgattttgaccagcagctagttgacttttcccattggcaagcgcattttcagcttcagataactgaactgccccagcatctaatgaacttttcgcggcatctaactgacttttcccagcttgcagttgattccatttttcgtctaaggttgttttcccggtagtcaaagcttcttcggcactggctaattgggattctccttggctgatggtgtcttgagcttgctgcatctgttcttgcccatcttctattttcaactcaccggaagccaattgttctttagcatcggctaattgttttttggcatcatcaattttcttttggccatcatcgatttgctgctgatactcttcttgaatatctgccaaccgaatttctggttgatcttttaatagctcatttaatgaatctttatgggcttggattttatccgtatagtcatctgaataaggatcaacatttttggtgtccttaaaattcattctagcaagcatgtagtattgggaatcaaaggtatccggggtaacaacaccatagccttttagttctccactaccggctgtggactggcccatattaatatttgaaagaatctctgctgaatagatgaaaccaacaatcttaaattcagttgttttcaagattttcgttccggtagcatcggctttttctgttactttataggtgtcaccaatcttgtatttcccattatgattattgtctaaagcaatttcattgtctttctccggtagtcgccctttcaccagatggtagcctgacagatcttctcccattgaataaaggcgaatcccttcatcgctaccttttgtgaccacgtcctttaggtagccatattcgatatgttgggtaccttccgctttattaatagtctttacatcattatcatctaagccaagggggctaatcacggtaatatcagcactattcaattcattgacatagtttttacctgtttcccgcatatcaggtcccgttacttttagccctaccaaggcaaaagaacctaataacatcagtccaaatatcgaaaagaatcgtcctttagactttgagacggatttaaaaacatccttccaaagcattttcttcttcatctgttgccacctaccattctatgtctgcgattgccgttggatttggattcaagtccacgctttgcactttggcatcccgcatccggattacccgatcagcaatcggtgcaatcgccgcgttgtgggtgacgataatcacggttgctccttgtactcggctcatatcttgtaagatttggagaacttgtttccccgtctcatagtccaaagccccagtaggttcgtcacacaatagaatcttagggtttttagccactgcccgggcaatggaaacccgttgttgttccccaccagaaagttgcgcggggaagttattgatccgttcagctaaacccacatcctttagagtcgtgaccggatcggcggctccttccacaatttcggaagctagttcaacattttctttggcggttaaattgggcactaaattatagaactgaaagacaaagcccacatcttctcgacgataacgagttaattgtttggcgttgtaatcagaaatatctttgccatcaataaaaatttgcccctcatcattgctatccatgccacctaaaatattcagcatggtcgatttaccggccccggacgctcctaaaatgatcgctaattcacctttttcaacttcaaaactcacatcgttattggcggcaatgaccgtgtcacccattttgtatcgtttccaactattttttacttcgatataactcatggtattcactcctttattaaaacaccgtgttgatttaagttcgatgccagtatataatgagttaacaaaacgtgcaatgaacactattggaaatgtgttcatttaaggagtgagtaccttgcaaaaacgacaaacatcaacaaaaaaagatattcgaaaaacctttattggcttattaaatacgaaaggatttgataacttaaccgtaagtgatctggcccgaggctctgacattaatcgggggactttctatcttcattacctggataaatatgatttaatggagaaactagaaatggaagttatctatgatttgaaacaaattatgttattggacaacgacataatttctatagatcagaataagcccattgatttaattccatacaatcgaattgtcaatgccttgcactatatcaaagatgatttcagctttattgctgctttatctggcaagggaggcgatcacaattttcccggacttattaaagatgtgctgaaagaaaccattcaagcgaagatcgatacttttgatcaatttcaattttcaagaaaagatatccctgaagaatacgccattgaaattttattatctggaattgttgcaatcattttagtttggattgacaaaggtggaattgaatcccccgaggaaatcggacgaataattgagctaaccaaaagcctatcaccgaacgaccttttgttgtgattgattttcctaaaaattggatttgacaattgaaagaaccaaaggactttttccctttggctctttcttgtcttcttgtcgtgtatttacatacccaaaatacatttagttttaactcaatccctgatgtcacgcaccctcgcatttccaattcaagaaaaccgcatcatttatgatacggttctccatcattaatcatcatctctaagaaaatctattccatctaaattttaaacactttcctctgttgaataatttgttttttatttaaatccaacaattgtccaattctcatttttctgcagaattaatctatattgaaaaaaagtggttacttttgatgaatcattaaggtattttacgttaatttttgctcgaacattcattccatcttctataaaaactgggtctactaattccacgaattttagattcgaattgattggacgtatcgcatttttttcaacataatactccaattctttttcagaagctgatggatataatttaaagaatgtttccaaaaactcagtaatctcttttgccgttttagcatcaatttctgaatcactttctaagtgttttgtctcatattgtgctttatcaggttttgcaatcatggtaggcaaactcgttacaatatgatttcctttttcatcttcaaagatcctcacacggtatgcagaagaaattgattgcgcctttttcccctctactatcttttgatccactaaaaatgagatgacaaattcttccgattgtttttcaacatctagaatttttactgattgaacttcagaactagtgggaatatctgcccgaatcatatcttggctcaaggtgagaccttcttctgtaagatattgtccaagagtactcattctcttttcaattgcttcctcattattcttccatgaaaagtattcttttgcgaaatcctctgtaaaacattcaacaccagaagtattcactatcttctcttttacaaccactttctcatgagttgtatgctgatcaatcgcggtgaaatttttataaacgccaaaagcgagactacaagacaataaaagccaaagggcaagcaccatttttcgatgcttgcccacggatactactcgttctttcttcttttttggaatcttttccttatgattccgttcaatttttatcttcattatttttcctcttttctcttatttgtatcgtccagcgccaataagacgctgctgccaatagctttccgttagattcgtccagcctactggatcgcctgcatgaaacatgcgattctcccctgcgtaaatgccgacatgggtcacataagtaccggcatcataagtcgaatgaaagaaaaccaaatcacctggtttggcatcttttacatcaatatgggtcatggcatcatactgatcttgagccacccgaggaagtttcagaccaactttggcataacaccattgagttaaaccactacagtcaaatcccgtttcgggacttgacccaccaaatacataagccgttccttcatacttaaacgcctcgtcaaaaatcccttggactgttttatcgtcaaactgtgttgtagttaggtattgcttcactaataagcaataaaacatattgccgtagttataacgccatccaccattttcctcaattgcgacgggatttggataatcgactttttgaccgccagatttttctttggaaaaagattcggctaaagcaaaactatgcctcttcccgtttttcgcgacatgatccagatatccgccaccatagttataagcctgaataatactgtcctgatcacaacctaattctttggaacgcttaaccaaggaagcaaaatagagacacccttgtttaatggatgcctcggtacttaatgaattcggtggcaacccggctgactcagaactttgcataacatcttccattttcccatcagattcgacttgaataatcgccaaaagaatcgggacatactctgttatatccgattctttggcatatttttccaccattgcccggtgtttcaaaacttcttctgagacgctagttcctccaggagaagtgccagaactaccatttccttcactgtcttcaccaaacaacaaacctacacacatcaaaatacccataaaagagatggtcagaaaagttaatgaaataacacccactttcttcaagttcattttttctcacccgaccttggttttggacgatggttcattcttttttggactttttgattggtccgctttggcagagtggaccgctgtttcacttgttggaaagaatttttcttacttgctgattggcttttcccttttgaaattatttcctgactagttagttttcgtctgatttcgggattcggatttgatctcacaatccgctttggtacttcttttttcagcgtcatatctttctgaggttgattctctgcttttatcggaacatttttccttcttttcccatgacgattccctgcttcgtttaatactttgcgcttttcatccattttttcgtctctaagttgtcgttgtttttctcgcaactctcctcgctctgctttttcttgaaccagtccacgcttgaactcttctggtgcttttttcgtcttttcgatccctttatggaggttgtatttcaagttggttggtgtatttcgtacctgatcctttacttgtttggtcttatctttcaccaaagcttgggtatccagaactttgcctatttttctcccggccaaattcattcgagattgttttttattatttgaaattggattttccttagttgagtcagatggtacctcgtgatagttaggtaatcgtgaattctttcgtagagaagaacctgatggcttaaatttggattttgattgttcctttgccaatttatttccgactgctgcaccaccaccaaaagccaaagttctgcccacatttcgattaatttgtcgcaatttacggttcatcaacatttgcggttttcgcatgacccgtcttcccattgactgactatcattactttggagattgaacatactcataatgtcccccaatttgaaatagataccggcaaaggtcacaatttgtagaaatgctaccataaagaagggataagtggccgaaatattgaaaaacatggtagaaatactaaatgcagtcgtaatgactaaggtaactcccgctcgcatcataatcgtattgaataagcgaatgatcgccttcttccccaaactctcttaagtcggcaacatggacaataagaaactaattggcagaaacatcgcaaaaataatgaagagaatttgcgagaacaacataatcccggttaggagaaagacaaagaaggatatgccaatgttgaacaacaccaaaaagaccacggtgcctaagcggttcatggtcttcgtgatacttaaattcgcattgtcattgtcttcaatctctgccttgaccgcttcttcccgatctttgcctttgttttcatctggactcacagatagaatcttgttgacccggtcttcaccaatttcttctatattggaatcgtcaaattgcagtagtaaccaaggttgttggacttgaatagaaaataagctatcccgaatcaaatccacactatcttttccttggctttctgaattgggtacaacgatctcggttccaaggctaagggccgcttcactaacatctgaactaaagtcattaatttttgtgatataggtaggcgcatacgcaataaaagaacccgaaagtagaaaaatcatcacaaaattaatcacggctcggactgctttggtagtttctcgtttgagtaggcctgtatacgccacataaactcctagggctaaaatcattaataataagaagccaaagtagaaacccgagatctgtaatccattttcggtaatgccggctaaggtttgaatattctttccaatactttcagccgtatccgaaatgaaatctaatttgtaagcctcttgaaccacataacccgtggcgttcgacaaatacaaactcaccgtccaaatgaaattagtaatggcataaagaccataaatcacgcttttccctaagccatccccccaattccaaggcagccaatcccaagagctatccacaaagaaatctagttgatagttgttcagtgaatatttggaatatagatttcctgattcaactgtatcatcaactagccctgtcgcctcggctaccgtaccaactaaactcaatagaactatcagagtgacaatgctaataaaaacgatttccacaatccgaaaaagtttctttttcatcccctcactccattctctcttgaacaggtggacgggtatcaaaggcatggaagagttcttcaaagactggatgtacctgaaccacgcctacccgaccatacaaatcctgcatcaagcattggccattttccaaatctcgtaggcgtttttgattactttcatcttcttgatccaacccaaaaaattccaaagtcttcttgatttcatgaatatcggtactacgaaaagcaaatttcaatccgatattattcttcaagcgttcatccagtaaatcgtcactattttgcgtgacaaagtaaacaccggcattcatagcccgcccagcacgaacgagcttattggatagggtctttccttgagctacttgaagaaaactccacgcctcatccaagtctacaattttgaagatttctcgattactatggataaagtccaaggcaaaagtggaaatgacgattagcatggaaacactaagcaattccatggtggtatattcttcaaaagtggtttctgcatccggtagaaccaaatccgctacttgaatgatatttaactgtttatctaaactaatcgactgggtaatcgaaccatctgagaaaagcaaatgggcaaaatcataatcggtaaaagactcgatatgatcggcgatattttccgcaactgttgatccctcttttcgaagctcattaataacttgtagtaaccctcgttgatcactttgagtaacggttcgaatggctttgcgcaaaacaggaaacttctccccatcccgactagaaattcctgttaaaaaagtcaggatatcaattgctagactttccgaatccttctttttcttcataatcacataaggatcaagcaaaccttgatattctggcttactggttaagttgagaatattgatttcctccgcaatttctggcaaggtttctttccaggcaccacgctctccttttggatcgacaattacagcttggccaccaaaaaggacggcatagtaaaccaagagattgttactaaaggatttcccaccaccgagagaacccaggaacgcagcggccaaagcattggtaactgaaccctttactccttgtgaggccaatgctggtttcaggtagacatttcgccctgtatctacgttatagccaaaataaataccctccaactctcctaacatttgagtagcaccaaagccaagtccagcgagaaaatcagacgtaacatattggatatagtcattcatatagcgtttgcttgaaggtaaaaattcttcatgtaatcccatcatatcgccaaagggccggactagttttacattggtatcatcataaaaatcaagcacttcatcacagcggcgctttaattcatctactgattcggcacttactcgaaccacatagctcagtttgtacatggattctttggactgatccaaagtagtttccaactcatccacggaatccaaggcatccaaaacattagaattggtttcattgtcagattggtaagcgtgattatctaaatctttcagttcctttttcttgttgcgaacattagcaagagcctttttgttcgtcacgatttccacattcattgaagtatcaatcgggaaagtgaattgttgttgctggtaatagaaaagttctgaggagggaaattccatctcccccacaatcgtattgattgttaaataggctacatacgattcatgattttcatgttccatgcgtaagtaccgaggcttttcttcaatcaagcaacgactaggacgcaataggtcataacgtttcaccagcgtttctgattttagctttttctttggcagctgaaattcatattcttcaaacggtgtacctttttcaccatagatatgttcaatcaggtaagttagatcactcggtgtgactcgtctgactttgaatcttcgagccaatttactttccattagtttttcaagcttagtataccgacgaatttcttcattggataaggaaacaaaatcgcccatcaaatgatgattcaccccatagataaattcttgaaacccagaaaagaaagatttcttgagactttttagattgacttctttatctgtcgcaatcagtttgaagccaataaaaaagcgataatcaatctgactatcgccaatcatggatactaatgcctctgtctgtaaatcaattcgttgttttgctacttcttttaatcgcccggtaatttcctttttcgatcgttcttgtgtggcacgaatactactttctgtggcaatttgtaaggcatggatctttccttcacggttttgcgcaatcaattggcggaagttatcatgtacttgatacttctgttcaggtgacaaaaaggagtaattgtaaggcactaactcatagtaggcaaaacactcaccttcttggttaaacacaagattattttcgatatacttaatcgggtacatagttcacactccttacaagagtaatgggttcgtcccatcgtttcttctgttctttgactttctttcctgcaaaagtgaccttaaatcgcaagtgataactgataaaggatcgtaaaaatcccaatggtttcttgccgtcaaacgtcttttgcgacataaaccaagtagccgccaccggtatgcccaagtattttagaaatgccccctctatcatggatagtggaggcacatgagcaaatacaatgacaaacagcaaggataaaacaaaccaagccatctgattaaaggtcacaggaaaaggcagttgaaagtcattgatcgcataaatgactttttcaactgcccagatactggtatagctttttatttttttcattagattcactccaataaaaaaaagcctatttctagacttttttataatatgatttacacatcaaaatgaatatcttcttcagcagtttgataaatgtcaatttggttttctacatttactcgattgacgatccatcctcttaggctacattgctgaataaagtcttcaattcgatttacaccgttaatttcttttaaagtaacaactactccaaaacgaataccttctccatcacgaggatttaatctttcttttgtcttaatactcattccccacattggatttttgtatactttttttccttttgtcctattagtcaaaacttctccaatgtgtttgacattatcccattttctgaataatttccgtgcatcttcttcgtaaacgaaatgtacttcctcatccagactttgattattcttatttaatggaacaaattttcctttatcgttaaaccgtccaaagtataaatctaattcagtgttcgtataatctacaccctgatttctggaacattttggaaagtagcagaatgtagcctttgccacatagggatgtttaccttggtatataggtaccgggaaattataattatacgtatcatacttttcagatacaccggagaccacaaatttgatttcatcatccattgaatgaataatattctcaatcctagttggaacaaccccatgcccttttaaagataactcatttaagtcattattgttattccagccaatcgcagaatcaattagcaacgccttcgctatttctttgtttaaacctataatatcgattagataagatagttttctcgcaatccatggagctgcataagatgttccagtaacttttgcttgtcccaacggttcacagactaacataaatccatctgtagttcctccaaaataactaacatctggtttggtgaaaaaagatagcacgattcctcttcttgaatagggtgcagaattattatttgcgtctactgaattcacaatcacagagttaattgaatctgctggtgcacctattcttttatctccttcatttgattgcttatttgtccccgcaataacaaagataacatcatgttcaaactgaagttgatccaataccgcaccctcagcagaaatgaaattttcatttacttcctcattagagcctagtgataaattccatacatgaatgtctggattgctgataacaatctctttaattgcacgaataattgaaaaagagttaaatcccttatttgtcgctacaccaaaatgacgaactttgaatcggccgcaaccatcatccaattgtggattaattgtcggtccatccacaataatcgaagaaaccgcagttccatgtttataatcagcatcaatggttggaatattgggatcaatcatattatgaaaatctacccattttccgaaatagactcgattgtcaaacaaagtatcaatcacaccaatagttggttcacttgttggatcaggaatcattagttgtgaggtagtatacgaatcataaaagtcacttggcgctaactctgataaattttctgtagccatggcaattaggtagggagctttttgtaataaaatggctaagtaatttggatctagtaataccgtcgtacgatcaacgatccgttcatttaaaactttgatgcccaatttacttaataaaacttgtgtatcctcaccagtatcatacaacgtaacaatagaagctcgctttgcttctatctcacttcgttcaacatcaaatttttcgacatatgctgtatcaacgatatatttctgaaatcgggttttcggaatattatatgattcaaaatctatagcatcgaatcgattagggacattaaattcttcatcatttgtagagccattaaactcctcatttaaaatcaatttaactttttgggctaccgaaatggtttcttcaacgacactgagtggtacaaaatgcgtaataatatgtttgggctttccttctgaaaattttgcgccaacaattgatgaatttggtattttgcttcctatggaaagaaatccttgaattcgattactcttggcagcaatcttgttatagtaaacactgactaggcaaccatttaaaaataattccgtttgccagaattctttcatttctaataggtcttgaattaaaacttcaatttgatcactacgaatagttgtattttttggtaactttggacttcctggacgttgtttgccagcattttgtgaaaagctacctttcaaatttaaaatgtcattcatactgctctcctttcaattctcgtgagacttgacttttggaaattccagttagcacttctatttctctaactgtaaatccccatttttgtaaatcttccaaattgaattctccagataatttctttgcagacttaagtaatcttcttaaatagtcaaatggattatttggatcactaaaagccaaagaaactttgatcaaattttttaattcacctggattgggaatttcatccatattttccagtattttcttgaagagtttcatgttcctaccagaacttttaaattttttaagtagtgaattaagaatgctctctgcaatttcaattaaatcttctctttcatatctattaaaatctatgacagaatcaaacctgcgaattaaagctttgtcaaaattttcaaatagatttgttgtagcaattaaaacaacatcttcattcaatttgtctagttcttttagaatgctagatgttactcgtcccatttctcttaaatcatttgaattaaccctgtctaaggcaatggcatctatttcatcaaataatattaacgaatttgatggataaggcattctattgatttcgttaaaaacggcggcaacattcttggcagtttgtcccattttactatcgattaattcactgaactccactacatatagtcttctttgcaaaagtcttgcaacttgtttgaccgtttccgtttttccagtaccaggagcgccttcaaacaaaaatttatttattcctacacgatgattcactgcattgattattccctttatatcttctgctattgcttttggtagcgggagtggatccgtatttatctctatttcttttaaaaataaactttcaaaagagttattttgaggaacaaacgtactagcatctgataccaaactcataatgtattctgctaattgatgatcgccaatctgatcaaaatatcttgcaatttccattgattcatttctaaattgaagttcatttttttcagaatgatacttgattagatttagaacatttttcttcttcaaaataatcacatcctttcagaatcattataacacaacctgggacaaaaatgtgcgttttgggactatttgtgttaatataatctcgtagataaatcgctaatatgaactgatttagtttgagtaagaatttattctactttgacttgaaaacattcaaaaaactagatcgtaagcagattacaaaagtagtatcactttgaatgcccagtttactagctatatctcatacattaattaaaaaaattcaattcggaggtaacaaaatggtaagatgtacagcaccagtaaatgggcatcgaacagcaagcggaagagcagcatgccccgcgtgtggaggtggttcacgaggatttagttcctacccatcatatttttcttctcccacttattctcgctcaacaaattctgtttccaatcgtagcaaaggtacgaagaaggcacgttggtcatcgcctggttcaactatcctatatacaccgtcccaaattcggacacttactccaatccgcaacaagtatgaggagagagccaaactacctgacttacgcgatgtttttctttgtcatgcgtgggatgatcgcaaaactgcagccaaagaattacatgacttattagaagaaaaaggtgtaaccgtatggtttagcgaaaaagatgttcttctcggctctccacttcttcgtgaaattgacaagggtttggcgaaatctcgagtgggtatagtgctagttaccccttcatttcttaagcgcatcaatggtgctggcgtagcagataaagaactttccgctttgttggctagggacttactcattcctatagtccatgaaactacttttgaagatttaagagaagttagtccattactaggatcaagaaatggactaagcactgtcgatgaatctatgacagaagttgcagccaaattagcagaattagttacaccagaagtagcataaataatatacttaaagacagatccgataaaagatctgtcttttttctaacttgccaaaaatacatttaggcaatatactcaaaaaccccacgactcgtaaccaaataattccctccaatctccaaatctcgaccacacgcatcaaagtcaatatacgtcttcaaatgttccggtacttcgccaaaatcacctgattccgtaattagataatacgctacatcactcatatcattacaatcgggataacaaacaatatcatccacatgctctaccatttcctcgaaagaattgaagaaagcgtgttgaatctcagaagcaacttcaccaattggggttccttcaagctccttcgctaagccacacaaccgattaatttcttcgattggcgtatactcatcaatctcaaaaggcagttcataatcatgaattgcgtactcttcgtattcatcatttaatccaatccgttctttgacctcatcaaaatcgacaggtggggtaaaccacgcccccaccaactcaccttcattatatcgacctaagttcgcaatataaacacgcatctgttccattgtgattccccctcaggcaccgacaattcggttaaacaaattgagtaagacatccttcacaccagaagcattaaagaccagaccgaccgcaatcaaggcaatcaccaagaagccaatcaatttagaaaactcccgcttaaatcctaaaaataacccaatgaccacaatcgctagtaaaactaaagattgggcattggttaaaaaccattgatataaattttgtccgaaattcatctcgtcactatcctttcttttccattgctcggtccgccgctgcacttgcattcatcaagcacatcacagtaacaccgagcatactgccaccaaacaccaataaaatatcttttacaattcccatgaccattcctcttttcatacaatcaagttttcaattaccatactttgttgctccaaaatctttttatgtcggtctgataatcgtgcattctgtaccatatcctgaatataggttgtctgattcatccgatctaactccttagccattttccacgtaggggcaacttgtcttccaagccaattcaacgttcgttcaatggtatacggtttcggttcagaagtgagttgaatctctttccgattacgcccaatgaagcgcccccattgttcattcaagggccagttggttcgccgttttccttccaccttatccgcaaatcgcaaataacgattgataatggaaaacgtggtgctttcaatgctacgaccttttaacaaatcttgaatcgcatgaaaagcacggtcatttttcagtcgaatctcaaagcgatttttcgtttcggtcttgtctaatggaatccctagcttgatatattgttcataatctttttcgtacaaacaaaaataaacctcgcttttgaggctgccaatatataaggtattgcccataccatccttttcatcagctttcaacagttccccggaacgatagcttttaaagttacggaacaaggaaatacattcttccttctgacattttttcgttaactcaggaatatctaataagcccactcgatcattgattgctaaatccaagcgtttcatcacgccaccggcttttagacaatcctcgaaaaagtcgtaccagctacgcttttgggcgagtaaaaaagtttcaaactgccgacaacctcgcccttttaattccaaaaggacgcctttatcttcttcatgagacaacatcaccacaatatctcccataacatattgttcttgataggagtaaaaggcataatcctcatgaagcatatactcaaatttcaaatggagaatttcttgaataatttttcgcgcatctgttgtgggaaagcgaatccttacatagtcaaacagtaacgtcaaaggcaaatcgggattgaagctttccagttggtcaaaaatttttctcatggtctttgcagaagcagttacaccaccattttctatctggtttaagtacggacgactaagcccgcaagcggtagccaatttattttgtgaaacgccatattcgttgcgtcggtcttttaataaccgataatctaaatttcgttgtgccaagttctcacctccaaattaaaggtgttaactttttcaaatgagttaacacctatacaaattacttactattcttgctacaccagtaattcttaatggttacttgcttattttttgtgtttttgtacccccctgttagatacggggggtgagacatcatggccggctaacgccgtccatgaacaggcacagcaccacggaggatttctgcttcgcaaatcccccgcggtcagcgcctatcagtggtttatttggttgttactccgcagtaataccctcaatttctagttctgcttttatctcaaacaagtattggcggatgtcgggttctttcgcaaggtccgcaatccgttcgaattcactgataacctgattcaactcaattcgagcatcggtttcctcatccattacatatgaatcaccagggaccttcaccccattttttcgaatatcaaaattgagccggtacagttcttcttccagttccggatctgactgaatcttgccaatcacccagtagatttctccgatcaactcatcataaatcatctagttttacctcctttaatcttctggcaatatcaaaaatgaccggaactgttactgagtttccggcctgcttatataactgactatctgaattgacttgagaagctcggtcaaaagcccaatcgggaaagccttgaagtcgccaacactccctgggcgttagcttccgaatctgatactgatctgtgacgaccgcttgttggtctcctgttagtaaagtatgcacactttgttttcccagacgacctcggcaacttgtggaattaggaaaagacaggttcacactgtctcctggcttcacctcttgatattctgttccatttttccgaatcatgatcttcgttcccccttgtttcgttgacagggtgagagctgtaccggttacttcataaactcgattgccttgttcaaaatttcccggtaacatacccgctacagaaattccatcctttaccggtaatgcgattttgattccttcatccccggttaaggttggggcaaccccatctgaaccatagacttggccacccattcctcgattggaaggattgatatttaacaagtttcggatgttttgatcagatgttggagacgatccaatgataggaaatacttgttcggtacatgcgtctcgagaatgtcagataaggaagacccgctcacggctttggggaacgtaggcctttgagttaagcacttgccattccacatcataccccaatccatccaacgttcggaggatcgtctcgaacgtagcccctccttcgtgattgagcaatccccggacgttctcaaggaataaaagcttaggttggagaagagtggcgaaccgagcgatttcaaagaataaagtacctcgagtatcggaaaatccttgccgctttcccgcaattgaaaaagcttggcacggaaatccgccgcaaaggatgtccactggtccgagggagtgaacaaactcgtctgatatacttgtgatgtcatgcatttccacctccttccttgtatcatggattgccttataactcctccgagcaaattcatcaatttcacaaaagccgatacactggtgacccacttgttccatacctaagcgaaagccaccaatcccagcgaataaatctaaaaatgtcataaatcacctcagtcattgcaaagaaaaaagccaagaacattttttgctcttggctaacatctattactgtattaacaatcgatttataaaggtcttacatcgcctttgttaaccccatttctataagatccatataaatcccgaactaccgtggctgtcgggatggcaaaatgccacctatcgagagaaaactgaatatattgagaaaaagattttttggcgtgcacttcccctccaatacaactgaaatcttgaaaatttttgtaagtcgatacatatgtcaaaaatgcacgaaaaaattcttcattgtcaaaataagtatcaacaacaaaagaatattgactaccaccaaaaaagaaacctgccaaatttttcactaatgaaaattggttttcattaaagtcgaaccattctttcggtaatctttttggttcctcaggtgagtcaggattgtataaattatctcttcttagatttttaatgtagccacctgcgattccaacaaaataatcagcaacccgaactcctacaacttcttttgagttgcaacctttcctcacttctttaaagttgaatttcgtaaaatgttgatctggaataccgttatctaaatgacaaattattgattctaagttttcattctgaacaaggtgtctttcactcaaccaaagatccatatcaaaaataactttattccagtcgaaatgaggttcctcagctgattctttggcatagtgtttagaattcttaatgacttttactatcagcttatattcattcacttgtgatgccattcttttattttttgattgactagaaattatcaagttcatttcattttgaattactgttaatagttcaatgatcgttttatctttgtctaataaagtctcgattgcaaattgagaagcctcaacatcaaagaacttaattattgtatacataaataaatatggattatcaatcaatctcttctcatcgattgtgtatatccattccaaaagtctagcatttacaattaccgacattttattgacggatagaagcatattttccgaattatactcatggcacaacttaatcaagttttgataaaaatcaacttctctatttttcattgaagctataccaaacttattaaaacgtcttcccagtaaaattgatccttttaattcattaaccgagctctgacgcttttccatataatcactttcaagtttcaaaagatcacgctcaaagttaagtagattttcgtctgagatataccaaatatcagcaacaaatccatgcattcggtctgcaccatacctaatcttttctttccaatcaaagggatcagatacttgaaaactttcctgtgggcccttttcatcaataaaaatatgcgccatttcaatttactcctctcagacaataccgtttactgagactataacatttcatattttatttttgaagtcttcgtatattatgggatatctctaatgactttcagaaaatcatacccttttggtacaagtggtgtataaaactcactaatcacactccctcctgtatctacatatcctcgacctttgatgcgtttcataaagaaatttttatcaacttcgccaaacatcatggaatacccaagctcactcatacgacccaaagccacacggaagttaaactgatcgcgaatcccatctcctagatatttcgcatcgggcctttgacaacctagaatcagaaagaaaccagactgacgacctaacatgacaatttgtttgagcttattcaaaatcaccgcactctccttagtcgttaacatttccatataagccacgtattcatcaaagattaaaaagtttggcggaagtccgagatacgcatagttctctcctgttttgtagttgggcatttctttcattgccttgctacgagccatcatgcgctcataaaaatcttccacacaagcagaaatttcttctttttgggagtatacgtgagacatcaccgtacctaaatcggctaggtccgcatttttgggatcaagaacaaaaagctcggcgtctgacttcaaaagtgcttggataatggtgagtaaaaaataagttttgcctcctccggttccgccagcaattaacatatgaggtaaggaatcatacgcccatacttgatttttcatcaatcgtaaagctccattttctgccactacttcttcaattccaattcgattggcaatcatatcgtataacaaggtgtattccacataggagtctttgagttccttttcaactaactcacaatacagtccgctttctaacttcttttctagcttcaacagttgatcttgatattttcctagtgaaatttgaacgcgaatggaaagtaagccctccttcattcgataataaattttggggaagtaactgatagtctctctggttcggctactattcaaatctttgaagaagccatcactttgagtttgcttcacttcgtaccaatggttttctagaatcattctggctagcttttgtcgatgccacaaacttcgccaatgatcaggaaaaaaatgaatataaagtaacatcataactcctgaaagagcgagacttccaagcagacatactaaatctttcatggaccaaacgatttcaatagtggaaagtgatagcttagaagtctcaagttgtctaagctcttgaaaataaaagacgcccatccaaccgatgaacaaagcgattagccggccaagaacaaagtgataaaccaagtgttgatctcctgcgcgtattcgatgtcctttgtacattttgattgtttccacctccagtcgaaaaagcccaatatgatttcattgggcaatttcaaaaagttatgctagtcatttactgctacggggagttggtttgtttcaaccaagtgttttaaaaagctttcaatggcatccgacatttccatacctatttcttctaagactgattctgcttgacgacataaactttcatttacctcgacaaccataaagaaggactcttcttcccctaaccaatccagtacatcaaagtcttctgcggcatcgttgcctacttccagtaacccttgattcataatcagaaacattttttcatcataggttaatgcgttagtgagttgttcctcggttagctcacctttgccatattgatcgagacaatctaaaatatgttccacattaatttccatattcttcacctatttctttccttcattttggttcgtgggatttccttgattcggttgtcgtttcaagactaaatcatctgccttaatgaaccaattgacagtagttccttctcggaaaacataattggcgaccgtatccacgattggattgaccaactctacctctgcatcataggcaaactcgcgtaagggcacatttgctgggatactaacttggatcattcgaccttgcgcggaggatttcaaattataggtccgttcttttacctcgttactaatcgtcccatcctcattttgtttccgtacttctcggcgtaatgcagaaaagcgcagcttcccaaacgttaatcctgaatctacgataataccttctgttaatctcatcttcttttcctcctatgctttcactaaatcatcgacatacaacacgtaatcggtaaacccacgattctcaatctcatagcctttggcaaccaagtggggattcacggcttttagcggttggtcttgatcaaaatccttttcgccggcttccgcagctactaccacctcaatatcatcggctcgttgtttactggaatacaaatggtaactacgaccaattactgtagtattccgcccatatccttctgttaaaacttcgccttcaccggcataacttatctttccaaaggtttcggccatatctggtacaacaaatttcaattccatcttcttttcctcttttcattgttagttttggatacaaaaatagcgcgaccacttttttaggaggcgggcgcgcacgttatttcttataatttacttgtatcatctcatcaccttagttccggcgattccagaaataatagccagctgtcgcaaagatcaaagtaaagccaacgaacagtaacacactggaagttttctccccagtttgtgggaacgtcttcactgtaggactagattcttgagagtcacttggtatttccggttgttctggtgtgcttggtgtggtcggaactttttttggagttaaggtttgggatttttctttcaaatcttcattgtgttttccattgatattcccatctttatcatagttaatttctttaaaggtaaagcttgtaccttctggatatttactcgtgtctactttttccgcaagtacggttttggtaaattctttgtcattcacttcgtaatcaatttttccagatttccaaatttctttgttcgtaccatctggaagtaatgcatacagaattgtttcaaaagcttcttttgagccatccagtacatcatgggtaatcgacacatcatcaaacatatccaccacgtcaccatgagtgaaagtttgcaaaccgtcttctaagtgcgcttttgtttggatcgaaacatggcgttccactgtacaattgacagtttgagcttgattattcaaactagcatccttcgctactggctcgtcacctgcttcaaaggcttccttgttttcatacacatagttgaacaagacgatggttttatccaaaacttgttcggcggttaatttatgccgaatttcccaagttcctgttttttctttgttcgccaaagtggccgttgtttcggcaattaccactggtttggctttttcatctttttcttgagcagcttttgtggcttccacatcaatagcctgcgctaccacataccagtcctctttgatttcatgtagattgtaactcagtttatcgactagctcggtagaatcaagggtagtcaattctttgtccccatctctccatgtcgcaagggaagtcaaactatcttcttcctcaggcaaatcatagagcatcagacgattcaaactaacagaaaatgctttgttcgtcagtttctcgtaagaagcggtcaccgttttaattggttgtttttggccttgttcggtaatggtaaaaaaatattcactcttggtgtaatcctctttattttctttaaacgtagaacagatttctaatggcgtaatcttttgaaatccttctggggcttctacttcttcaagtaaataatccccataaggaagattttcaaacttgccgtagccatcaaaacttagttgctcgttataagctgtggtcgcttcatcttcagcacctgtgatttcattggttccttccaatggcgatactttaaaggttaagtcattaaacccagtttcggtagttcccgcagctgatccggcgaatttgaagaaatcaaacccaaagcgaatcacttgttcctttgccgtaacatctcgggtaatcacggcatttttttcgttatcatcgacttttttgatggatacaggatacttcgttttatccaaagtatatccttcaggtgctttggtttcttgccagtaatactcattaattgctaagtgtttaacagaaacttggtccttttcgtctaaattcaaagttaccgtttcatcagaagctttcgttcctttcactaattctggtttaaaagattcactccatttaactgcttgaccatcttttgcagtaaacaaggtgtattcagccccctcaaagactgccttgccttgtgtcttatctccagtatctttgtcttcttttgtcagagtggtttctccaataatttcttggttttgtccttttacattactcgtaacaagggctacggtttgattggcatacttcaattcaacttttactgggttgaaagtattcacgaaaccattagctgctttggtttcggtcacataataggttcccaattccaatgcgttagcaatctcttttggtgtttctgcatgacctttttcatccgtagtcatttcttgaacgatttcaccggttgggctatctttgcgaatggcaaacgtattgccagctaaagaataattgtcgttccaaagatcatttcctgtttcaattccggttttatccagaatgatttgacctttttctcgcgtattttttgaagtcacagaaatggtttcacctgctttaatcgtagcagtcataggtgtggcatcaatcgtataaggcaccggcactgatttttcagtaatggttacctttgtaccatgagaaattccatccaatgtcgcaatgccttctttatcggtagtcacatcttttgcaggtaaattttttccaaagtctaaatggaaaaccgttcctgagacaatagcacctgattctttatcaacttttttgatctttaaagaaccctccgtttccacatcaattttgactgtgtaagtgttcggtttatcaatcgccccagccatcagggtttgttgtccagccattttataagcaaccggtgttccagttccagcagatttcttaagcgtcaacacaccactttcttttgaattggcatttggggtgataaccaattgattgccattgacacgataatcaatatttgcggtgttttccacaacatcatcgaactctgataagttcaaattattcgtatccgttacggttgtcgattgtcctaaaactgttttgactgtggaattatggaaacttggtttcttctggtaatcggcaatagcttgattaatttttgcctcaatggctgcgatatttacgatactaccatctgatcgtttgattgagtgaagggtataaccgttaacttcttgccagatcatcttctgtgccacaatatgggtatctacatctgtaccggctttcttccataacactgaaactaatttggctttttccggcatatctggcaatggatttttctcatatccaggagtaaactcattgtagattgggactcctggttcgatacagaaaatatcttgtttcacgccattgtacactgcataatgtggaacagtgacttctgacattggacggccgtcactgaaagttccttcgacagcgtattgatgtgccaagtcaagctctacggttaccgtttgtggatgagtaatttcatcggccagagcaatcgtaggaccaatcgatccgccaattgtttgacccaacagagccaaagtcgcaaataatctccaatttttaaatctcggctttttcatataattaatctcctttcccatttgggtaataaaaaagagacatccacctctgaatgtctcaaatgcttaaaagtatttttttcaaaaattgtcagataccatatatcaaaaactccaaagagacttttcctatataggcatactgaataatgcgatccgtatttgggatatcttttccattctcgtatttgtccattgaccattttgtaataggcggtgaaaaaagctttccaaagtcttctctttctaaacgataatcccttcgaatcttcctgaatcttagtcccattcggaaaggatccaacttttcaaattggttaatcgtatttccccttttcaacatcttgctaaaagtctccccatacaaaatataagggacagtcactttcccaagataggcaacattcattaatctttcaatatcaggaatgttcgcacctttttcccatctattcacaacattcttacctgctggccgagtaaagttcttaccaaatttctccagtgtctcacctcgatttttccgaatctcttgaattcgttctcccatcgcttttttatcgatgatgggtaatttaaacgaaccgtcatcttgttttatatccatcaaaatttctttaccattgttagagagaaacacagcaattttttgttgcatttccttcgatggttttctctttccgtttaaaacataactaagtgatacttcactagtccctactttagtagccaactctttattgagtaacttgttcatgtctctgtatgcaattagttgatcaataagaagcccaactctattcttctcatcttttaatagagtttctacattcagaattttacttagtgtatcatctacatcttttggaattttccttgttcctttttcatacttgactaaagcactttgcgaaatccccgctaagtcggctagattcttttgagacatttttttctctttccttaaagatttaagaaattctccacttatattttcagacatgaaaaaagcacctcctatgagatgctttcatcatacgctgacggttaaaaaccttcaaggaaaatattccatttttgttaatttcaatactaccgtgacaaccgtatgacagtttaaacttttttaaacgggtaaatcacgaatttttcaccactcgaaaagattgatttaatagggttttccgttgaaaacaagctatttcgcgttatcctggtcgtccattttcagaacggccatgaaggcttcttgcggaacttcgacggagccgatttgtttcatccgcttcttcccttctttttgtttctctaagagtttacgtttacgagaaacatctccaccataacatttagccaagacgtttttacgcaaggccttgatgtctgaacgggcaacgattttttgtccaatagctgcttgtattggcacctcaaattgttggcgtgggattagttttttcagtttttcaacgattgcttttccacgttcataggcaaagtctcggtgaacgataaagcttaatgcatcgactttttctccattcagcaagatgtccatcttcactaacttgcttttttgataaccagacatttcataatccaatgaggcatagccttttgtacttgatttcaatttgtcaaaaaagtcaaagacgatttcagaaagcggaatattatagacgacatttactcggtaatcgtctaaataatccatcgtaatgaattctccacgttttcgttgagaaagttccatgactgcaccgacaaaatcattgggcaccataatctgtgctttgacaaatggttcttctacatcttggatcgttacaggttcaggaaaatctgccgggttatcaactgtagcagtcgtaccatctgttttattaacatggtaaataacggatggtgcagtcgtaatcaattctagattgaattctcgttccaaacgttcttggacgacatccatatgaagaagtcctaagaatccgcagcggaacccaaatcccaatgcttgagaagtttctggttcgaattgtaaagcagcatcgttcaattgcagtttttctaaagcttcccgcaaatcgttgtaacgagaagtatcaattggataaagaccacaataaaccatcggattcatttttcggtaacctggtaaagcttcagcggcaggattgtctgctaatgttactgtatcccctactcgagtatcttggacagttttgatacttgctgtgatataaccaacatcaccgaccatcaaaaagtctctagcaactgcttttggcgagaagaccccgacttctgtaacatcaaatgttttgccattactcatcagtttgattttatctccgggtttgaccataccgtccgtgatccggacatttagaacaacaccgcggtaactatcataaatagaatcaaagatcaaagcttttagcggtgcatctaagtctccacttggtgctggaacatattccacaatctgctcgagaatatcttcaattccaatccctgcttttgcactagctaatacagcttcactagcatcgattccgattacgtcttcgatttcttgacggacacgttcgggatctgctgcgggtaggtcgattttattgatgactggcaggatctccaaatcattgtctaacgctaaataaacattggccaatgtttgtgcttcgattccttgggctgcatcaaccactaaaacggcgccttcacaggcagcaaggcttcgagagacttcataggtgaagtcgacgtgccctggagtgtcaatcaagtgaaagatatatgtttctccgtttttcgctgtgtaattgagttctacagcatttaatttaatcgtgattccacgttcacgttccaaatccatcgagtctaacagctgatcttgcatttcgcgagacgtcacagtgtgcgtcatttctaaaatacgatcggccaatgtagattttccatggtcgatatgagcaatgatcgaaaaattacgaatctgctcttggcgttctttcattttctttatatccatagcgtctcctcttttcatataatcagcactttccattataccaacgaaaagcagtaatttaaagactttttaattagtcagctttagaagtttttttggtagaattttgctatactgttatcaagctaataaatggagatgaaaaaatggatcaaaaagattttagagaaaatcttgaattaaaaccagtcactcaagaacatatcgatcagttcaacgaattactttcctatgtgttccaagtgactgaagcagatatcgaggaaagcgggtttgagaataaacgagcttttatccgttccaaaagaccgattttagaagtatcaaaagtgttcgggtggtttcatgaaaacaaactaatctctcaaatcgctatctatccttgtgaagtcaatattcacggtgcacgttataaaatgggaggcgtgactggagttggaacttatccagaatatgcgaaccacggattgatgcaagatttaatcatcgttgcattggataatatgcgcaagaacaagcaatggatctcttatttgtatccttacagtatcccctattatcggcgcaaaggatgggagattatgtctgataaactttcctttaaaatcagagatacacagctacctaaacaagtcccagtaagtgggatggttgaacgattaccagttgatcatccagatgtatttgccgtttatgacaaatttgcccaacgaaaccatggtgctttattccgcagtaattttcattgggaagaatattggcgtttcgaaaatgaagatgagcgcacagccgctgtctactacgatagcaatcatgaaccaagaggtgttctattctactgggtagctgaagaaatatttcacgtaaaagaaatgttctatcttgatcaagaagctcgaaatggcttatggaactttatttccgcacatttttccatgatttactgggtacatggagatatttacaaaaatgaacccttagcttttttgattgaagacagtcagatcaaagagcagatcgaaccatattttatggctcggatcgttgatgtaaaagaattcctacaacattttccgtttgttggaacagctgatgcttttcatttcatcattgaagatcctgtcgctccttggaataatggcatcttcgccttaacatgggatgaacaaggacaagtccgtgtcttgaatgaacctataggaaaacctgttcgattgaatatccaaacattgacatgcttgatgatgaattatcgacgtgcttcttatttggcaagaatcgaacggttagaaacagatgaagaaacactgaagtcactagagcgtattattccaaatatggaagcttactttagcgattatttttaataaaaaggatgatgtttagatgaaaatttattttgccgcaccaatgtttgctaaaagtgatttgttatataacgagcagatagttaaagaagtcagagcgatctcttctaaactttcaatttatcttcctcaagaaaatgaagcaatcaatgacaaaactgcttatgcagacagtcggatgattgctcttgcagatacagaaaaagtgctggaaagcgatttgatgatcgctttattagatggattgacgattgatgctggcgtagcatcagaaatcggtgtggcttatgcgaaaggtatcccagtgattggcttgtatactgatacccggcagcaaggcggagcccacccgaaaaaaatcgctgcgctacaggaaacagctgagaatcaatttcactatctgaacttatatacagtaggactgatcaaattgaacggaaaagtggtttcttcagagactgagttgctttcagaagtaaaaagatttttagatggagggactttcagtgattaaagaaatcaaaaaggttcaaatagctttacttgcttttggtgtattcgttgtctgttataatttttatgaatttatcacccaaaagtattcgacttctcaaggaatcacatttatcgtggaatctttattaggaattgcattgattttcatgccacaagtcattttgacagttttcaaacttaaaattccagcagcaatcgttttgttttactggtttttcttatttatctctgtctttttaggtacagggatgcatttgattagtatcatctctttttgggacaaaatcttacatgcagtgagtccaatggttctgacagctcttggctatggattgattggttacttgatgaaagatgcggagatatcaaaaaccagtccttggttgttcctcttattcggctttgcgtttgctggactttgcggcgtgttttgggagttctgggaattcttatgcgaccagttcttaggcatgaatcttcaacgttttgctgcttctgatggcacactgtttgttggacgagcagcattgatggatacgatgggcgacttgctgacaaatacgataggtgctgccttgatgggattgtttgcttggtctcaaagtaaaaaagatgagcgttactttgaaagttataaattagaaaaagtgaaaaatacttaataacaaaggtcgtgacagaagtggacagctcaaaaaatttcggcttatatccgaaaaagctacttctggaacactgtttatttgaaaaaaaggaggtctgacagtagttgtgtcagaccccttttttcttttatagtctcaatggaagattagacgatttcttctagctcttctgttttgaaatgaagttgtccatcaagtaaagtaatcgttacttttgatttaggcataacatgtcctgcaacgatttctttagctaatggtgtttctacttccttagtgataaatcgtttcaatggtctggcaccatatgctggttcataagcattttcagcgatccacgttttggcttcatcactgattgttagtaggatttcttgatgttccagacgttgtgccaattgcgccaccattttgtcaacgattcctttcacgttgtctaggctcaatggtgtaaataaaatcgtgtcgtcgattcggttcaagaattctggtttgaagtttccacgtaatagcgtgttgacttgttcagccactgcttctggaatcgttccatcagcagtcacaccttccaacagtaactgtgaaccgatattgctagtcatgatcagaaccgtatttttgaaatcaactactcgcccttttgaatcggttaggcgtccgtcatctaggacttgtaacaagatattgaagacatcgggatgcgctttttcgatttcatccaacaagacgattgtataaggatttcgtctgacagcttccgttaattgtccaccttcttcgtaacctacatagcctggaggagctccgactagacgagacacagcatgtttttccatatattcactcatatcgatccgtaccatatgatcttctgagtcaaacaagttctcagctaaagctttcgctaattcggtttttccgacaccagttggtcctaggaaaaggaaagaacctagaggacgatttgggtcttgcaatccagcccgtgaacgaatcaccgcgtcactgaccgcatcaactgcttcatcttgaccaatcactcgtttgtgaagcgtttcattcaatttaatcagtttttctcgttcgccttctacaagtttcgttacggggatacccgttaatctgccaacgacttgagcaatttcattttcggtaacggactcttgaaccatcttgatctcgctgtcttttgctttggtttctagttccttcaattctttttctaattgaggtatcgtaccatggcgcaatacagcagcgcgttccagatcatagttattttctgcatcttctaattcgtgttttgctttatcgatttcagcacgttttgctgaaacagaattgacctcttctttttctgtttcccactgcatcttcattgcatttgcttcttcacgaagttcagctaattcttcttgcaaatttttcagtcgttttttacttgcatcatctgattcttttttcagtgcagcttcttcgatttccaactgcatcaaacgtctggtcacttgatctaattccgttggcatagagttcatttctacccgaatcgttgcactggcttcatcgatcaaatcgattgctttgtctggtaagaatcgatcagtaatataacggtcagataaagtagctgctgcgaccagtgcgttgtcatggatgttaacaccatggtggatctcaaaacgttcttttaatccacgcagaatactgatcgtatcttccactgttggttctttgactaataccttttgaaagcgacgttccaacgctttgtctttttccatatattgacggtattcatctaaagttgtggcaccgatcaaatgtaattcaccgcgagcaagcattggtttcaacagatttccggcatccatacttccttctgtttttcctgctcctacgatattgtgaatttcatcaatgaacaagaggatccgcccatcactttttttgacttctttcaagaccgcttttagtctttcttcaaattcaccgcggaattttgctccagcgatcaatgcacccatatctaatgaaaaaatcgttttatcttttaaattttcaggcacatctttgcgtacgatacgttgagcaagtccttcaacgatcgccgttttacctacacctggttctcctatcagaacaggattattttttgtttttcgtgaaagaatacggatgacatcacggatttcttcatcacgaccgatgattggatccatttttccacttttgacttgctgtactaaatcaacgccgtatttttctaatgctttgtattgttcttcttggttttgcgaggtcaccctttctcctcctctcatctcttcgatgtttttacgcaattctttttcagataatccgtttttattcaaataaacagttaacggataattttttaatttcatcaacgctaaaataacgacttccgttgaaagaaactcgtcgccgaagctttcacgtatttggtctgcttcattcaataatcgaaagaaattctggctgaggttttgtccatattggacgtttccaccagaaacaactggatactcatccagtagacgatcgatttcatgttcaaaagattcgacatccaatccggcatccgtatagaaatttcgaccaaaatgattaggttgtaaaaagattttccatacatgggcaatgtcgatatcttggtgttttcgagtgaccgcaatctgttgagcttcagcaatagcttcttgaagcgtcgtagtcattttctcaatattcatacaggtatacctcctaattaaaggtaagatcacttatttctttgatctttacacaaactattatatctctttggtcaattttggtcaaaatatacacatgtttttttgactttttttctcgtcttatataaatcttaaaaaaacaaaattgattgtatacatacaaaaaaagagcaaaacaaacgtaaaattatcttacccataacgtttttctttgatttgataaaaagggtagatcttataaaagacctacccttgattttctttattctctttttttacttctattatttcttctttgatcactcttcgccgttcagcaatcacatacacaaatccatagagaaatggcaagataaaggaactgaaacgatacaacaaaagcgaagaaactgcgtcaactgttccgacaactggtctaaacaataacaagtagacaaattcaaaggagccaataccagctggcgtaggaataacccctgaaagcactactgcaaagctgataaacgaaatggtcagtagaaaatctattttaggatggttttcaatcagaatcaaatagggaagtacataccaaaatacaagtttcaacatattccatagataaatacgcaatagcgcagtcctgtcttggataatggtttggaccgtttcccttaaagagtagatctgctgattacatgtatccacccattttcgcaaacgctcactcttaaataacttattcgataagctgacaaaaaatatttggacattcagactgatggacattaccaataaaaaggcaacaatcacgatcgtcaaaagaattccagcaataataaaccagatcattgacggactattagaataaaaaagagagaattggatgagcaagccagctaacgcataggtaatcactgcaagtttgtacatgatcatatggagtgctgtcactcctgctccctgagacagtttcattccttttttattataaaaataaatttccgagatcaatgttcctgtaccaaacgaaacgattcggtaaaacgcaatatagctagaggtcaagaacccatctttcgttgtaaaattcggcgcgaaaggttcagcaatctctttgatcgaacgcccttcagcgatttggtaaactgtccctaatataacagtggctgccaaaacgacaacactggtagacattaattcggtaaagatatctgcaaatgattgattgattaaataataaataatagcaaaaatcgcaatcagcaaaagcagattcagaatgattttaatttttgttcctttagatgacatctcctgctccttaatggaaaaaataaatgagaatcaaatcaacaagcacacccgcagtgaatcctacggtaaacttctttttccttgttttatgatgaaaaactttccgagaaatcaatcctcccaaaccaccgcctaacaaactgacaaatatcaagttattttcaggtacacgccagccgccagttcgagcctgatgtttatcatatcccatcagacaaaataaataaaaatttacaatgaatagataaaaccacaaaggattgtgcaacaatacatccattattcttcttccaactttctattaactactatttctaagcttgttcttctttttttggtgaataaactgctaatccttttgatacaacagataattcaactggaagatcatctgtcgtgtctccatctgtccgagtgccaacagatttttcctttgctttgattttcatgcgtttggctgtgaaataagtgatgccaggtatcgtatagaattttcctctcatgattctaggcaaataaaaaataaatcggaaaatatctaaggaaggtacgatcgttacatggaattttccatcatctggggtcgctgaatcgtcgaaatttgtaaagccgcccacggagttagacatcgtgactgtcaataactgagattttcctttccaatgctcctcgtctgtttctaaatccaaatgatatttttccttcttcagcaataacttaaagaatttcttgataaaaatccacgagccataacgctgtttttcttcttgactgatccaaactgctgtatcggctaagataccgattgtcagtgtagagataatgattgcatcattgacttggccatagtctatttttcggacatttccttctagaatcacgtcagcagcctcttctttcttcaatggaatctcaaggacacgtgcgagattattgactgttccacctggaagtaatccgatatgatactgagataacgtttgctggaacgcttggacgatatgatggatcgttccgtcccctcctatgatcactagagtatcggctcctatagcttctgctttcttgactaaatccgcatggtcaatcgacgggccagtttcagctaaatctacaaataattctggttgcttttcttttacataatcttgaaaccagcgtgctaatttctccccctcatctttccctgaacttttgttataaaaaactagcagctttttcattctttacctcctatttactcttcaaaaaagagggcgggacaatccattccattgtcctgccctttagccttagacagatgacattccatcatcggacgaacgccttgtcataagctgttctttttcgattttaactctttgtgttcaattctgcaattttaacaatcacatctgttgctttttccattacttgtaaagaaacaaattcgaatcgaccgtgcatattttctcctccggcaaatagatttggcgtcggaatacccatgtaagagatttttgaaccatctgttcctccgcggactggttcgatcactggagagatcccaagctcgatcattgcttgtttcgctaattccacgatgctcatatctttttcgatgatttctttcatgttgtaatattgatcatacatatctactttgattcgttcttgatcaaatcgttgattcaattcttcttggatatgtgtgatttgtgctttgcgtgcttcgaatttttcacgatcatgatcgcgaatgatataactcatagaagcttcttcaggattcccattcaatgccatcaaatggaagaaaccttcgtatccttctgttttttctggaacttcatcggctggaagctgattatgaaaatcaatggccagctgtaaagcattgatcatcgtatcttttgccgtccctggatgtacatttttcccttggatcgtgatatttgcttgagcagcgctgaatgtttcatactgcaattcacctaaaggaccgccgtcgactgtataagcaaaatccacattgaattgctcaacatcgaatttatccgctccgacaccgatttcttcatcaggtccaaaagctactttgatggtaccatgagggatagaaggattattgatcaagatctccattgcagtcatgatttccgcaatccctgatttgtcatctgctcccagtaaagtactgccatctgtagtgatcaacgtgtggccttcataatttttcaaatttgggaaatcttttgtattcaacgtgtaacgttcttccgcatctagtacgatcgtagactctccatcatagttttcaatgatttgtggattgactcctactgcattaaagtctgctgtatccatgtgggaaataaatccaatggaacgcacttcatgatcgacattgcttggtaatgttcccataacgaatccattgtcttcattatagaaaacatctgataaacctaactcttctaattcttttttcaattcttgtgcaaaagcaacttgtgtctgagtcgatggggtcgttttgcttgttgcatcggagcgtgtttctgttttgacataccgtaaaaaacgtggcaaaagattttcgtacatagtattctctcctttaattaaattgaaatgggtttgtattcgtttcagaaacgaaaaagtcaatatcccaattttcttcttgtttccaagtctcaaatttctcgatgaaccgttccttacataacgattcaatataatgtccgggatcaattgcaatcaacccggcgctttgcatatcatgagccgtatgataatagatgtctccggtgatatagacgtctgctctttgagcgattgcttgcggataaaatttttcgccgcttccaccgcaaatcgcaatacgcttgatggatgattttgttttttgaggctgaacgattctcagtccttctaattggaaaactttttttacttgttccacaaatgtttctaaggggatttcttgcggtaattcacctattcgacctagcccaaacttttcgactggttcatcaattgcgaaaagatcgtacgcaggttcttcataaggatgaaccgattgcatggcatcaatcacttgtttttcgattgtttcgggcaaaataacctcgacttttgcttcttggacttgttctgccttccctactttcccaatcgctggttgtgcaccaacattcggagtaaatcgaccgtgtccaatcgaggtaaaacttgtaccggtataatcgccttgcgtaccagcaccagctacagctaatgcttcccgcattttctgtgcatgatccacaggtacataaaccgccagttttttataatggatttcatgagtcttcactaaataactctccacttcaataccaagcagttcgcaaaaccagtcattcagtccgtcccaaataatatccatattcgtgtgtgccgcataaacggcaatatcatgtttcaacagatctgcatacattttttcttgcggctgatcagtagtcagccgttttacagggcgaaagattgggggatgtttagcaatcagcagatcgatttttttctcgattgcttcttcgaccacttctgggcgaacatctaatgtcatcattacccgttgaatcggtttatctaatgttccaatatgcagtccgactgggtctccttcttcagctagccattgaggacaatagctctcaaacttttggatgaaggtacgtccgcttattgtcatatctctaaaacctcctcaatcatttggatttcctgttcgatttgtttttgacgtgcctcttgattagctgcttgtttgagctgttcacgaatagcttttctttgttgaagctctcttgtccattttgatttgaagatctcacttttctcttcgagcagaaatggtccgaacatcagctccatttcgttgtaagtaactggtttttgttctttttcggctacaataatttcatatatttttttgttttcttcaagtattttttctgattggattttgtattgattttcttgcagccatgatcgtaacgtacgctctccgatatttggctgaaggatcaaacgttcttgtccacttaggcgttgatgcaacttgccagcttctaggatctctcggatcagcgaacctcccatacccgcgatcgtgacagccgttatagcatcttgcggttggatcgcatctagaccatttgcaagacgtacagtgatacggtcttccaatccatctttttggacttgcttacgtgctgattcataaggaccttgaacgacttcacctgcaactgcatatttgatttttccttttagcatcaatgcaacaggtaagtatgcgtgatctgatccaatgtctgctaaacgagcagattcaggaacaaattcaccaactgccgctaagcgctgagataaatctaaatggttcatagcttcactccttctaggtaattatagcattttccatataaaataaggagactaggaataaaaaaattcccagatctccttaaaaattatacctttttgttctataaaacaacattttcttatttttgaaaaatgttgttaattatttgttcaatgaaatatcaatgatcgaatctccaggcacttgtggtgggatagacatcgtcatgatcggcatctcaactaatgtaaattggactttgtcaccgattttcagttcatctatgtccacgcttattttttcagcagtagcattcaaaatcactccgtcattgctgaatgatgtccccatattcgctggatcttctttggccatgacatcgacgagtttcagttgaatcgtttcttcttccgcttctacttgagtgatgctttcaatcgttcctacaaatatgctttgtccctccgttttcgtactgcttgtttttattgtttgacccgcatcaatcgaatcaagagaacctgtgttgctgtctgcactaccgcatcctgctaaaataaaaaatagaccaactacatatatactagaaaaaatagccctcataaaaaatcctccgtttaagtttttgcattacttgttgcggtgattgtctccggtcatttctgtccatgtaaagattcgctgacctgcttttactacttggtcaaatatcagttggacttatcaactgttcaaccattgcggcggttgcgaccagtcatttcgatttcttttgtcaaataacgtatgcgttccattatgcgttttgctttcagcggctcttcatctccacgttgagtgacggacaaatgctgttccaattcatccattgtgaaatttgatgagaagaaggtcggtagctgttcctgcatccgatattgaaggatgacgccaaatacttcatcccgtatccaactgctcatcgcgtctgcaccaatatcgtcaatcattaaaatgggggaacgcttcactgcatctagcttttctgccacttgatcttttccgattgcctgtttcatctcaacggcaaacgtcggaaagtggactaatgtcgtggtgaatccagcaatcgctagttctctcgctgttgctcctaataagtatgtttttccaataccaaaactccccaccaaataaagacctttatgatacccttttggatctgcagtatatttctctacgaaatctagggcttccaagcttgcatatcctcgtccatctgtacgctcaaagttttcaaaagatgctgattgaatatcttttggcatatccattgcttttactcggcttctaatttcttcttgtctttgccgagctaacaatgcttctgttggtacataagtgacatccacataatgaaaattcaacgtcaacttcggctcgtatcctggagcgatcatcgttggatcgtttttttgatatttacgcttttcttgcacgaactcatacaatttggcgtagcttttttcaatatccgcttgtgtcagttcttcttggtgtgcacttagaaaagcttgaacatccgtatcatttaggacgtcagcaatcatttcagcatatttttcttgataattacgtttgctgatgatcctcttcaattctttgcctacgtcttccattagatgtcaccctcctttttcgccaggtattctttaaaacggcggtcaatctctgcttttttctcactactgatctgtttttcatcttttggctggttgacccaatcaggaagcttttcccgccgaacatttcgcttgccgtttggataatttgtttgctttttttgttttgattgttttgcttgattgcttatttgccgaatatgctgaatcgcttcttctgctgtggcgattttcttttgtgcccattcatttgccactgtattcacataactagcatttaagctagcattatttttgatcaccaatacataattcagcaaaacattgatcacactgctggaaagacctgattgagaaacaaggtcttgcagtaaccaagtttcttgtttagaaacatatccgcctttttctgacttgattgcttccagatatttcatcggcggaatgctctgtgcttcttttatcaactgaagcgctgcatttgtcaaatgttcgttcgtcggagattcattgctgttttcagcaacagctactgtttcctttatttgcttcactggtcgtctctgcattgccaaaacagctttttgcagctccttcatggatactttttgttcactaaaatcataagattgactgatgagttcaccaagagttagttcatcgaatccataaagctgatgatacatgtcgacttgtttgatgattgaatcatcaagaacagtcatatgtttttttgccagccaatcattcaaaaattgccaatcgaatgtcgaatctgtttcaagtaatgctactggctcagattcttcaaaagatttattcagtgattcgatgctttcttgattagcagcgtatactgcttcattgaagcgataaacatctaaaaatttttttgtgattttttgatatccctctgttgtatgccttttaggttcaaacaactgggtaagcttctggaatcgtcgttcaccaactttttccaaaagaagaaatgccagaacagaatctttgaaaaatgctttaggaatgagtggctctaacaactcataaataaaacgaggccccagatcgctatcttctttaaaataaacatccagtaagccgattccttccagcttttttcttgcatcataaaattgagggatcccgcagcctagactactgagtaaatctgcatgcatcccttcaggaccttcaccagattcttgcgagatctctgataacagagtgaaatagatactcaaggcttctccgccgatcagtggctgataaagatacagcaacgcgttcttgctgtcttccctcagcggagcttcttttcttccttggtaaatattttttggttgaagctctttccaagcattttccaaggaaatgcctcctttttgtttcttaattgttttctttattattctctttattattctctttattattttcttttgctttatccacgatatcttgcagctcttttaagaaaacagacatatctttgaactggcgataaacactggcaaaacggatatacgcgatttcatctaaatcgactaaatcctccatcacatattcaccaatcagattcgttgatacttcgttttccccaagactgcgtacgcggttttcgacatggttgacgatttgttccatttgctccatagctacaggtcttttttctgctgagcggatgagtcctcttaaaattttatcgcgattgaattcttcgcgttccccgtttttcttgatgactaataacggagcagcttcaattcgttcaaaagtagtgaatcggaacgaacaattctcacattcgcgacggcgacggatcgcacgtccatcatctgcttgacggctgtcgattactcgtgaattattatgttgacatctgggacatctcattttgtctcacctcttgcatcgcatttttatataaaggatgtgtctttctttacaactagttgtattataacacgaaacaaatcacaaacgcgactgtcctacccaaaaaaacacggatataagaacaattttttctattttcatgcgtaattatgtcccctgtcctaattcaatttcaattttccagtactgatgaccttgattgctgagaaatgactcgcccaaaagctgatttagtcggctagcacaaaaaacttgaagcagatgaacatcttatcatctgcttcaagtcacatctctatttcttattgttttataacttctcttcgattcctgtatagtgtttcattcgttgttcctcgattttttgttcatcaggaatgtgttcactttctgggagcggtgtcttactacgatcaggtaccggattttttcgttcttgagtcaaatcttgctgtttcgcttctttttctgcctgctggtcttctatttcatcgattcttgcttggtactgcttttctttctcttctgctgtttctgattgcgtacgaccttcatcgattagattttctttattgagtatttcgccgattttttcttttgcgttacctacgactttatccttttggtttttaaatgatcccatcgctatccctcgctttctatatactcaggatagcaaacttgacacagatactcaaagaaagcgattagctgaaagccaattttcgatttgttccacaagttcctcttttgttccgttgttgtcaaacaaaatatccgcacgctgctttttttcttcgattggaagttgactgctaattctctgctgtgcttgttctagtgttagttgattacgtttcatcaagcgtctgagttgaatatctggcgtggtataaacgacagctactgcatccatatagtggtcataatgaccttcatagagcaatgggatatctacaattactaaaggatgatgggaacttagataggcgatttgatcttttatcgcttttcggataaacggatctaatagctgatcaagtttttgtcgtttctcctttgatggaaaaacaatcatcccaagtttccctcgatctagctgaccatcagactgcaatatctcttggccaaacacggacacaaccttcctcagagcaagcgttccaggctcaacagtttctctagcaatcacgtcaccatcgatcaaaggaaatccatgagactgaaagactttggctgccgtacttttgccagtagctattccgcccgtcaaacctaaaacaaagcctacttttcgattttcagcctttgacaattcggacaatagtgagtccccctttgtgccacttttattttcacgatcggtgtcccacaacgtatacatggtttgccagtttgctgatagacatgcagtgcgacttggaatccgcctgattctcctaatgcattcaaatagctgcgaatcgtggtacctccggcttctattgcacgattcaaaacatcaatgatcgatagacgtaattgttctatctcttttggacgtaatgtattcgccggttgttctggatgaatcttcgcttcccataatgcttcgtctacataaatattacctagtcccgttactagacgttgatctagcagtaaaggcttgattgctttgtgcgattttttcagtccagctgcaaaatctgctaataaaaagctgtcaggcaatggctcaggtcctaatttcatgattcctcggtaagttgcacttgctcctttttcgacaattgtcatacgaccaaattttcgtacatcgttgtagcgaagttggctcccgtcctcaaaaaagaaaagtacatgcgtatgtttatcgattggtgtattttctttcgtgaattgatattttccttccattcgcaagtgtgagatcagttcataatgatcgagatgaaaaatcaaaaacttccctctacgtccaatggattggatggtttcgccaacaagagaagcctcaaagatgggcgtctctggttgctcaatgatcttgggccacaagacctgcactttctgaatcgtttttcctactactaaccgttccaatcctttacgaacggtttctacttctggtaattctggcattttttcttttcaccttcattatattgctctgtcttaaacaatgtttattttgcttcgtaccacgtttttccccaactgctgtcagtgatcagtggtacatggagagaaacagcttgttccataacttccttcaccaatttatctaatgattcaagttctttttcaggtacctcgaagacaagttcatcatgaacttgtaacagcatcgtagcttgaagacctgtttcttttaatcgtttatccaattcaatcatcgcgattttcaaaatatcagcagcacttccttgaattggtgtattgatagctgttcgttccgcaaaagaacggatattgtaatttcttgaattgatgtctggcaaatatcgtcggcggtgatacagcgtttcgacgtagccttgatcttttgcttcgcgtacgattctttccatatattctttgacacctgggtatttttcaaagtacgtatcgatgtattgctgtgctgcttttcggctgatgcctaaattttgtgaaagtccgtaatcagagatgccatacacgataccaaaattcactgcttttgcctgccgacgcatatttggtgtgacatcctctgccttttcgattccaaatacgcgcatcgctgtgctggcatggatatcttgaccttctaggaaggcagctttcaaatgttcatcatttgagatatgcgcaagtacgcgtaactcgatttgtgaatagtcagaagaataaatcaaccagtctttttctctcggaacaaatgcctgacgtatctttctcccttcatctaatcgaatcgggatgttctgcaaattaggatcaacagagcttaatcgtcctgtttgggtcaatgtctggacataacgggtatgcacttttccatctgattggatcactttcagcagtccctcgacataggtagattgaatttttgcgatttgacgataggttaggatatcctctacgattggtgcttgttcacgaagctgttccagtacatctacggctgtggagtacccagtttttgtttttttgataacgggtaatcccattttttcaaataagatcactcctaattgctttggtgaattcaaattgaattcttcgccggcttcttcgtagattttttgttcgatctctcttaagcgagcagaaaactcgcccttcatttcttgtaagcgagtcgcatctactttgatcccgcttatttccatctctgccaaaatgatagacaatggcagttccattttccggaaaagatcttcttggtttttatctgccagttcttggctcaattttggtgttaacgcattgattgcagctacttttcgcgctaaatgagcaaaaaagagttcctcttcttctggtaaaccttttttcgcccctttgccgtatacagtttcatctgattggatatcgttgtatccgtaatgtgcagctattccttcgatatctgtgcttttttcattcgtatcgagaaggtatgcacctagcaagacatcaaaatcgattcctttcgtttttccagtatagcgatttaaagcaacataagttcgtttcgcatcatatacttttttcaatcggttcggatcagtgatccaagaatggaacgcttggttttcgaatacagacagatcattcgtgacatagattttcttttctgtcccccacgctactccgacgatttcctctatatggtaattgtcgcccatcatttccacgtacagtgccatatccgtagtaaacatttcctctttaaattcatgcacgacttcaaataaaatatcatccatttttacttcttcttcaacgatattcagtttagaaaggaactgattgaaatccatttctttataaaatggaacgagtttatcgagatttttcccttcatacttcaatgagtcgatagagacctccacaggggctgaagtattgatggtcgccaatttcttcgataagaacgcttgctctttgtcatttatcagattttctttcattttgctttgcttcatttcatcaatatgctcatagattccttcgactgagccatattgtttcaatagcttgatagctgttttttcaccgattttagtcacacctgggatattgtcagaggcatctccggctagtcccttcatgtcaataatctgttttggtatcaatccatcatatttttccgccacatgttctggtgtataactttcgatatcgctgacaccttttacagtgatatccacttttacttctttactagctaattgagtcaaatcccgatcaccggaaagtacgacgacatcaaattgatttttatctactttttctgccaaagtaccgataatatcatccgcttcataattgggcaattcgtaatactgtacacctaatcccgtcaacaaatcacggatatatggcatttgttctttgaattcgcctggtgttttagatcttcctcctttgtactccgcatacatttctgtccgaaaggtcgtttttcctgcatcgaacgcaaccagaacatgcgtcggttgctctttttgcataacattttcaaacatcgtattgaatgcatagattgcatttgtatgaagaccgtttctgtttttgaaacgttcaagggaattgtgcagcgcaaagaatgcgcgaaaagccacactgttcccatcaacgagtaataatttattttttgtcatcttcttaactccttactgtaaagttcttattcattctaacaaagaatcatgcggaatgcgaaaagaaaaagcgggaccataccaaatattttggtatagccccaactgatcaattttttccttttttagttgttccgtccaaagattcttaaaaacgccaagaacaaattgataaagtctaaatacagcttcaatgccataaatacagcaatgccactatgtgctgttccatttgtctggacatagatattacgaatgctttggttatcataagctgtgatccctgcaaagatgacgactaaaagcagtgagatgaacagctcaactgcgctacttctcaaaatgaagatgttcaagactagtgcaatgatcactccgatcaaagcagcctgtcctgctcttccgaccccgctaagatctcgttttgttgtcactccgacaacagacatccccatgaacatcaaggtagctgtcaagaaagcttgtgttactgttccaatatcgtagaatgcaagagtaactgctaatgttacgccattcaaaagagagtaggcaatgaatccaccgatcgctaagctcggattcttttgtgcttttacgcctagaaccattaccaaaatcagttcaacgatccacagacccataaagcctaatggaaagttattgataaaagttgctagttgtaaaggaaatacccaaagagccaagtaagaagtgactgcactaagggcaagccccatacctaaaaaaccataaacttttgcataaaaacgattgatgcctgacattgatgtacttggattattcatttaattcaccttcactttcgattgctatttccaattcaggaacttgtggcggttggaccataacaacagcatccaacacacgatcttcgttcgtgttttccgcttctacagaaatcgtcaccacgtccttcatcttatctacttttatgacctcaaactgaaaagtcagtgtttcataatggaaaaccggttcaataaaattgacagaaaaattgacaacatgtgatcctggtccaggaagatgctttgaaattgcacttgtgatgatccccatcagcatcactgatggaacgattggctgatgatattctgttttttgtgcaaagtcatgttggatatacaaaggatttgcatcattcgtcaatcccaaatacagcaaaagctggttatcttcaatagattctgttaaagataacgagtcgccttcctcgatttcatttattgtttttcctagttttctcggcttacctatgttcaagatagaaaccctccagtttatttttaatcatacattattgtaccaaaagcagcgcaaaaggcaagttttgctcctttaatttaacagatttctatagtttaaagaggtcgttaaaaagctgtcctgcatcaagtaataagaacagccaagaaaaaacagcttctcatgtttttgatttggctaggcttattaccgcagatgcaagcttttgaacgccgtttatcaaaagttgtaaaaaagggagcatgacaagaattttgccactctccctctttctatttttataaggacactgcagtaattgtattacagtacatttttcgtcgtgctgcttaaaagtttttcatacgcttgttcaaatttttgaacatctccagcacccatgaagattactactgcatcatgataatctaataatggagatacattattttctttgatgacttctccaccttttttgattttcgctccaaggtcttcgatcttaacgtttccttgttcttcccgagccgaaccaaaaatatcgcataagtaaactttatcagctaaatcaagtgcttctgcaaattcatccatcaatgcaatcgtacgcgtaaacgtatgaggttggaaaactgcaattatttctttatctggatatttttggcgtgcaccatcaatggttgctttgatttctgcagggtgatgcgcataatcatcgactacggtcatgtctgctacgattttttcactgaatcgacgttttactcctgggaaagtcagcatttcttccgcaacttctttcagatccagtttttcgaaatacgcgactgcaataacacctaaagcatttaaaatattgtgtttgccgaatgccggtacagtgaaatgtccaacaaattcatccccatgatagacatcaaaagcagaaccggatgttgtacgttcgatgtttcgtgcttggatatcatcattttctgtgacaccataataataaatcggcacatctgcttctaatttgcgtaaataagcgtcgtcaccgtacgcaaaaatagcttttttcacttgtccagccattgtttggaaagctgtaaatacatcgtcgatacttgtataataatccggatgatcaaaatcgatgtttgtcatgatcgcatagtctggtgaataggcaaggaaatgacggcgatattcacaggcttcaaatgaaaagaattccgcttgcggatcaccatgccctgttccgtctccaattagataacttgttggacgaacaccactcaatacatgagagagcagaccagtcgtacttgtttttccgtgagaaccggttacagcgatactcgtatagttttggataaaatgaccaataaagtcgtgatagcgaatcacttccaaacctaattcttttgctcgctggatttcttcatgtgaatcaggaaatgcatttcctgcaataatcgtcatacctggttttacattgtctgcgttaaatggcagaatcgtgatatttgctttttctaaatctctttgtgtaaagaaatatttttcaatgtctgatccttggacatttaaaccttgttcatgtaaaacaagagccaaggagctcattcctgaacctttgataccaacaaaatgatacaatttattttgattttccatttgaatcctcttctcttatctagcgtccattcttttagctattacattcaacacgctcctcattatcttataaacgattgaaaatttcaaccaaatttatttagaaagggggattcgcctgctaaaaaggtcatgtacgggaaaaatccgtttttattgactgtttgattcttgtataagaagaccaaacttcttctgatatatcaatatgaggaataaaatcttttcctttcggaccatagccattctcatcgtcgtggagtcgctccatttctcctaacaccagtgcatagaaatattccttcggccattgatggttcagttcttttactgtaaagacgatctcctcagaaaagtgaaggatttccggcacaaatggcacagcatttgcgaaaacagtttgttcattttgccatactttctcaaaagttgctcgagtcctgcgttgcagtgtcggatcattcatcaataggactttttctggtacagcatctaaggaatgaagaatctccagtgaaaaagtggcgttctctccagaatttgtagacttcgattctatcaggaaagccttatcgggcaaatcatagacttcttttagatactgacgacagatttcactttcactcatgccttcttcaaaatgaaatccttgcttttcaaaattctcataaaggatcctagtcgcatgacccaccccgccgaccaaaaacaaacgttctacttgaccatttacatacatttgtgctgctttatcagctaagataggaagaccgtttccagctaaaataagtgtaggtgccgacaatttctcaaaatctttctcatcaggtgcggctaaaaaggctaataactgattccagtcttttagatttctctgctcgtttttttccaaaaactcttcatcctttcatttgattttttatacttcattgaggctttctctctttgtctcaatccatttgatttccccatgacatcttccacaacgatatttgtgtacatcgattcttcttttgcggcagatcgtggcagaacaatcttggcattgataatattcgatctttatctgtttcttcgtcaaggctggcgcatagcgcaatcctcctgtttttttcaaaagatacttgaaatccatatctttatgacgatatcctcttccagttagatgcagatgataatggcaaagttcatgtttgatgattcctgcaattgtttctttgtctgactcttcaaacagctttacattaaaatctaaatgatgatcgtttaaatgatagcgcccgccagttgtacgcaagcgtggattgaacattgcttggtgcttgaaaggacgctggaagctttttaatgatatctcttctactaactgctgcagttcttcttgtgtcaatttttgttactcctcattgttactcttcataaggggaaagcatcgtcaaactgattctgccttttttcgtatcaacttgctctatccaaaccgtcacgatatctccgactgacacgacgtctgttggatgcttgacaaattttttgctaagttttgagatatggacaagtccgtcttgtttcacaccgatatcgacaaatgcgccgaagtcgatgacgttacggaccgttccagtcaattccatacctggtttcaaatcttccatactcaacacatctgtacgcaataggggcgctggcatctcatcacgcatatctcgtccaggttttgtcagcccagctaaaatatcggctaacgtttcttctccgactgataagctttcagccagtttctccgcggataaccgtgtcaatttttctactgcttcttctgtcccaagctctttttctgaaagatggacggtcattaatatgtctttcgcaatagaataactttcgggatggataccggtgttgtccaaaatgtttttcccgccaggaactcgcaagaagccgattgcttgttcatatgcttttggtcctaaacgtggcacttttttcagctgatttcgtgcagtaaattctccattttcttcacgataactgacaatgttttgggcagtcgttttattcaatcctgatatatgctgcaagagctgtggactagccgtgttcacatccacgcctacttggttgaccgctgtttccacgacaaaatccaattgttcagtcaaacgtttttgagaaacatcatgttggtactgtcctacaccgacagctttaggatcgatcttgactaattcagctaaaggatcttgcagacgacgggcaatagaaacagcacttctttcttctacttgtagatgcgggaattcttttcgtgcaatttcgctagcagagtaaacagaagcgccagcttcattgacaatggcataataggctttatggtcagctgatttcaattgttcagccacaaaaagttctgattcccgactggctgttccattcccgatagctaccatatctacttgatattgattgatcaattggataaaagctggaccagcagcttcccttttcgcttgtgctgcaggtttatgcggataaatgacttcgattgccaaaacttttcctgtcgcatctacgactgctagtttacatccagtacgataggccggatcaaatcccagtacgactttaccttttagcggcggttgcaacaaaagattgcgaagattttctccaaaaatagcgatggcttgctcatccgccttttcagtcaattcattacgcagttctcgctcgattgccggctgtataaagcgtttataactatcttgataagcttctcttacaaaggaagaagaaggtgaggcaggatttttcactaattggcgatccaagtaagctaaaactgctgcttcgtctacttgaaggaatactttgagaacctcttctttttctcctcgattagtggccaatatccgatgagaaaccattttatggacaggttctgcaaagtcataatacatttcatatacgcctttttcatctgttttctcatccttgacttggctgacatacatgcctttgttatacgtataagaccgaatccaagtccgaaactttgcattatcgctgacttgttcagcaatgatctcatgcgcaccttgcaacgcttcttcagcagaagagacttctttttctttatcgatatatttttctgcttccgtttgcacctctccatctgtaagctgcatcagccacagcgcgagtggctcaagtcctttttctttagcaatcgttgcttttgtccgccgtttctgtttgtatggccgatataaatcttccacttgttgcatttttacggattgcgtgatttctgtttctaactcaggggtcagtttcccttgttcatcgatcagccgaatcacttcgttttttcgtttttctaagttttcaagatatgcataccgctcttcgatttcacgaatctggacttcatcaagacttcccgtcatttcttttcgataacgcgcgataaaaggaacggtgtttccttcatttaacaaattaagtacagtcgtcaactgcttgggacgatagtctgaaagctctttttgtacaagctgaatgattgtctggttcaaattttccgtcattaaaatgcctcttttctgctaaaaattgcttctttattctatcatactttttatcatgggttaaactgctgaaagaaacaatattatctatacaaataaaaagagccgcaacaaagtcgcagctccttcattctttccatttgtcagattccttgccaagatccttcgttgttctgatattcaatgtcttgaaggatgccttccttgtcaaaaacaaccccatgcaatgaccctccgaatacagccccaccgtccattccgattttatgatcctgaatccagagatctgttgtctgcatatctccatggagcattggtgtaatcgtatgtccaaatacaattgtcttacctgtattgtttttcccttcatgaaatggttcccgtatccaaataaaatcgcttggacttgtcttacgccagtctttctttgtcaaatccactccagcatggacaaacagataattttcccattcataatacaaggggcgctggactaaaaattcaatcagttctgggtatctcgatcggatcatcattgagatttcagtcggggagtattcctccgacgcacctgggtgaagtaggctttcaaatgtttcttttccaccatttctgatataaggcgcataccagtcctccggtgcttgcagaaattgcaaaaaatattcttcatggttgccccggagataaatggctcctgtttcttcgactaattgttttcctaataaaaaacattcctttgtacgaggtcctcgatcattgagatctcctaataaaacaagctgatggatcgtcggatcataatagtgaataagtttttcaaaaagatcatatttaccatggacatcgccaatagcataaatcaatgatttcatgtggatcaccatcctcaacgatagtatagcgcatattggaaatggtcgacaatcaaaactattgttttctatttatttaaagctgcaaaccgcagttctgcttcttctggagagattccatggtcttgaacatagcggttgcgtggatgtttcgcacactctacgctacatgctcctaaatgtttttcttcattttcaatggaagcaagaatctggcgattgcactcaggattgctacaattgatatatcgttcacatggtgttccgtcaaaccagtcgcgaccgacgatttgtttatctacttggttgatatcgacagcgattcgttcatcaaacacatacatcttgccgtcccataattctccttggacttcaggatccttaccataagtagcaataccgccatgcagctgtccgacatctttgaatccttcacggacaagccaaccagaaaacttctcgcaacgaataccaccagtacagtaggtcactacccgtttttccataaattcttctttgtgctcgcgaatccagtctggaagctctcgaaaactgcgtatatctgggcgtacggcccctcgaaaatgccccaagtcatattcataatcattccgtgcatcaatcaccactgtctgttcgtctaaaatagcttctttaaattcttgcggtgaaagataagcacctgtcacttggtttggatcaatgtcctcttctagctttaaacttacaagctctggacggtatcttacaaacatcttcttaaaggcatgtccttcgcttggatcaatcttgaacatcgtatcagcaaatcgaggatcagctttcattgcttccatataggcagtcgtgttttcaacggttccagacacagtaccatttattccttcttcagctactagaatacgacctttaagatccaaagatttgcaaaaggctaaatgatttttggcaaattcctctggttcttctatttttgtataattgtaataaagcagtacttgataatccatgtatttcttccttccttcttttcgttcctaaacagtataaagaaggcgttcgcatttgacgatttatttgcttgtgtataattacgcatgtgatttttttgtttacataatattattatttgaattaaaaaaacttcgctttcctgttttgcacagaaaaacaaagtctttgtttctattatttacctgtaaccgcaaagtaattgccatcaggatcagcaaagttgaagacatattcttctccaagctgtaccatatcacctaatgtgactgattgcgtctgcatttttttatataatccaaagatatctttgctgtaaaacatcaaagatggggcactagtagctgtaccaggtgaatgggactcaacaaacgctcgatcatataacacgaatgaggtttgactgtcctcaatccctacttcaattacaagcgtcccatccatttcttgacgatctttttccgcaaagccaattgctctccaaaacgctgcatttttttctacatcgtccacatacagcatgatttttatttcatttgtaaacatctgtttcctcctaaacgatctgttctaacatccccaactttgtcagtttaccataggaaaatgggaaaatctacgaaagctctcaacagattcatcctacttaaatacgtttctctttaataataaattaagttggttgtttttgttattcaggctttcacttttcggaataaatattttgtacttatatggaatgaataaaaaaacatactaagagaggagaacatcatttatcaatgatgttcccctctaatcttagtatgtttttaactatgcattcacatcgatcacttttgaatcatcattgatgacatcgcgatctaaatctttgatgcgtgcacttgtcacgataccagctaccatgctaccgctgacgtttactgctgtgcgtgccatatcgattaatggttcaacagagataactaacccaacgattgctactggcaagttcattgcccctaaaacgatcagtgaagcaaatgttgcaccaccgccgactccggctacaccaaaagagctgattgttacaatcgccacaagcatcaaaataaattccaaactaaagacattcactccagccgctggtgcgacgatcgttgccaacatagctggataaacaccagcacagccgttttgtccaatagataaaccaaaacttgctgagaagttagctgttgcatcgtctactcctaaagcttttgtctgagtctcgatgttcaatggcaaggctccggcacttgaacgtgaagtaaacgcaaagctcaatactggaaaagcttttttgaaatagttgattggattgactttggcaccaatcaaaatcagtgagtggacaattaaaacagccagcaatgctacgtaagatgcaacgacaaatttacctaaattgacgatagctgcaaaatcacttgttgccaaaacgtttgtcatcaaagcaaataccccatatggtgtcaaacgcagaacaagcgtcacgatccgcataatgattttatacagactgtcgactagatctgaaaagaatgctgcttcttttggcgcttttcttttcacccctagataagcgataccgacaaaggctgcaaaaataacgactccaatcgtactagttgcacggctacctgctaaatcagcaaatacgtttttagggataaaggataaaatctgctgcggaatcgataagttttcaactgtttcctgacgtgtcgccaattcagagatccgtgctgtttctgctgctccttgtgtgaatttagctccttgaagaccgaacagcatcgttgaaccgattccgatcaatgctgcaatagctgttgtaccaagtaaagaagtcagtacagttgcactgattttccccagcttttcagaaactttcatttttgtgaatgcaccaatgatcgaaatgaacactagaggcataactagcatttgcaagaatgatacatacccttgtcctacgatcccgatccattccattgattgagtaacgactttgtcttctaccccaaagatcaattgaagcagaccgccaaagacgataccaactcctaatgctgtaaagacgcgtgttgaaaattttgtatggcgcttttgcatacgatagaacacatataataatgccgcaaaaactagaaccactaaaactgtgatgagtgttgtcatttttctcctcctcatattattaatgacaagtccatcgaaggaagtaaaggttcccgagaatgattcttcaaccatcctcctgaaaaatttttttcagtgacttttatattttagacgatttttatcgaaatgacattctttttgcttacaattagtaataaaaaaacatgcctgtgatagattaaaactatcgcaggcatgtttttactgtctattcttgtttttctgattgaaaattcaattttaccccaggctgatccaaggcgatctctgtcacctcataagacatccggcgtacgatatcgaataaaggtgctactagttcgtccacttcttcttgtgtgacatcattttgaccttcaattttccgattgaggatatgattgatctgactcacacttccagataaaacatatgtatcaaacactaaacggaactctaagcgtgctcccacgatgctatgttctttcggatagttttcgatcgtttctttcaaaggcgagaagcccactttcaaatctgtttctacttcttggttcggtaatctcatatcataatgaaatgcttctactacttctttttgtcttctgatttccatataattttatcactcctttataaaaattataacatatctcctttgtaaggggatactatttttttacgttactctgcaaggataggatttcattcaaatttcctaccacataatctgcaggaatctctcccagaaaatgatcgatatcgtaaagacaagtaacgactcctgcgtttttccctgcttcaatatctaaacggcgatcgccgatcatcatcgtgtctgttctttctaaatgaaaagtctcaatcaaatactttaaagatgctggatccggtttacgaggaaaatcctgatcaatccctactacttcctcaatcagatgggctaattgatactctttcagcagttcccatgtcgattctgtcaaacggtgggtcaagatgaagtgacgtcctccattgatttttagcctttcaagtacttgtttcgtttctggaaatggacgggaagcttccttgctttttttctcataccgatgaaaccattcattaaactcattggcgtccaaatttgattcattgatcaaataactggtggaatattttttcattttgaagtagatctcttttttgtccatattgataccaaaatcttttagagcttgctgagcaccatctaccattgcgggatacgtatcaaacaatgtcccatcaaagtcccatatataatttctcacgttttttgttccattcctttgcttcttttttctatctttcattatagataaatacgttgattaaagtattgttttctctagaatcgtcaaatcgtctgttaatgtatattggattggttgtgcgttcgggatatcaattgtatccatttgatcctcaggaacattttctaaatattttgtcagtgctcggatgctattcccatgacccacaactagtaaatctttccgatctttcagttttggtgctagttgatcttgccacaaaggaatgatccgattcactgtcatttctagactttctccgtacggaatcaaatgtggatccaaatgatcatatctgcggtcaaatcggttttctgcggttagcggcggaacttctgtatatcctctgcgccatttctttacttgatcttttccgtatatttctttcatctgatccttgtttttaccaacaagatccccatagtgccgttcattcagacgccatgtttttactataggaagccacaactgccccatttcttctagtgcgacttgaccggtaagaatcgcgcgttttaaaacagaggtgtaaaccgcatcgaattgaagaccggcttcatacattttttgaccggctactgctgcttgttcttttcctttttctgttaaggcgacatctagccaccctgtccagtaattttcaaaatttgcttcgctttcgccatgacgcaataatactaatttcatttttttctcccttaaacattcgtttcgaattttatgccacatgttttgcatgtcacgcgtattcgtccttttcctctaggcgcacgctgcttttgatgacaattcgggcactcaaaaaaagtatagctttttcgttccgttttagcttgctttttgtttctcatctgatgatatttttctttgactttatcaaaatattccaaataacgttgattttcatttagtctaggatagattttttttgatagaaaacgaaatagcatccatccgaaaaagacgatgaacaacaattgcccgattctaaatggcaaccaccgacttagtaaactaaaaaaaagtgcgataatcaatagaacccgattcaattgatcaaattttgcatatcttccctgcataagtttttgatagttctgctgaaaccgtatcagtctttctaaccatgtttgcatcctattatctcctccatcatctatcattcattatgacaaaaaaaacaaaaaagaaaaagccttaattggccttttccattgcgacttgatgaaggacattccgatttctggtaaagtcgatcacaatcactttctttttatcttctctgttgactacacggaatgtgtccgtcaatggcaaaaacagcttcttagatggtagctgttgcatacgtataaatcgatggatcatcgtaatcaattgagggaattgaatggacgtatgaagcagatttggatattttttcaacagttgagtcgttttgatcaaattccgttttttactgattacttttaaaaagctttttagaatcttttgctgacgtctaaaaatagaaaaagaattttcatcatctatttgataacgcatttgtttctgtagttctgctgcagtcaaatgaatcttcccatcattcgtatcgatcatcaaaccttctgggaatagctcaacgactgctcgatcccaggattcaagagaaagctcgatataatcttttaccggtaattccaattctgcctcaaaaaagtgcaaaacagccgatagtccttctgcttgataaatttctcctaatgttagtccctctagatggaactctggtgaaaaatgcagcaatgttttattttcctgcaattgaacatatagaaatgtagaccgctcaatcagagtatcttttaaaacaactaaaaaattcatttttctcccccttttttcatcatttttaaaatagcatattttgaaaagaatgtctgatgcttagagaagaatttcataaaaatttactatttcataagtattcacgaaaaaaacctaaacaaaaaagcggaaataacgttcatccgccttcttatttaggtatattttttcttcaaatgcttgtctatgattcaggactttctctatcgttagtttcatccaaaagttcctgcatcccgataatttcccgatactgatgaatcttagtgataccaattactttatctacatcaatactaaaacaaatcccgttacctggaacatcgatgttgatgccttgaccaatcgcatccatcacttgattcgtcaaactatctggtactaatgtcaaaacaacatctttttctggcgagatgtccaaacctaaaaatttccctgaatcatgtacaccagaaccacgaccatgcaagattgtaccgccagctgcacctgcttcttttgaaaagtcgatgacatcttcacctgttcctccgtccacgatcgtcacaatcatgtgaagattcaatgctacaagatctttcatttgcttccccccaatttttgcaatctttctttttcgattctgtctttttcatcttttcgtttataaatatatcctagtactaaagtggataatattggtgtcaatgcaatcattgcaaccacaccaaacccatcaatgatcggatctcttccctcaatttgtgcagcgatcgccacgctcattgataaaataaatgtcgaacacatcggacccgttgctactccaccgttgtcaaaagccattgctaaaaagatcttgtccacttttcgtcctaaaataaatgctagcccatatcctggaatcaagaaataataaagagagaatccgacgagcaaacgccacatagacaatcctactgctgcgccaatcccaatcgaaattaccatcagcatgactttcgaccggatcctcccttcactcaattcttcaacctgtttgaccattacatgaatcgccggctcagcaaaccctactaggaaccccatcaaaaagccaagtggaaccaatatataattatagggcaatccagcgatcgtactacctaaatgctgtcctaccggaacgtaagccatattgactccgtgcaggaaaatgatcaacccaatagtcgttatcaagaagcctttcataatgtcaaagaaacgcttcttgcgcatacgaaaactaatgatattcatcaaaacaaatagaatcacgataggtgccactgctaaaataacttccatagtaacgatctcgataccatctatcacttgctgccagaaattcattggaagatcacccccaaaatcattacggcaagaattggtcctaatgaagcaataccaaccattccaaagctgtcattttcatttttcttttgtttgatcatactagtcatccctccggcaagggccaagataaatgggacagttactggaccagtagtcactccccccgaatcaaaagcaatcggcatgaattcggaactggtgaagaacgaggcgatcaaaacgcctatgtagcctatagccatcaattgataataggatagcttgaatacgacccgaagcagcgcaaaggctagaaatactccagtgccgacgctgacgatcccaatcagcaacactctgccaatctctccgtcagatatatcatatacttgttgtcccaaaacttgcacggaaggttcggcaatcgtgatcacgatcccgatagcaaaccccaaactgaccaaaacagccaaacttttctttttgatcatatatttccctactagatctccgacttccatcatggaatagtctgccccaaacaaaaagagcgtcattccgatcatcatgatagccgcacctaccaagaatgaagcgaggtcttctccttctaacggcgcaaaaacaaacgttaaaatgacaatcaggacggtcatcggcaatatggcagcaatcacttctttaaaattttttagcatgtatcctcctcctttactctttaagtttaccttaaaatgaaagagttttcgagtataaacttaaaacgttatcttttaatttttctcaacataaaataacacacgtcccaaaagtatctttttacttggaaaagatgactttgtagggacgcacttgctgttgttttttattttacagagccgatcattccttgaacgaattgcttttgcaaaacaaaaaatacgatggcagttggtaaagtagcaatgactaatccagccatgatcattccataatctggcgtataggaagcacccatagcagataaaacaagcggaaccgtccgtttatcaggagattgcaaagccactaagggccataaataattgttccaactgctcatgaatgtgatgattgctgccgctgcataggtatttttagccgtcggcatatatactctaaaaaaaatacttagttcttttagaccgtctaatcgagcggcttctactagatcttttggaaaggatttaacattttgtcggaagaagaagatcaaaaaagcagtgctgacagatggtaagattacaactaagaaactattgattcccaaaatcgttccgttcaattgtgaaaacattcgatacaaaggaatcatcaacgccgcaaaaggaaccatcatcgatagcagtagaatattgaaaatcaagtcttttcgcttgctttgataaatctcaaacccatatcctgccattgaggaaatcagcaatgcaaacacagtggtcactaaagcgatcattgctgaattccaaagggaacgagtaaaattcagttcattggaaaacaaattttgaaaattgatgatcaagttactgccaatctttatttttcccgatgtgatatccacgggtgtattcgtcattcccagaatcatccagacaaaagggaaaatggaaataaatgataggatgcttaatgctgtatactttaatgctgacccaattgccgaacgaagtcctaaggcttgttttttgacgttgggatgttcgatcggttctttttctaccatgcttttcatcgactctctcctcctactttcgtttggattatcgacaatatcacaataaaggcaacaataacaaaggaaactgctgccgcatatccaaaattaggcgtgaatttataacacaaattatagatgtattgagacaaggtggtcgttgcatttgctggacccccgccagtaatattttgtacttcatcaaaaagctgcaatgtcccgatcgtcgaagtaatggaagtaaacaaaatgatcggttttaaattcgggatcgtcactttgataaactgctgccatttagaagcaccgtcaatagatgctgcttcataaatctccgaatcaatattttgcatgcctgaaaggaaaaaaatcatattgtatccagtccaacgccaagtgatcgaaagaatgatcagaactttcgcccaaattggatgagtcagccagccaatcggtgtatcaatcataccaatgcccaacaacaagttgtttacaaggccagattgagaaaatagacttttcatgatcagagaataactgaccatcgaagtgatacacggaagaaaaatagctgttcgaaacaaccctttatatttcagctttttatcatttaagaggttggaaataaaaagcgctagaaacagcatgattggtacttgaactagtaaatataggaacgtattgaaaaaagcttttttaaaagtagcatctgtcagcatccgctgataattacctaatccgttaaatctcatattgacagggggaccactttgaaaagacgtgatcaaagccaaaaccatcggaataaaaaccatgatcgatatcaaaatgactggcaagattaaaaaagcatgcccgtttttgaataaatctttctgcttcattcttttccctccaattctatcattgattatttaattgaaaagacaagaaagacaacgtctgtaaggcagccgccatcttttttgtcttttcggttgtctgatgaaaaagcaaagaaatttgcttttttatcaccaatcaattagccaactgtgcttctacttgtttttgtgtatctgctagtaccttgtctgtctcttctccattgatgattcgatgaagagcttcggctacgactgcttcaattgcataggtctcatgtccgtaattcacttctggaatttctgatgtccatttggaaaaatcatcaaagaccttttggccactgtaaaattctgaagcttcttgataagcttcttgttcatttgcactaagcatcgtagacaccagtccgatttctttcgcaagagtgcccatcagttcttcattcgatgcaaacgttgcttcgaggaaatctttcgctgattcttctccagctactcctttgagcacataccagccagcgccgccaaggttagaagcttgcgctttttgtaaactttctggcagtgcaggtattggcgcaatcttccattttccagattggtcttctgctccttggatcgttgaagaataccaagcgccagttgggctagaagctactgctcctgattgtatcgcagttactccagcattccagtcagaggtttgttcgactaggtcttctttcaaaagagtggcaaataattcaagaccatactttaaagatgcattgtcttggatcgtgaccgtctccccatctttggacgtataccattctcccgcttgttgcatcatcattcttactcgaccaagatcagaaggattgacttcagcgattttctttcccgtcttttctttgacatctcgcgccacttgaatatactcgtcccacctcagattctccatgtcctcttctgtatatcctgcttcagccatcagatccgtacgatagaagtttgctgttacgcccgaatcgaaaggaacaccgtatattttttctcctactttgtttaccgcaaatttatacggtgcaaaatgatcttcctttacaatagcagacaaatcagcgaatgcatctggataagaagtcaaatagccttgtatcctataatcttcaatcaagacgatattgggcaatccttctgtattcccgcttgctaaagcggtgttcagtttctgaacgatatcatcctgagacatcgtaacaacttctatctctgtttcttcgttctcataaattttttttgcttcattcactgctttgatattgaatgtctcatcccacgcccaaacagtgactttttcttcgttgtctgctgtgctactaacacttccgcatcctgttaagaaacctgatgctgccgctaaacaaacgactccagcaattaactttctgatgttcatttttatccgctccttttccatccattagttgtttacgtttgctacattcatcataccaaaatttgaaaacggtttctttattattcagatacttcaaaaatttctcctaaaataataaaaaaatacaaatcaactatgacaaaaggaataatcttagcatctagaccaaagatcgaaagggtggaggtttctttaaaataaaaatatccttgcattttctcctagaaataagtatttttaaattacaagactatttttaaggcgggtaaaaaaatgccaatacgcgtaattcttatcgatgatgaacagacgattttagacggaatgaaacagttgatcaattggtctgagcacgggtttcaattaataggaactttttccagcccgttgaaagcgcttgacttttctttggcacatgcaatcgatatcgtggtcacagatgtaatgatgcctgaactaaatgggatcgaattatcgcggctattaaaacagcaacaacctgaaacacagattcttatcctctctagctatgatgaatttgatatggttaaagattctttcaaatatggcgtcgctgattatcttttaaagcctcgattgagtcctgatttttttctaaattccttaattgccgtttcacaaaaaatcaaaaaaaagcccaacaaaagcccaatcaccgatcgtaatgagcagatctgcgagaatctttcacagcagattgctggacaaactcgtccattgcttgaccctcttctttttgaacacaccttgttttttctggtatataccgaaaaacggccattcagttcaaaacaaggctctaaacaaaaacagtcgatcatccattcgttgatggatagcgacgattcatttactatttatcccttttctaccttttcggaagaatccggctatgtgatcaatactgattccaaagatacgcttaggaagtttgttcaaaagtttcgtcaagaaatttttccaggtgatttttttgttgtttctgactcttttgcaatccaagatatcaatgaaatattccaagaaatcagaaattgtaccaaaggacaacgtttctatcataagggaaagaaccttgcttatcagcatgaacttcttccgttatcaaccaaccacgagcagcaagcaagtagctatttaacaaaaatcgttcataaagactacgctttagctgtcaaagaacttgagggtttcttcacgaaaatattggaacagcctattgatccagcttatttgaaacatgaggcaatcaatcgtttctatgcattactcaatgctttggctgacgaatatgttgggaatgaagaactttctttgctcaagatcgcccttccttctttattagccgatgctgagtacttggaagatttttctattcttgtcaaagaaacacttgagaaactcacccacttttctgcaaatgcaataaaagacaatttcgatatcttgactttgatctacgagttcgtccaggaaaattatgagaaagaaatcaatttacaacttctatccgaaaaatatcatttttcatatagctatctttcagctatctttactgaaaaatttggcatcaacttttcaaaatatctaaaaaaagtccgtattagtaaagccaagctctttttaacggaaacacggcttactttgacggaaatctgtgagaaagtcggctataccgaactgggttatttctccagagtttttaaagaagagacaggaatgacaccttctcaataccgtaaaggaacttttgtaaaatgagaaaaaaaaatcaaagagcatgaactctttaccaaacttctgttcattttgttcatcggtctttttctgcaggccatcgtcatctctttgtttatttatcatcgatcaagggatgcctatatccagctgttcaatcaatcgaatgatgtggtactaaaaaagatccaatctgaatttgaaggcttgaatgatgcaatcgagaatacattagccgcttttgattccaacccagctgtcgaaagctatttttccaatggtccagtccaacatatggaacagcttcagcagctaagaacgatccaaaaaatgaatgactctctttcaaaaatccatccaatgatcgattacgatgtgttgatctttggagaaaacggaagaacttttgtcggaaacgacatgctcactgccgtatctgccgattctttttttcaatctgcgattgcccagagagtgaatgaacgtgctgctgatacacaaatgctttttgcacaatacggattgactcttcgcgataagaaagcacccagcgtcttctttgtcaaaaaactgaaaaacacattgaatcacatttacggatatgctgttttatcgatctcatctcagcaactagcgaatctttttcaatctgtagtaaatcctgagatatcgaagatctccttcatgaacgaagaacagacgatcatcgcatcaaatgaagaaaatagaattgggagccgatcaatgattttcaaaaaactaacagtaggtgaaacaacgatttcaaatggacagcagttgacccgtcttcccctgtaccgccaggattgtacattactcagtcaagtcgatcttcattctttgtctaaccaaatggacgtgattttccccattattttgtataatatcgtgacacttgcttttgctggctcattggcatttatgtatttggatcgacacacaaaatcgatctaccgcttgattgattcgctaaactggctagaggaagatggcttaaaagctactgttcctgtacaaggaagccatgaagtccaattgctagggaatacgatcaatcaattgctaagtaatgcgcagcatcattatgaacagaccatccaagacgaaaagaagaaacgttcgcttgaaatccaaactatgcaagcacagatacagccccatttcatttataatacgctgactagcttgaaatttttgatttggcagaaaaaaacagatgaagcagttcagggaatcgacagtttcattactttactaagaagtacgattggaaaaaaagaagaagtgattccagtcaaggaagaaatcaaaagcgtacaaagttacattgatcttttgagtatgcgatatggcgaaagaatctcggctaaaataatgattcctgatgaactgcagacattatctatgccgaatatgatccttcaaccaattatcgaaaacgcctatcttcatgcttttcacaataaaacgcaaggattcatcacggtgtacggcaaaacaaaaaatcagcttcttttattcgaagtgattgataacggcgatggcttcgatactgaaaataccaaacaaaaaaatgatcatttctcaggaatcggcatcagtcatgtagatgagcggatacgcctaatgtatggagatgcatatggcataacgatccaatcagtgattgggacaggaacgactgtaacgatttgtctcccgcttctttttaaaaatcaatcagaatattaaaaataaagaatagccaagcgctgattgatttattttaagttaaataaatcaatcagtattcttgactttcatctacgcgtctattctactgtcaatactggataacagcccaatatttgactttttcctccgagcatcttgatttcttggagcgcattctctactaatgccattgggcggtccaataacaaatcgattacgaaaaaatattctcccaagctagttttcaatggtcgagattcaatcttacttaagttgatctcccgccagccaaaagctgccagcattttatgaagcatccctggccgattagcaggcagtgtcaagatgacactcatctttactggagctggctgctggctggtcatctttcggtcaccgacgatccaaaaacgtgtctggttcaactcattatcttggatattctcagctaagatctccaatccaacgtgctgtgctgtttctaatgaagcaatcgctgctgcgtcttctttcggatgttctgctacatacattgctgcagcagttgttgattctgttgctactaaaggaacattaggataatgcgtttctaaaaactgttgtgattgtgctagtgcttggggatgagaaaggatttttgtaatctttgttgctgcattgcctaaaagctgctgcttgataggaagaacgatttcacttttaacttcgacttctggatgtttggaaagaagatcgattgtgtgatgaacagatccttccaatgaattctctacaggaacgacagccagatccacctgtttgcgaaacaaagcgcgcaaacaagcaggaatcgaagcatacgcagtcaattgttctgtaggaaatagctggcaagccgcctgataagtgaacgaactttctggccctagatagctgacattcatatgcttttgatcctctctataatggtatcgatgatcttttctggtgtttcattggtcgtgttgattcgaagtgtcgcgctctcttcataccaggaaagtcgttgtgccaataaggcttttatttcttctcttgtttttccaagagctaacggtcgaatagacgttttatcttgttggatacgatcgattagacaatctgcttctgcctctaagtaaagaacaattggctgtgtttgtaaaaattgccgattggcagcacattggatgattcctccaccagtcgcgataattttatcttcatttgacagctttcttaaaacctttgactccacttttcgaaagctgttttcaccgtaatagtgaaaatattcggcaatcgacaattggatatgttcctcaatctttgtatctaaatctacatactctttttgtaaacgttgagctaaccctttaccgatcgttgtttttccagcgcccatgaaaccaatcagcaaaatgctagccatgagcttctcctcctgacacaagttctgctaaatcatcgaaaaatgccggataagagattgaaacggcttcggctccttctagttcgcaaggtccatcagctatcaaagcagcaacttgcagcatcatcccgattcgatgatcgcctctgctagaaacttttgcgccatgcagaggtgttggtccatggatgatcaaaccatctgctgttgcttttatctttgctcccattttttgcaattcttctgccaccgcatcaattctgttggtttcttttacttttaattcttctgcgtctttaatgatcgtgattccttctgcttgagtagccactaaagctagaattggcagttcatcaatcagacgcggaatgatttctccaccaatcgtcgctttcttcaaatgactcgtcttgacacttaaatcagccgattggttctgtttattgtgattcgtctgggtaatcgctgcgcccatctcctccaacacatctaagatacctgtccttgttggattgaccccgacattttttaacaacagctggctttccggaacaagaagtcctgctgctagaaagaaagcagctgatgaaatatcacctggaacagtgatctgctgaccggttaatttttgcggtcctgtcaccatgattgttttatcttccactgtgatccttccaccaaattgacgaatcatttcttccgtatggttacgggaacgttctttctcaacgattacggatgtaccttctgcttgtagtgccgcaaacagcaaagcagatttgacctgtgcactagctacaggcatattgtatcggataggtgataaagagcgggttcctgtcacagtgattggtaaacactggtcattttcatttccttgcaagtcagcacccatctcgcgtaaaggctccattactcgccccattggacgtttagacaacgaagcgtcaccgaacagagtcgttgtaaaaggctgaccagccaaaatacccatcaataaacgactcgtcgtaccggagtttcccatgtcgatgggttcagttggtgggacaaaggagtggctaccgcgaccatgaatcttgatcacctcttcctcttcttcgatttcgacgcctaattgttggaaggcatgtaaagtactcagacaatcttctgcgcgcaaaaaattttgtatagtcgtcgttccctcagcaattgctccaaacatgatgctgcgatgagaaatcgatttatctgctggtatcctaacagtccctcttaatccatgtatttgttgtaataatcgcatttatccagcctcctatttgatccagcaatgataactggtattagacataatggttctttttgcttgtaacaaatcctgttgatttttgaaactgatttgcagtatccctaaaatatcttctcgcgtctcttggatcttcaaattaatcaaagaaactcccgcttttccgatcagtccagttacttctgcaataacgccaggctcatctggcacatcgataaataaatcaaaaaaggcagggattgcgccttgcttatggataggcaactggtctcgactttcttttgcccgattgaaaaaagaaaagatttccgattggttctcagtcatgatccattctgctatttgtgtcatttcttgctgccaatctgccaatcgttccaataatatctgcttattgctcaacaaaatatctgtccacatgacaggatccgaggaagcgatcctagtgatatctcgaaagcctcctgctgctagttgtttggctcgcggatattcttgattgaattgttctgcctgattgactaaaccagctgccagaatatgtggaaaatgacttagcattcctgttatacggtcatgttctcctgctgtaagagtcacatattttgctttggttccgcaaaatagttcttgcagtttttcaacatcttttttcgtcttttccaaaggtgtaaagatgtaataggcattttcaaatagtttagcatctgctgcctgtatacctgatttgtgagaaccagccattggatgtccaccgacaaaccgaagatttttctgctcagcggatgtcacgacttgctgcttcgtactgctgacatccgtaatgatgacgtgatcagacaagttgattctttcaaggacatcaagataagctaaggttgtacggacgggaacggctaataagataacgtctgcttgttctgcacctgtttcaaaatcatttgcaacgtaatcaacgatctgctgttctactgcttgctcacgggtttttgactgactatcccaaccaactactatcagttctggattggtctgacgaatacaaagtgccatagaagcaccaatcagtccaagccccacgataaaaacatgttgtgccatcttatttgccccctttttagtaatgtttcaagtagtcacggtactccttcactgcagctttcaactcaacaagcgaatcacttgggaattttgacaatagctctgtcgctacaacagtggctacaacattttccgcaacgacactagctgcaggaactgctgtactatccgaacgttctacacttgctttgtaaggttcttttgtatcgatatcaacactttgaagtggcttgtacaatgtagggatgggtttcatgaccccgcggataataagtggttcgccattggtcattccgccttcgaagccgcctagattattgctacgtcggaagtagcctcgttcttcttcccataagatctcatccatcacttctgatcctggtaatgatccagcagtgaatccgaccccaaattcaactcctttaaaggcattgatactaaccacagcttgcgcgattttggcatctagcttcgtgtcccattgtacatagcttcctaatccagctggaacgcctccaacgagcacttctacaattcctccgatcgtgtctccatttttctttgtctgatcgatcagttcttttattctttgctcgactgctgaatcaacaacccgtacttctgatgcttcagaaatttctttgatttcttgaatggagatatttccaggtatttctgcttggattccaccaagacaaatcacgtgtccggctacgatgatgtcaagttcttccagaattttcttggcaattgcgccgattgctacacgcatggtcgtctctcttgcagaggaccgttcaagcacattccgaagatctcgatgatggtatttcataccgcctaccaaatccgcgtgtcctggacgcggacgtgcaactcgccgcagtgatcggtccttttcaggtacttctgctacagacatgacagttgtccaatttttccaatctttattttctaccactaaagtgacaggtgaaccaattgttttgccgtgacggatgccagacgtgatccgaacacggtctttttcgatcttcatccttcctcctctgccgtaaccagtttgtctgcgagcgagttcgtaattgatttcttcttctgatagaggtaaccctgctggtagtccttcaataatcgctgttaattctggtccatgggattctcccgcagtcatataacgcatcttacagtcctcctaagtaatctttgaatgtctctgtaggaacaggtacgatttttgcttgcccaatcttttctagcaagatgatattcaattggcttcctcttgctttcttatcatgggttatcgcgtggaataattcctctgaatgacttagatcgtaagtaatcggcaggtggaatttttggagtatcctttctaatgcagctgtcgatccagttggagacaagccgattttttctgcatgagaagtgatggctaccattccaatagctactccttctccatgactgactaccccatatcctgctgtattttcaattgcatggccaattgtgtgaccaaaatttaaaataagtcgatttccttggtcaaagacatcttcttccactacttttcgcttgattttcaacgtagcagtgatgattggaacagcatgctctaaaagatctttttcgtctttcagctcattcagctgttgccaaagcattgcatctgctatagctgctgatttgatgatttcagcgatcccttctcgtaaacgacgtaccggcaaagtctttagaacctcaggatcaatcaatacgccagctggctggctaaatgttccgacaaggttcttcgctttgtttgtattgactgctgtcttcccaccgatactagaatctacttgtgcaagtagcgtagtcggaagttgaacgaaatggataccacgcatgaacgttgaggccacgaatgcggctagatcacccaccattcctccaccaagtgcaagtattccatcgctgcgggtaaaatcattatctgccaaaaaatcgtataactcagctgcttgttccaaagatttactggtctcacccgccggtacgattgaaaggactggttcaaaatcagcttgtctcaattggaacatgattttttccgcatacagtggagcaacgttggtatcagtgattacagctactttttgaggcttccaaatcgtttgaagccatgatccagcctgttctagtgcaccttcttcaatatgaatatcgtatttctggttatcaacatgtacagtaagcattcgtttcacttctttcttttaaaaagctgacattaatcgagtgtttggatcttttccattgcttctttcatgatcgtcacttctttcatcatgcgtgagtaagtcttttcattcaacgattggggaccgtctgaccaagcatttgcaggatcaggatgaatctctacgatcatgccatctgctccgcttgccacacccgcacgggccattggtggtacaagatcccaaatacctgtaccatgacttggatcaacgatcacagggaaatgagttaattttttcatcaatgggacagcacttaaatcaaacgtattacgtgtagctgtctcgtaagtccgaatcccacgttcgataaaaatgacaggagatttgtcttcgactgcaatgtattctgcagcattaagccattcattgatcgtaccagaaatcccacgtttcaatccaacaggtttacctgttttgccgacagcagatagcagtttgaaattttgcatattacgtgcgccaatctgtaggatatcgctgtactcagccaccatgtcgatatgtccttcatccatcacttcagtaatcactttcattccaaattcatcagccgcttgacggatgtatttcaatccttcttcttctaaaccttggaaagcatatggagaagtacgtggtttgaaggcaccacctcgcagaatttttgcgcccccggctttagccatccgcgcacattctctgatttggtctaatccttcgatagaacaaggaccagccatcgtcacaaaactgccgtcaccgatttttactccgtctacatccacgactgtattgccaggatggaattctcgagaagtcaatttgtatgtgttcaaaatacgcacagcattttctactccttcgtagcgtgtaaatgctccttcttgtaaacttcgcgtatcaccttttagtccaatcactactcgttctgttccttgatcgattgagactttgaatccttctttttcgatatgatcgacgactttttttacttgttcttccgttgcttcttttttcataattactatcattgtttttcccgctttcttttgtttacttatctatcttggctgattttctctactttttcaaggtggttttacataaattcctactaaacgaccgtgtcctattgttctcattttcgctccttctttcctacttatgaaccggataatcaacaaaaaaagatgtccctgtaggaaattgcctctacagtgaacatcttcaacgagccttaaaaagcgctgcaaaaatataaaatagccactatagatgaatttctctacgtggctgtaagtcgtgtttaaaaatctttagccatcatagatacaaacttggtttgtttgtacccacgaagtcatgaatacaaacctatctaaaatagctaaagtaatacgtattcagttttgtaagttttctagatttcataaaaaatcgctccaaactgatgtaagaattgtacctagtatagacataaaaaaatcgactgtcaatcatttttgtgaaactttttttaattttctgatagttaactttatttttcagaaaaataacaattggtttcattgaagaaaatagtcatgaacaaaagattctgagaacttttttgctcgcttgttcatgacgtatcttgttcatgacgtatagaataaagcagctttgtcttgtaaactctgtttttcaaataataatctaaagatcgctactggataataaagctgatttcatggtcctcttcgccgctgatgcgataaggtgactcaacatccgctccccagctattgatacccccgactcctcttacttttgcaaaaatcgtaagaaccgttcgtctttctggcggtagttcttctatatgtgtcgcctgttccagttcttctgctttgaatggtaaagcggaaaaagcaaatggcgtatcctgctgttcaaatcgcaacgaaaagtcttcttgatctttgtccgtattatccaatgtttgatttcttgtcagttctagccatttcgtttccatatgcataccgcattcttggggaacaagatatggagggatagggagtccttccactttataaataccttcgataccaccagccagccgatccggatatgtttcccctgataaaccctcatactcaaagaattttgcttttgttggcataatgaaccttatacccaatgctggtaattccggcaaccctttttgtccaacataatgcattttaacaagcattttaccctctccagcgatttggtaggaaattgtcacttgtgtttttggtactgtgttgatttccagtgtaaaaatgatttcaactgttccagcgtattcattacttgaatattgattatttactggggcaatcggcaaatcgatctttttattgtccaccagtacttctatttctttgacttttggatacaatccggctcctaaccacataccagatttaaatccaaatccgctacctctgtcattatcggtcgttgcccgccaaaaaactggaagtgtttcccggtatagccattcttttccgtttttattgagcgattctagtccgcctcttgtataagaaaaaatataatgcgtattccccgatttgacacctaatgtacagtcgccgaagacgattgcaactttttctgtctccatatgacttttatttactgtatttttcataataatatcttacctcctgcatggcgggtttttcttgtccatctgcaaaaacgattccattccctgagaattcatagtcacttggtttatcgtcaaagtcaccgccatagcgcatcacttctctaccagtgattggatcagtcacttggatcgcctgatctttaaaatcccatatatagcctccttggtacatttcataacgatcaagcaacgtcatgtaagaatccattccacctaacgaattccccatgtcatgcatgtattcacataagatgaacggtttttccgctttattttcaaggtagtcaacaatctcttctggtggcgcatacatgcagctttttacatctgaaatcgaatcttcgaatgctggatttggaaaattcccttcataatgaacaagtcgatccgggtctacttttttgaagtaatcgttcatttgtcgaatgttttcttccgcataggattcatttccaagagaccaaaaaagaatgcttggatggttctttaatgtttcgaaattcgtttttgcccgatcaagaacagcagatcgccactgaggtactgcacctggcacattgtaagaaggctcaaatgcacccattttttgccatgagccatgggattcgaggttcgtttccgccatcacgtggatacctgcttggtcgcataaataataccaagtgatctggttggggtaatgagatgtccgtacgccgttgatctttgcattttttatgatagccaaatctttttccatatcttctatagtgatggcgcgtcctttttttggatgccactcatgtcgatttaccccgttgatgatcatccgttttccattgaagtatatgattttatctttgatttcgattttacgaaaaccgaaggaatagttaatatactccgttactcttttttcttcgtctatcgtctccaattcaagcttatataaattgggctgaaaatgcccccacaatgccacgttttcaaatccatcgatccgaatcgtcatttgttcttttaacggatattgctgttgatagatttccttcccctcaggatctagtatcgctacattcagctgactgtttttggctacttgctcaaaagacaaatctacttcaagtttaccattttgacatttgtcatctaagcgaggtttgatccaaagatcttctaaatggttttgtcctcgagcaactaagaagacctctctgaagatcccaaaaaatcggaaaaagtcctgatcttccaagaatgcagctgtacttcttttgtaaacctccacagctagaatattttcttcttccaaataaggtgttaaatcaaattcagacggagtgaacgaatcttcggcataaccgataaaatgaccattcaaccaaaggaacattgcttgttctacaccagcaaaatgtatcgagatttgttttccctttagaccttcttctaatcgaaaagtcgtcaaataggaccccaccggattgtctttagcagctgaaaatatcccttccgcctctttctcagggcttgtcgtgaaagggggacggcgaaatacatgtccctcccacggatacatcgtattgatgtaatggatcttgtcataatttgctaattcaatatgactaggaacagtgatttcatcaaaagaacaggcatcaaaatcttttttataaaatgtttttggacgtaccgaaggatttggcgaataacaaaaacgccatgttccatttaaagactgtttaagggatgatgtggtttctacttcttcccttgttgcatagcaaacatgatcactatgcgcatttgattggttcactctaaaaacttgtggatcatctaaccattttatatttgctttcatacttttttccttctctctcataactttttgaaatgaagcagctctgtttggaaatcaccttgaaaatcagggaagtaaagtccgactgtcatcaattcggcccccgaaaatagccgcttcgaggtctgttcctgataaagtgcctcatcatctaaccccaacagatatacttcatggaacgctggttgagctgaagctagtatcctccctaaaaacacaatagcttcatcttgtttaggagacacaaacatccatgcgacaatattttcttcaaaaggactcgccaaacgataataatggccgtactggatcacgagacgaatcgtttgataggatataatttgttctttgacttgctttttttcttcaggagacagctttgtcaaatccagttcataaccaaaaacagcgctcatagctgtttctcctcttgttttcaacgaagtagatctgccagtctgatgatttggtacagctgatacatgagccgtgatggacgaaatcggataagcaagacttgttccatattggattttcatacgctccactgcatccgtgttatcacttgtccatgactgcggcatataataaataaaaccagcatcaaaccgcccacctccaccagaacagccttcccataagatttccggataatcagctgtcaaatgttcgagtagttcataaagcccaagcatataacgatgcgctacttctccttgtctaagtgggtcaagggtaatcgaatagatatctgaaagcgaacgattcatatcccatttgatgtagtcaagaggaatcgtgtctaaaatctttctcatttgtttctcaatcgtctgccgaacatctaaccttgtaaaatccagtacatgttgtgatctggaagcagaaggcattctacctggcacctgcataagaaaatcaggatgtgttcgatacagttcagaatcaatggagatcatttctggttcaaaccataaaccaaatttcaatcctttgctatgagcataatctgctatttcacgtaatccatttgtcaacttgcctttatactcgaaccagtctcctaatgaagaattgtccgcatctctttttccaaaccagccatcatctaatacgaacatttcgatgcctagctcctttgcttcatcaatgatcgccttgattttttcactattgaagtcaaagtaagtggcttcccagttattgacaagaatcggccgttcagcaaattgatgacgacctcttgcgattctttcacgtagcaactcatggtggatctgactcattttgttcaatccctgacttgagtaagaaaggatcatttcaggtgtttgaaaagactgatttgcattcaattcccacgaaaaacaatggctgttgatcccaccgacgactctcaattgattgatctgatctttttcaagttcgaaagaatggttgccggaataaacaaattgaagtccaatcgcttctccagtattttctgtcgtatgatgatgaactaaagcaataaagttattcatatggtgactgctcgttcctcgacggctttcaaatacttttgttccagataaaagagattgccgtgagatctgtctttcattgacatgtgctcctggcaaagcaatgacttcatcaaatcgcctagtatgggcaaaatctaactggaaactagctgctttttctagtttgattgtttctctagtttcatttcttatctttacagatcgtgtgatcactgctctatcactaaatatggtatagaacaaatcgaaataaatcgctgtttctctatccttaagtgaaatcaccaacgtttgtgcctctgacttgtctagcacataagtttgaggcaagccttcgatgtctggcttcccatctgtaatataatgactatcatatctcagatccagtaagtctgacccattcttgcgctgaatgatcgatgcgggcgttcgaaagtccatgctgccatgagaagagtattcttgtggtagtgtatctttcgacagagaccggtcaggatttaagggaatatttcctgaaaatccacgatctcttcggggataatttttattgtctttgtactgcttgactggtttgccaaaataaatatgcgccaatacattgctctcttctatctttatcagataagaaagaaatgtatttcgtaaatggaatactcggctcttttcatcaaataagatgaaatttttttctgtttttttatgcgtaatatccatcatttcactcccaccaaaacggaaaccgtttactttttttataattcctgtatactgtttactaaacaattttgtcaatagaaattttttgtttttttgaggagtgtgtaaaaatggttggaattagagatgtcgcacgaaaggcaaatgtctctcctgctacagtttcccgcgtgttgaataacgatcagacgatccatgtggctcaggctactcggcaacgaatagtagaggcagcagctgcgttggattatgatatcagtactcgaaaatatatcaaaaagagaatgccttcgattggtgtgatctctacgatcggcaaatcgagcgaagaacatgatatctattacaaacatttgcgagtagggatggaagaagaagctcgacgtctgcatttagggatgaatcgaatctataatctatctgataatcctaaacaatgggaagatctagatcagttaggtgcggtgatcgttgttgggaccgttacgaaagaatcgattaccgccttattaaaacaaaacatgcaaatagtcgtcgtggataaccctgacatccagcaagaggtcgatatggtttatgcagatcttgaacggatgactaaaaccgtactggaattgttcttagaaaatggccataaaagaatagcctatatcggggggtataaagtcgatatggatgaactgggtgggaagcagatttctataaacgaaaagagaatgcgtgcctatcagcattttatgatcgatcatcacttagaaaaatatatgtcttatcgtctaggtggctggacagaaaaacaaggtgagggacttgcgactgatctattagaaaatgaatcccctcttcctactgccattcttgtcgggagcgatccaatggcaatcggtgtctatcgggcattgaaacaaaaaaatattcaaattggagaagagattgttgtagcaagctttgataatatcgagacaatcgcaaacctctcccctggcttgaccagtgtccaaatcaatgcgaaatcaattgggcaagcagctgttcgaatggcattggagcgaattgacggaatacgggacgaaccaatcattttgacttatcctgcacgattgattgttcgggaaagttttatcccaagaacaaaaaggtattaaaagagaggttgtaaaaagccgcttcgtttcttcatactcaaaactaaacggctttttcacaacctcttacttatacttattcacaaaatccaatgtctgctggtaacaattttgcgattcttttagcgtgtaatcaaattggtattcatgggtaatctctttttttgtatctgtataaaacaaggattgcacgggtacctttaattctgtcaaccgattttctaatgcttgaccttgctcttggaaggagtaagcatttccgtcagttatatacgttggcggaaattccttagaaacatggtcagccacactagcttctttcagttgctcgctcgttttccaatcttttgttccaatcaacgaccatgcaacggttttgacgaagaacttcataaatcgatcatccgaatgttgctgtgctgttagctttaaatcaacgggtccacaataagaaatggttcctttcaaactatcttttggaagtacctgtttgattttcatctgtttggcatacgcttcatttgtttgtagagctgcatattgcaaagcgatttgtgcacctgcactatcgccgccaaaaaatagttgttccatgtctagcagtttgtcgtcgccttcagctaataaatctttgaccagctcattcacttgaagaacttgattagggtattctgaatcaggcgctaattcataattcatcgcaaccactgcgatgttggcatctgatactaattttgtcgcaaattccttgacacctgatttatctccgccgacgaaccctccaccatgtacccaaaacagaacaggaacagttcccttgctgttttttggatagtagatatcatacgtattctctttatagttggactcgtacgtcaaatctgtttttttcgccacgtttttttctgcttgattgaacgttttctgatcggtgatttgaacagtatttgaaaacatatggttgatcaagaatgctccgggtctgggggaaagctggaaggcaagaaagattgcaaacgcgatcccaagaatgattccgaagaaccacccgataaatttaagaattttctttttcataagtctccctcagaaattaatattaagcattctgattataccatagtgttctttcctagcaagctctcctgcatgatttaattgttcccccaaacttcttctgcaatgcttttgacaaaagcaatcttttcccattgttcttcttcagacaaaatatttccttcttctgttgaagcaaatccgcattgaggacttaagcacaaacgatccaaaggcagatatcgtgtcgcttcgtagatccggtcaatcacttgctggcgctcttccagttcaccacttttcgttgtgatcaagcctaatacaactaatttatcttcggaaactttcgctaaaggtgcaaaactcccagcacgttcactatcgtattctaaataataggcacggacattttcttgagtaaataatggatctgctacgtcgtcatagccccccgatgctgcccaagtagaatgataattcccgcgacagacatgtgtattgagtgttaaatcatccggctggtcagctaagactgcattgttgatcgttaaataaagatttgctagttcccgacgaacttctttttcatcttttccctcatccatcgcaaaccctttaggaagtggtgcaactaatactccccatgtacaatcatctagctggatcgtccgcgcacctgcttcatataagtcgtcgatcacttgacgataagctgcgatgatatctttgatcaatgtttgattgtcttcatagacttttcgaacatggggtaatatatccggacgaagtagttccactaaaatttgagctggagcaggaattgtctgtttcacttcgatgccttgacttgtatgtgcctgagtgaatttaaaatgttcgacgaaagggtggttcgtaccagaaattttccccgtcacaatcactgtaccaggacgtgtctcttctccatgaaagaaatagccatgttcaggcacataaaattccacgccattcaacccataaaagaagtccaagtgccaccagctgcgacggaactctccatcagtaacagctttcaaaccagctccttcttgtttttttatcaattcgatgattgtttcatcttctacttttcgaagttcttcttgtgtgatttccccatcagtaaaacgagtccttgcctctttcaatttttcaggacgtaaaaagctcccaacgatgtcatagcgaaatggtgatgttgttcgaattgtcataaaaaatctcctccaataatcatgttttaacaaagcgtaagaagcttttcaaaaaaagaaaaaagtacccgcctcttttgccgttgaacgacaaaagggacgaatacttcgtgttaccacccttatttgcattattctcacaaataatgcctcatcggtacagattgtatacccggcgagttatcggtcgctttaccgtttagattgcgtgaacaatccaaaaaactcagagctcatcttcactgaccaaacaatccttgctctcacctaccaaggtctctgtacttatttccgatcagctactcttctcttcaaagcttcattatttgctaattaatatcccactttcgtttcattttgtcaatcttttttcaataaaaaaaatcgagcgatttctctctcatttcattttcatccattcaatccacttatcctaaatatttctttcctattttttcatttccatccatgcatgataatattcaattctgatattgttttcgtccgtattggtcaatagatattgtccgatcacttctcctgtttcccaccctttttcatgcattgtttctctgacttctaacatattattacgttccgcatggttcatctcagatttcaataaaaaccggcgataaatagtcgtatcttttttcttccaaatcacatcttgggaaaataaatgtatgtcactggggtcgataaaaaagccgtacatcgtttgcgaactggaagctggcatactcatcattccaaaactcgaatagtttggtagaaattgttttatttccacaatatcttcaaattccgttgagatcatacagtcaaaagggatctcttctataggaaattcttcctcgtttgtatcgatcatcaatttcaactgtttttttcgcgcccttatctctttctgtttttgtttcattatcaatagttctttatggattcttttttctgtttcatcaagtgtctcatataactccgtcaacgttttaccatataaattcttcatctgcttgatcggtatatctaattttctataaaaaacgatatcataaagcataaaaatatcatcgatatcaaacaagcggtaatcattctcttcctgtctgcttgaccggatcagtccctgttcatcccaatagcgaatcgttgattttggcaaatcaaacagttccgatacttggccgatcgtgtacatttttttcattttttctcacctcttttccagtttattcttttttctattgaccttcaagctacttgaaggtatagaatcgaaaagtatcaggaaaaaggaggaataatatgactatcttaaaaaaattcttacagcaaaacaaaggactcgctctccttacctttgtgatgatctgtttacaaatcgccggtacattaggtgtaccaaaattagtagccaaactgatcgacacaggtatagcaagtggcgaagcctctgttatcaagaaaatcggcgttgaaatgctacttgtagcatttctaggaacgattgctgcagttgcctctagttacttttcagcattggcatccgctcggtttggtttccagacacgggagaaatatttccgtaaattccaacaactgtcaatgaaggatatcagccgtttcagttctggatctcttttgacaagaatgacgaatgatgtcgataatgtccagcaaatgattgttttattttgccaaatgattttaccagcaccagttatttgctttttcaccatcctcatgatgtttcgttattctctattgcttacatgggttacattattctctgttgttttttacgtatggatcgtttaccgactgatgaaacgaggaacgcctttatctttgagtatccaaccaaaaatggatcggatcaccatcacattgagagaattctttacggggatcaatatgatccgtgcctttgataatcaatcatatgaagaaaagcgaacgaatcagacctttgcagattatgctagtcaaatgatcaaagtgaaccgaatctttgcttgggtcactccaaatgcttttttactcatgggaatcgtttatgcttctattttgtggtttggcggaaatcttgtggcagacgggacgttacagatcggggtcgtgaccgcggtagtggaatactctatgctgacacttgcttatttgatgattgcagccatggtactggtcattatccctaaatcattcgcctctttacgacggatagaagaaatactcgaagcagagatcgaaattaaagaagagacgatccaaacagttgctaaaccatcctttgatcagacaaatgcagctgcttttaaacatgtcacattcaaatatactgaaacttctgatccagttctagaagatattgattttacaatacctaaaggaaaaacaacggcgatcgttggtgggaccggatctggaaaaagtagtttagcaaaacttctcttgagactaagtgatcctacggtaggaaaagtgacccttggtggtattcctcttactcaaatgacgcaggaacagatccgctcccacatcagttatgtccctcaaaaagccttcttattcagcggtacgatcttaagcaacttgcagatgggaaatgaacatgcttcaccagaagaattggctaaagcgatcaaagtcgcccaattagaagaactagtggacactcttcctgatggattagatagctttgttgctcaaggtggttctaattactctggcggacagaaacagcggatatgcattgctcgagtattgatcaaaccagcagaaatctatgtattcgatgatagtttttccgctttagattataagacagacgcagcattaagggcagcactccataaacacatgtcggagaaaactctcgtgattgttgctcaacggctcagtacgatccaacaagcagataacatcattgttttagatgaaggaaaaatcgtaggacaaggtactcatgaagaactattgtctaattgtcaaacatatcaagagtttgccaaatcacaaggaatatagaaagaagggattcgatggaaaagaaaaaaacgttgaacacacacgctttgatacgtttttggaaaatgatcaaacctgaacataaatatttttacggattgtttctatgcagtttattgggcaacctattagttgtagccatgcccctgatcatgggaattgggattgatgatttgttgtcgcaaataagaaaaacaggtattggacagcttactttcagtgatatcaaacaggcattgctgttccctgtcttattgctgatcggctgttcagtcctaagcagtgttgcttcatttatccaagaacgtacaatggcagcattaagcgaaaagatcacattgagggtacgaaaagaaatcacaaaaaaattcaaaacattgccgatgtcgttttttgataatcatcaagtcggcgacatcatcagtcggacgactaccggactcaatcagctttctcaagtgttattgacaggtatcaatcaatttttcacttctgtggtaacaatagttgctgctggtctaatgctgttttatatcgaaagcaagcttactttgctcgtcttattgctgatcgtcggaagttcaattgttacaactaaaattgcgaataaaaacaaacagatttctgaacaaaaccaatatgaactaggtgtcttgaataatcggatggaagaaatcttagctggtaatctagtagtcaaaacattcaatcagcaagctcgtgcagaggcttctatacatgaagtaaacaaaaaacaatacaatgcttttaaacgtgctcaatttatgaactttgccatctatccggcaatccgtttcatcaatcaacttgccttcatcataagtgcggtattcggtgctatactcgttctttctggcggtgtgacgattggcttcttacaagcttaccttcagtacatcaatcagatctctgaaccaatttccactgcttcttatgtgatcaactcgatccaatccgcaatggctgcaatcgaaaggatctttgagatattagatgaaacagatgaaattccggacttaccagaagcaaaacttttggaagaaccgaaaggaaaaatagctttcaaaaatgtacaatttggttacacatcggataaaatattgatgaatcaagttgatttttcagtaaaaccaaaacaaactgtggcgatcgttggaccaactggtgcaggaaaaacgactttagttaatctgctgatgcgtttttatgaactgaataaaggaaagatcgaatttgacggccgcgatattactaagctttcgcgtggagaactacgccgttcttttgggatggtcttacaaaatacctggctgtttgaaggaacagtggccgataatattgcctatgggaaaatggatgccacgagagaacaaattatcgaagcggctgaaatcgcgcaatgtgatcactttattcgaacactgccagagggatatgatacaatcatctctagcgaaaatggtacgttatctcaagggcagcaacaattattaacaattgcacgggtcattctggcaaatccccctgtcgttattttagatgaagcaacttctagtgtagatacacgaacagaagcattgatccagcaagcaatggaggctgtgacaaaagacaggacaagttttgtcatcgcgcaccgtttgtcaacaattgaaaatgcagatatgatccttgtaatgaaaaacggcgatatcgtcgaaaaaggaacgcattctgaattactccaagcaccaacgctttatgctagcctttataatagtcaatttcaggtagcatagccaaaagagcgtgggacaaaagtaaagaacacttttgtcccacgctctaaacacgtataaacggcggaagcagaagcaactccttcggaaataagctgaaattaacaaaaatttgaaaaagcaattttcgtgaattccttcttatttcttggagttaaacgcttctgtcccagcttctttgtctcattactggttgaacacaaaaaatgttaaaatatctgaatgcaatcagctaaatattttggaatggcctcgtatgtagctttccagtcagcaggagcaattctgatggctttcatgagtttttctaagcttttctaaatgcagctaaatttcttgtttcttttgtcatcatgacttttttaacccctcattttcaacgactttttcacgaacagccgattgaattaccaaaaatgtggagtatagcggcatttattcactctttttttatcttttttaggttatatcattttcaagaatataaaacaaagtgtatgaggatttaaatagcgaaaggatggggaacgatcatcaagatcatcgttccccatccttttttaaccatattacttattaaagatcttagggccttttctcatgtttttacgatcattcttaggtgtttccatttgtttggatcggcctccaccttgtttctttttgatcaattctttcattttttctttttggtccatttttattctcctttaacgaatgaagcgactaattcgatatgatgggtttgcgggaaaagatctacaggctgaactttcttcacggcataacctgcttctgcaaataacttagcatctcttgcaaaagttgccggattacacgagatatagacgattcgttctggtgacatttcgattgctgattcaataaaatgatgatctaatccttttcgtggagggtcaactacgatcacagatggtttaatccctttttcttgccattttttcatgactttctctgcttttccgacttcataatgaacattttcgattttattatttaaagcattgaactgtgcatcttcaattgcttctggaataacttccatcccatacaccttatccactctgtctgctaaagacaagccaatcgtacctattcctgaataagcgtcgatcacaatgtcttttttatctaactcagcaaactcgatggctgtttggtacagatactctgcttgttgagtatttacttgataaaatgactttgctgagattcgataggtttttcctaatagctgatcttcgatatagtctctgccatataaaactttttctttgtctcctaaaatcacatttgttttttcttcattgatattttggatgaccgaaaccacttctggcaattcttcatgaatggcttcagcaatttccttggatttaaagaatttttctttacgagtaactaaaacgaccatcatttcatgggaataatgaccacgacggataatgatgtgacgaagctgtccttcatttttttcttcattatatcctcgtacttggaaccgttgcaagatatctctgactactttgattgcttgatcgatgacaggatcttggatataaaaatcttcgatagggactagatcatggctattctttttgtaaaaaccggtggctaactgtccatcgatacggcgaacagggatctgtgctttattacggtagccgaatggttctgccattccgacagttggaagtacaggaacttctggcatcttagcaatcttcgccattacatgctctacttgtttttgtttgaagacaagctgttgttcatacttcaaatgagctaaaggtgcgatacctgtgcgaagtaatgcattgttttctacaggctggcgatcaggagattgtgtaataaatgtttcgactttcccatacccaaacttattgcctgctttcactactagtatttctacttcttctccagggagtgcattttcgataaacaatggataaccatcgatttttgctacccccattccttcataactcaagtcgacgatttcgactgtatatcgttcgtttttctttactatttgctgttctgtcatattttgctcctttaagcctatttttcaatcctactgaactctactataaatcagctaattacacaactaaaaccggcactgaccttactacgttcagcaccggcttttgattaattcttttgattaggtgtttcgtctgctatttttccgtcaccgtcgatatcttcatccgttaaacgttcgacttcttttacgaattctttgctgacaacctctaattcttcttcatctgtgcctgtgattgcttcatcaggaatctgatcggtattggcaaagaactcaatgtgttgatgaagattttggaaatgcatcggtgcttccccgccatattcaccatctaagttgatcattactggtcgattgatatcatcttctgtttcgacgaacaaactgcttgttttggtatagattactcttggatcatcgacatgtcgaccgccattcagcatgagtgccgcaatatgcaagatctcaaagatatttgctgtcttcacaatgatcaaagaaaacttgccatcatccaatttggcatctggcgcgatctgttcgaatcctccaacagagttcgtcagccctaggaaaaacatcgaagcatttccgatatattccccttcatcatacttcaagcgcattttgattggctttactcgaggtagcatctctgctcctttcgcaaggtaggcaagataaccaaaaatactctttagttctgatggaacttcataagtcaattctgtcaaatagccgcctgcagcgatattgatgaagtaactgctatcagaaagaccgatgtccatttttactgtttggtgtttttttattacttctgctgctgctttaatattatctctaggaatttttaatgctcgagcatagtcgttcgtcgtaccggctgggataatggccattttaggacggtgttcaagcggagcgatcccattgaccacttcgttgatcgttccgtcgcccccagctgccactactagatcaaaacctagttctgcaactctgcgtgcttcattcttggctgaatcaggttctggtgtagtggcataggcgctggcttcaaatcctgcttcttctaatgcctgcaggatatccgccaaatttttttttaataattcttttcccgaggtagggttataaattacgcgtgcttttttcattttcagcctctagcgtttcgctaattcatctttaagcagcttgttcacgacaccaggatttgcttgccctttagttgctttcatgatttgaccgactaggaagccaaccgcacgatcttttccatttttgaaatcatcgacagattgttgattgttatccaagatttcattaatgattggaagaagtttgctaggatcagataattgtacccaaccatttttctcaacaacttcttgcgcttctccgccatttgtgatcaattcacggaagacttttttggcgatttttgagctgatcgttccatcggcgatcaaacgaatcattcctgctaagttctcaggtgtcaattttgtctcagctaattccagtttctcactgttcaagtaagcagaaacttcacccatcaaccagttagatgcttgcttggcatctgcaccattttccaaaacagcttcaaagaaatcagacatttcttttgtaagtgtcaataccattgcgtcatactctggaagaccaaattcacggatatagcgttcgcgacgagaagctggcatctcaggtaaactagcttttactttttgaatccattcgtcatcgatcacgaatttcggaatatcaggctctgggaaataacgataatcactagaaccctctttcacacgcatcaaaactgttttattcgttgtttcgtcaaaacggcgtgtttcttgttggatttctcctcctgaaagaagaacttttgcttgacgtttttcttcaaaagctaaaccttttttcacgaaagataaagagttcaagtttttcaattctgctttcgtaccgaattcttcttgtccataagggcggagagaaatattcgcatcacaacgcatagaaccttcttccattttcacatcgctgacttctgtaaattggatgattgaacgtaatgcttctagataagcgtatgcttcttctggtgaacgcatatcagcttcagaaacgatttcgatcaaaggcgtgccttgtcggttcaaatcaacgtaagaatagccgccgataccatgcatgtttttcccagcatcttcttctaaatggacccgttcgatccggatttttttcttcttgccttctacttcgatttcgatccatccgtcatgaccgattggttgatcaaattgggaaatttgatatgctttcggattatctgggtaaaagtaatttttccggtcaaaatgagtatctttagagatttcgcagtttaatgccaaagctgctttcatcccgaattccagcgcagctttgttcattactggcagcacgcctggataaccccagtcgatcacgtttgtattgctgtttggttctgcaccaaaatgagctggcgctggagagaaaatttttgagttggttttcaactcgacgtggacttctagtccaatgactgtttcaaaattcattcgtctttccctcctaaaatagctggttgttgtgtgtggaattctgttgcttgttcaaacgcatatgccgcttgatacatcgttttttcatcaaaataattaccgatgatctgcaatccaactggtaatccttctgacaatcctgccggtacagacatacctggaagtccagccaagttgacagggatcgttaagatgtcactcatgtacatcgtgattggatcgttgatgttctcaccgattccgaatgccactgttggtgaagatggtccgatgatcaagtcataatctgcaaagactttttcaaaatctcgtttgatcaatgtacggacttgtcctgcttttttgaagtaagcgtcataataacccgcacttaatgagaatgtacctaacatgatacggcgttttacttcttcaccgaatccttctgaacgtgagttgacatatacatcatccaatgatttcacgttttcagagcgataaccatagcggataccatcgaaacgttgcaagttggaacttgcttctgatgaggcaatgatataataaacagccacaccgtattttgaatgaggtaagctgacttcttccacaacagcacctaatgaacggaatgtttctgctgctttcaatacagcttcttttacgccaggggccacaccttcgcctaagtattctttaggtaaagcaatcttcattcctttgatgtcaccggtcagtccctctgcaaagtcaggaactgaaacgcctgaagaagtaccgtctttttcgtcataaccactgatagctgttaatgctaatgcgttatctttcaccgtacgggtcattggtccgatttggtcaagagatgaagcaaaggcaatcaaaccaaaacgtgagacacggccataagtaggtttcattcctacaatgccgttgaaagctgctggctggcggatacttccccccgtatcactacctaaagaaactgggatttgtccagctgctactgctgctgcagaaccaccggaagagcccccaggtacttttgtttggtcccaagcattttttgttttcttgaaataagaagtttctgtacttccgcccatagcaaattcatccatgtttagtttaccaacagggatcatatctgcttgatagattttatccatgaccgttgcatcataaattggttcaaaattgtaaagaatcttagatgcagcggttgtcaagatatcttttgttacgatattatccttgatcccaatcggaattccagcaaggatgttgctttcatcaatccctttttcatctaaagcttttgcctgttccaatgctttttcttcattcaatgtgatgaatgcttcgatctcaggctctgtttctttgattcgttcaaatgttgcttttgtcaaatcttgtacagtgatttcttttgatacaagcatatgatgtagttcctctagagaacgattgtgtaattttgtcattatgcgccagcctccccattatcgatgattgcgggtactttgataaagccgtcttctgtttccggcacatttttcaataattcatcacggttccatccagcttgcgcccgatcttgtcgcatcacgtttactgtttcgacaacattcgacgtaaatggaacaccttccgtatctacttcttccagcatttccaccatatcgatgattttacctaattggtcggtaaaacttgcaagttcttcatctgcgaacgcaagttttgctaatttggcaacgtgtttcacttgttcttcactaatcgccatactaccccttctttctaaacgagttaaaaactttgctctctattttaacataagagtgctctgtctgaaattatttattgaaatttgtctgaaaaaactcaatatttattcttttgctgagtggcttttagccaatgcttctgccatttgatcttctgtccaaacttcgattcctaattcttgtgctttggttagcttgctgccagcatcttctcctgctaccacgatatccgtttttttcgatacgctaccagtcactttcccgccaagattttcgatcgtctcttttgcttcttcacgagtcaatcgtgttagtttaccagtaaggactactgttttttctttaaaaggcgactcgacttcttgcaattgggtacttcgaagccctttgtattcgaaattgacgcctgcttgttttaattcattcatcaattcatggacttcttcgttactaaaataagtgactacactgtcggcaatgatatcaccgatcgtatcaagcgcaataatcgactcatagtcgcttctactcaatgtctctagatcaccaaaatgttctgctaaaatttttgctgctttcgctccgacatgtcggattcctaatccgaaaatcaaccgctcgaccgaattatctttgctgttgtcaattgctgtcaaaatattatttgctgatttttcttttattttgtccaacgtcaataactcttcttctgtcaatttataaagatcagcaacatctgcgactagttttttgtcatacatctgttcaagcacacgtgggcccaacccgtcgatattcatcgcatttcttgagacaaagtgattcaagccttctttcatttgagcagggcatttaggattgatgcaccgtagcgctacttcttcatccaaatggacaagttcacttccacaaactgggcaatgtgtaggtaattggtattcttcgctgtctttaggtcgtttatccaacacgacttgcgaaacttctggaatgatatctcccgctttataaatcagaactgtatctttcaagcggatatccttcaacttgatataatccccattatgcagactggcacggcttactgtcgttcctgctactcggaccggcgtcatgatagccgttggcgtcactacccccgttcgtccgactgtccattcgatgttttcgatcagtgtttcaacttcttctgggggaaacttataagctgttgcccatcgtggtgctttgacagtaaagccaagttgatcttgcagcgagaactcattcactttgatgacgatcccatcaatctcatagggcaaatctacacgtttatcatgatattcctcaatgtatgcccatacttcgtcaatcgaatgacatagacgtttttcccgattcgtgtggaatcctattttttctagctcttctagtgcatcatactgtgtttttgcttccataggaccgaaatcagctactgtgtataagaaagtatccaggtttcttttcgctgtgattttagaatctaactgacgcaaggaaccggctgcggcattccgaggattcgcaaagatatcttttccctctgcttctctgtcttgattcaattgaacaaatgaacgttttggcatgaaacattcgcctcttacttcgatgttcatcggttcttttaatttgattgggactgatcggacagtctttaggttttcagtgatgttttctcctacagtcccatccccacgagtcgctcctctaacgaaattcccatcttcataacgcaaagagacggaaagaccatctatttttagttcgcagcaataatcgactacacgtcccactgctttttgtacacgttgatcaaaagctatcagctcttctttgctgaaaacgtcgttcaaactgtaaagcggaatatcatgagtgactttttcaaacccttctaatacttttccgcctactcgttgagtgggagaatccgacgtgatcaaatcaggatattgttcttcgattgctactaattctgcgtattctttatcataaacatagtcttccactgttggtttatcttctacgtagtattcgcgagaccattggttcaatcttgtacgaagttcttctgctcgtttagcagcttcgtcaatcgtcatttcatgttccatcatttaccctccactactaagctttttcaattggcgcaaaggcagccaaaagacgttttactccttgacttgggaaagccacatctagttctagatccttcgacgtcccacttactcggacgactgttcctagtccccattttttatgtttgactttatctccaggtttccagctgttcttttcccctccagtggcacttttagaggaaacaaccgctgtctctggctgtttatagctatatgctgctgtttttttagcgaatacaggtgtttttttaggcgtaggacgcatgccctcgatttctagcaattcttgatcgatttcttctacaaaacgagaaggtcggttatattgcgtccgtccatataatgttctggagaaagcattggttaaatacaacgcttcttctgctcgcgtgattcccacataagcgagacgacgttcttcttccagttcgctttcttccatcaatgctcgagataaaggaaaaacaccttcttctagaccaatcaggaatacaactggaaattctaatcctttggctgcatgcaatgtcatcaatgtcacttgcgaagcgtcttcttctaaattgtcaatgtcagaaacaagtgccagatcgttcaagaagaccgttagtttttcttctggtgcatcagcatcttcttcattttgctgttcgaactgcttatcgaattcttgtgtgaccgttaaaaattcctccaagttttcgatgcgcgcttgtgcttctaatgtattttggatttttaaatcttccaggtaaccgctacgatccaaaacctctttcgtcaattctgtcactgtcaagtatgggatcatctgcgtgacttcttgaatcatctctccaaatgcacctaattgctggcctgcttttccaccgatatttgccagatccacattttgggctgcttcaagcagcggccattcatggagagaagcaaaactgcgtagtttttcgatagatcctggtccgatgcctcgtttgggcgaattaacgatacgctcaaaactgattgagtcttgaggatttgccagcacatttaaatacgctaaaatatctttgatttctttacgatcgtagaatttgtgccctccaaccattttataaggaatatttgctttcaacagggtttcttccattacacgagattgtgcgttcgtccggtacaaaatggcaaagtcgccgtaatttcgatgattgcttcgaatctcttcttgcatccggtctacgataaaacgagtttcgtctcgttcattatctgcacgatagtaagtgatcttgtttccttctttgttttctgtccacaagttttttggttttcgattgctattgttttcaatgacttggtttgccgcgctaagaatgtttttcgtggagcgatagttttgttccagcaaaatcactgcagcatctggataatctttttcgaaatccaagatgttctgcatatctgcaccgcgccagccgtagatactttgatctgcatctcccactacgcatagatttctaaatctacctgccaataaattgaccaacgtatactgtgcatggtttgtatcttgatactcatctacatgaatataatggaatttgttttggtaatatgtgagtgaatcaggatgttcttcaaataaccggatcgtattcatgatcaggtcgtcaaagtccatacattgattgtattgaagctctttttgataagcagcgtaacattttgccgcaatctcttcgtaataactgccttgcatttttgcaaaatcctgaggggtctgcaagctattttttgcttgggagattgttcctaatatgctgcgaggatcatattttttcgggtcaatgttcagttctttcagtatccgtttcatcaaggtcagctgttcagaagagtcgatgatcgtaaagttccggttatacccgataaaatcaacatctcttcttaaaatacgcacacacattgagtgaaaagtcgatacccagacatcttcgcctccagatgcgagaatcgcattgacacgttctttcatttcttttgcagctttattggtaaaagtaatcgctaggatgttccaaggattgacttctttttcctcaatcaaataggcaatgcgatgcgtcaacactctcgtctttccacttcccgcacctgccatcagcaataatggtccgtcagtgtgaagaacagcttctttctgacgggggttcatcccgtttaataattcagctttggatgacattaacaacatcctttcttttatcaatcttgttaattatagcattttcttggctttcattaaactagctaattcaaaatcatttgtttctttttatggatttctccttgtcaattcgttgatttcgcgctaaattaaaagaaagtgaggcgtttgaatgaaaaaaaaaggaaaaatcaagaaattagataaaactcagatatattttattctaaaaggaatattcgttggactactgacaggaatcgtggttagcctgtttcgtttatcgatcgaaaagttaggcgattttgttcgaagcatctatgaaataagtcgggaacagccgatttacttagttggtatggctatttgctgcatccttgcagcattttttgtgggttatctggtcaaaaatgaaccggatatcaaaggaagcgggattccacaagtagaaggacagcttcgaggggaattatcaatgaactggttctctgttttatggaaaaagttcattggtggtgtactttcagttggcgcaggactttttctaggtcgagaaggtccttctatacagcttggcgcagctatcggacaaggagctggacaattgtttcggagtccatcttcagaagaaaagattttgatttctagcggagcaagtagcggacttgcagcagcattcaatgctcctatcgcaggattactctttgttttagaagaaatccatcactccttctctcctcttgtttggctgacatcttttgctgcggccatcacggctaactttgtctctctttatttttttggcttaagaccagttttatatctaggggatcttccttctttgccgttgaaatattatggttctttggtggtattaggcgtacttctaggcgtcttaggttttatttatcaaaaggtcctgctggcattgccaaaattttacaaccgattgcctttaccagcttattttcatggattcgttcctttcttgctgattttgccgattggttatttatggcctagtacgctaggcggaggcaatcaaatcgttttagcttttggacatgcttcattgccaatcattatgattatcggtttgtttgttcttcgattcgttttttccatgatttcttatggtggtggtcttccaggagggattttccttccgatattgacattgggtgctttaatcggtagcttttatggaaacatcatggttgatttcgggatggatccaatctacatcaaggatttcgtcgtgattgccatggctggttatttcacagcaattgggaaagcaccgctgacagcaattattttagtgacagaaatggttggctctctcaatcatctgatgcctttagggttggctgctcttgttgcttatatcgtcaatgatcttctcggagggaatccgatctacgaatcattgttggaacgtttacttggaaataatcagaccgccgctcttaaaggtgcaaggacaacttttgattttccagtaacggcagagagttctttagacggattaatggtgcgggacttcaattggcctaaaaatatgctgctaatctctatacgcagaggaaatcaggaaatcttgactcacggtgatacgatcatgaatgtaggagatattttggtaatcttgactgatgaagcaaacttaccaagaatcaagcaagaaatcgaggctaaatcttcgatcacaaatttgaagcaatcattttaacgaaccgagaagaactattttatggcacaacaactattcatctatactactcatctatactactttgactctacaaaaaaagaagaggctggatttccccagtctcttctttttatttctatgcttctgctactgcaggagcttttctcaacaaaccataaatcacaccagagacgactgctccgatagcaataaacaccaaatacatgattgggtgactcagtaagaatacaacaaaaattccgccatgaggagccagtaatttgattccgaaagcaccgactaatccgccagttaaagcagaaccaataataaaacttggaatggcacgaatcgggtcagctgctgcaaatggaatcgatccttccgtgacaaacgaaagtcccatcacgatgttcgtcaaaccagcatcttgatctgttttgctgaatttatttttgaacaaacgtgtagcaacgaaaatcgccaatggagggaccattcctccagccataacagaagccatcacaacacttccgccagtggcaacagtcgtagctaaagttgctgtaccaaatacataagcggctttgttgattggaccgcctaaatctgccgccatcattccagctaataatgcaccaagtaaagcagcattcgaaccactcatacttgtcaagaaaccattcaatgcatcattgattgctttcatagggacattgaccagcaacatcaggaaaccagtaatcagtaagccaaacactggataaaagaggatcgttttgattccatccaatgattttggtaagttcttgaataatttacgtaaaaatacgatgacataaccagccaagaatccaccaatcagtgcgcctaagaatcctgcgccacctgtattagctaatgcaccagcagcaaatccaacaatcaaaccagggcggtcgccgatacttgaagcaataaatccagctaataccggtaacatgaacccaaatgcagcttgtccgatttggttgaaccagctagcagcttgattgtagttccccagattcgataactggtcatgcggcacgccaataaattggtcaatcatgaaagaaagagcaatagcgattcctccaccaataacgaatggtaacatgtgtgatacgccattcatcaaatctttatagattctttgtccgacagtaccatccgcgtttccttcttctgaactattttcttttccgtcgccatggaatactggtgcagtaccactaagggctagattgatcaactcttctggtttacggataccatcactgactggacgattgatcaattcttttccgtcaaaacggttcatctctacttttttgtctgctgcaacgatcacgccttctgcacgagcgatgtcttcagcagtcaatcggtttttgattccttctgaaccgttcgtttcgactttgatctccactcccatttctttcgcttttttcttcaaagcatcttctgccatgtaagtatgagcgattcctgttgggcaagctgtaacggcaacaacgaattttctttctggatgagcagaagcttctgcagcttgtgtttcttgttctgctttttcttctgcttctttttgctcttcagctgtttggaacaagtcttggacttcttctggtgtacttgcttcttttaatttcgctacaaaatctgcatcaatcagcaatcgagatagtgctgctaatgcttgcaagtgtgtgtcgttcgcgccctctggagctgcgatcatgaaaaacagataagtcggctgtccgtctaatgcttcataatctacacctttttggctttttgcaaataaaactgttgcttctttgactgcactatttttcgcgtgaggcatggcgattccgtcaccaagacctgtagaggtttgtgcttcacgagctagaattccttctttatatgtgtcgatatcggaaatccggccggcatcaaacattttttgaaccatttcatcgatcgcgccttttttatcagtcgcttgcaaatccatgatcattgcttctttgaccattaaatccttgatattcatgattatcctccttgaaactaatcaatttttgtgatttcaacttctggcaataactcatcaatcagttcgcgagctgccaagtcatcagaaaaagccgttgcgcttccacaagcaactccccatttaaaggcttcgatcggatctttcgtccggctgtaagcaccaataaaaccggcaatcattgaatcccctgcacctactgaatttttcaatgggcgaaccaatacattcgttttataagttccttgttctgtaaagagcaaagcgccgtctccagccattgagatcagcacattctgtgccccttcagctagtattttttttccatacggaatgatttcttctacagattggaaggttgtattgtaaagctcagctaattcgtgattgtttggtttaatcaacaacggtttcttaacaagtgcattttttagatcatcacctgttgtatcgattacgaaatctgcacctttttctcgaatgatatcaatcagttcttgataaaatccttttcgtaggctggctggcgcgcttcctgacaatacgacgatatctccttgttctactgtccctagtgcttgcttcaattcattgatttcttcgtctgaaatagctggacctaaaccgttaatttcagtttcagtatctgattttagtttgatattgattcttgtatcttcttgcacgtgtgtgaacaaagatttgatttgttctttttcaagccacttcgaaataaattcgccagtgaatcctcctaaaaaccctagtgctgtagattgagaatcaatccgtttcaaaatacgggaaacattgatcccttttcctccaggcaatttgaagtcttctttcatccggttcaaatcacctatttttaacccatctacgcgtacaatataatcaattgatggattaagtgttactgtgtaaatcattgtattgcctccttaattgttgtcttttcacggaattcattgatgaattctaatggacaacgctcggttatgatcgtggctgcttccaaaggtgcaacagaggtgaaagacaactggctgaatttagtatgatcaatcaatacaaaggtctcttcagaatttttcatggctaaacgtttaacagctgcttcttctggatccggagtcgtgaatccttgctcgatatgcgcaccgttcattcccataaacgctttattgaaatgaaaatgttttagttgttctatcgcattagatcctaaaacagcattggttgacagcttgatcgttccacctaaaatgatcgtagcaagctccaaatcaactaaatttgccgcatgttgaacggaatttgtcaccactgtgatttgttttccttgtaaaaaagggatcatttctaaagtagtagagccagcgtctaaatagatgacatcttcgtcattaatggtttcagctgccaatttggcaatctgctgtttttcatgaacgtttttgagtgatttttcactcatattctgctcaaaattcaataattgctctttcttagcgccgccatggactctttctagaaaaccaccattctccaactcttgcaaatcacgccttatcgttgattctgaagcattcaaaaggtttacaaggtcttgtgatttcacgattttctgctgttcaagcaagtctagtattttttgtctgcgttcctctgtaagcattttcacgatcacctcaatacaaataatagcatattttttttagactcgcaatacaaatcagtcaaaatcgttcacaaaaattataaatcggtcaaaaaaataaaaaaccagtctttttttgactggtttcctactttatttgactattatcaaactgttttatcgtttgttattttcgcttcttgtttttttcatataaacagaagcaggttttctttccttatgaagaaggtaataataaagtcccatcccaccaaacatgaccaagaaaccgatgactgatcgaataggaaaattaggaacaaaaaagagacagacggataataatgatgctggaaccattattcgataataaagttgtttatccattttcttcacctcatattttttgtaaagtaatcaattgttctaattcgcgataatctaaaaactgcacacgcagatgcttctcgcctttcttgacatcaaattggacacttcgccgttttttctttattcgtttgaaggcaatatcagtgagtctgtgtttgatttcctttaacggtaaatccggcagtgcttcagaaggaacatagattcttaatgataaaagataatcttgatatttctcatctgttacctctatttctagatattccctgatgtaataacaatacgcttcgattccattgtccaaagcaacagtcggatcgatgatcttatagcacatcattcgcgcgcgattctcgtcaacccaaggaaaatacgcctgggcattcagtgttccgcgaacacgtctttctttataatttcctccttgaatatcataacttttcgttacaaagaacgaggcattttttttgggaacaggttgcatctgcgcattttgatactggacagattgaatcgtatgatcagtataaatgtattcaacaaatggtggtttcagcaatcccacgccattatcccaagcaaggtggtcaaacccaagctggtctctaaaataggattggaatagctgattgtttgttttttgccaattgaatgggtctcgataaagctggatatatatgacttcgttatctaattctttcactttttctacttgttgtgtatcgagaaaaatcggtttggggatgatctgatggtaatagtgactgtaatacatttcccaacatgaggtaaaacataagccttgataaaaaagatcgtagcctggaaattgattgcaatccactactacgtcgccatttttctgtttcattttaggtaaacgctcgatttcatccatcgtctcaaacagcagccgctggggaatctgttttgtattgtgatagataaactcgctataagctctcatataagcaaacacaccatgggcaatcatttttttctgaatgaaatctcgaatcaaaaactggttttctttgaaaacagggatagccaatacattttttatcaacaattgattgccttccaaacgaaaactacactcgttctcgtcattccctacaactaaccagctttcgtctcttaccgatgcgagcattattttttcttgcagtttcctaagatcatacggctccgcttgttgagcgaaagagcggataaatgttggctggatcaacagacgtgtcaaaacagcccaatcgcttatttcctgttttttttcttcctcatttaagtctgtgagctggatagtcattaataatttatcttcaccaatcattttctcacctctttcaaatctttttataattcaattataacgaatgataaagaaaaactaaaactttttgtcttagaaaccaattttaggtattacatggtaaactaagtaaaaaaggaacaaagaggtgttcgcgatgggattgaaatttgaacgtacagacaatttagataaacttttcgaatcatttgctgtcgatccggaaaaaacagttgcgccaaaagaagaaatcgatcggtttctaaaaccgcagccacaaaacgaaaagaaaaaagacaagaaacaaaagtaagataagttctgcaaaaaaagacttactagccaaacttttatggaagagtttggctagtaagtcttttttattctttttatgattcgattgcttgttctattgctgcccatgcttcttctttcccttgttttgtaacggaagaaaaaagaataaatgtgtcattacgatcaaaatccaatgcttttttgatctcgctttcgtgcttgttccatttaccgcgaggaatcttatctgccttagtagcaacaacgatcacagggatatcataatacttcaaaaattgatacatctggatatcttcttgagaaggcttatggcgcagatctactaaagaaacgaccgcacgtagttgttctctggtcgttaaatatgtctcgatcatctttccccattttgctcgttcagttttggatacttttgcatacccgtatcctggaacatcgacaaaatgcaatgcattctcgatcaaataaaaattcaaggtctgggtctttccaggcttaccggaagtacgcgctaaattctttcgatcaatcaatgtgttgataaaagaagatttccctacatttgatcgccctgccagagctatttccggcaattgtgtctctggatattgttttggtgccactgcacttatgatgatttcagcttgatggactttcatggtctctctccttaaaaaggtgatgaataaagcaagcggctgtcgtaaaagccaaaatgacttttacggcagcctcttctcatcaacccgcttttttctctgaatctttatagatcactgttggctcaccagacaattcagctgcttctttggtaataatcactttttcgatgttttcatttgaaggaatatcaaacatcacatccatcatgatttcttcgatgatagaacgaagacctcgagcaccagtgttgcgttcgattgcttttttcgcaatagctctcaatgcttcaggttcaaattcaagttcggtatcatctagagaaagaagtttttgatattgtttgactaacgcattttttggctcagtcaagatccgtaccagatcatctgttgtcaatttctctaaagctgccataacaggtaatcgtccgataaactcaggaatcaatccgaatttcagcaaatcttcaggaatgatatgctgcatgacgctttcgtcttcagaaagtttttggttttgtgtaccaaatccaatcgttttttcgcccatgcggttcttcacgattgtttcgataccatcaaacgccccacctacgatgaacaagatattcgtcgtatcgatctggataaattcttgatgtggatgtttacgtcctccctgaggcggaacacttgcaacagttccttctagaatcttcagcaaggcttgttggacaccttcgccggaaacatcacgagtgatggatacattttcgcttttacgcgcgattttatcgatctcatcaatatagatgatccctttttctgcacgttccacattgtaatcagcagactggagcaatttaagcaaaatgttttctacatcttcacccacataaccagcctctgtcaaacttgtcgcatctgcgattgcaaaaggtacattcaacgtttttgctaatgtttgtgccaaaaatgttttccctgaccctgtaggtccgatcaagcagatattgcttttttgtagttcaacatcatctgtgttctcttgtgcttgctgattgacacgtttgtagtgattgtatacagcgacagctaacgagcgttttgcgcgatcttgtccaatcacgtagttattcaatacttcaagaatttctagtggtttagggacttcagtgaattcgcgtacagcttcttcataaaattcttcatcaatgatttctttacataggtcgatacattcattacagatgtagacccctggaccagctacgatttttttcacttcttcttgggttttcccacaaaaagaacagcgtacggtctcattgctacttggattgtcatacatggtcttcaccccttaacttgcaaaaagtatgcaagaaactatcagagactttacagtcttttactatcataacatagtttagtaaaaagaaaaagtgtttaacaaaggatcgattgacctatatttttgtatattttcacgcttaacaaaaaataagggactgtgacaacaaacatgtcacagtcccttatttcatgacctctattacttaatttctattcttttgcttctgtcgctgtacctgtgatcaattcgattgcttttttcattgtcacatcatgttccagcatatcttctgtcaacacgcgtttgatttgttcgattggcatgttgtatgtttctgataattcttggatttctgcattgatttcttcttctgttgcttgaagattttcagcagctgcaattgcttcgatcacaagatttgttcttgtgcgcatttctgcttcaccttcgaattgtttatgcaagtcttcttctgtagaactagttaattgatagtacatttcaggagagataccttgacgttgcatgttgttcaagaattcgtccattgaacgatgtacttcatcatgaaccatcacgtgcggcaattcaacgatttctgcgttttcaacagccatacggattgctgcttcatcttttgcatcgtccgctgctttttcttttgtttctactaattctttgcgatatttttctttcaattcgtctaatgttgatacttcgtcatccacatcttttgcgaattcgtcatctaattcaggcacttcttttgcttttacttcatggattgtcactttgaagactgcttcttttccagcaagatcttctgcttgataatcttctgggaaagttacatttacatctagactttcacctgatttatgaccaactaattgatcttcaaatcctggaatgaatgaacctgaacctaattcaagtgagtaattttcgccttttccgccatcaaacgcttcgccatctacaaagccttcgaagtcgattactactgtatcgccattttcagctgcagcatcttctttgataactaattcagcttgtgcttcttgttcacgtttgatacgtgcatccacgtcagcatctgttacttcacggtcttgtttttcaacaactagatctttatattgtcctaattttacttctggtttcactgttacttcagcagtgattacccaatcttgacctttttccatgctttcaacatcgatttttggttgagaaacagggtcgatgccagcttctttgacagcagcttcataagcttctggtaatacagcattcaatgcatcttcatataaagcttcttcaccgtacatacggttgaatacttgacgagaaactttccctttacggaatccaggtacgttcaagctttttttcactttattaaacgcagttgttaatcctttttggatttcgtcttgcgcaatcgtaaattttaaaacaccatcattcgtgccttttttttcaaatgttgcagtcatttaattccctccgagtttagaaattcattttatacatcaaaaacgtttcatgcatacctttaaatagtacactaaccctttcaaattgtaaacatattgaatgggtagaatccttgtttttcataacatttttatctttttcactgataaaatctaatggaagaagatcatttgctgcaaaattttctctcgttttttaaaaaaatcttgtttttcatcttccgtaccatcatacatcgtttttcctgtacatgcctctacagtcagttgaaaccaacgcctcgggtcttcaatgtatgtatcatagacaggataaacgattgcagattgcaacgtaaattcttctttcagcaccgaactaagtagcgcatcttcattcccgtaatgatctgaaaacacacacaattgtcgataacttgactgttgctgtggcttaggcaaatctttgggtatgactttgactagtttttcttcaatcgtcaaatagaaaacagggttgcattcattcaattgcctgagtgtctccagcaattttgccctcgctaaaatatggacctctggtaatacaatcagtttactcgctgtttggataaactcatggtaaggaagctgttcgatctcctcgatagacgacagctgacgtgctggttccaatgaaggaagttcctccgattttttatggagtgccttgactttttgcctctccatttgtccggacaattcttctgcaaattggattttttcaatgatacgctgctcaaaagattcataaaaatctgtacttgctatcaattttctagcatataaaaaatcttgtgcgctgattaacaagtcaaaataaaattcagcaaactcctcgttttgaagatactgtttttcatgtaagagtgcttgtttcaacgcttcttttttctcgtctaactcataaagacaaaaaacaagcaggctattagcctcaaagctttcttttaactcgtaagcacgttgaaatagttcttttgcctgctgatattgctggtttgctagtgcttgttgggccactcgcattaaattctcatatttttctggaaaatcaatcggcttcacgcagtgtcctcctcttgcttatgttcagctcatgttcaatagtagcaaaacaaaaaaagcatgacaattaaaaataatcgaagcatcctctaaaagctagatttttaatctgacttttagaagatgcttcaaactactgttttttatggatcatcagctgttaacttcttggttgaatgctttgatcagattaatcgtaacgacacttgtattagtgaaaagatctcccagatgctgctttttctgattaaagattgctggaagataccctaacatcagcaaaggaaactttagaatgaaccgacaagcaccttctctaactaaaacagttgaccagctaagttcttcttcatcaaaactgatgactcgaataccgaagatcattttcccaatcgtttggccatgattgagtttcgtcaataaaacaaaatacgctaaataaatgagtaatgctgtgaatccatagagactcaaatacgaatctgaaaaattcagccaacctagatttttggcaataccaagtgttaaacgtgtaatagctccgatacacaaaagatcgatcaagaaggcaaacattcggatcaaaaaacctgcatagaaataatgaggaaaatcatttgcttttggtggttcattttttgtgtcagtatactttttccatttccgttgtttctttttgatttcttctgacgtcatcggttctctttcaaaagagctcagcaccttttgggaaaagcttggatcaggtcccacagcaggctgctgctgcctctctcttccttgttccttattttcgtttggaagttccgtcatgcttactcacctccgtaataatacattgcttttggtgattctgcagttccgagattctcaagtattgataagatctgactagtttcagaagatttcaatccttggaactctgccagtttgctccctaaccatgtgctggcaaatccagatgatgcggaggaatattctactaattcagcatcttcaagtttttgttcctttcgcatagcttgtaaggcgtcttcagggaatcccaattcatcgactaaacctacttcttttgcttggacaccatcataaatccttccatctgctatttttttgactgcttcttcagatttatttcgtccctcgctaacgattcttacaaatcgttgatacgcactatcaatatacgcttgaagcactgcttcctcttcttttgtctctgggcgtgttcctgaacccatatctttcaatgcgccacttttcactgttgtgtcttccacacccagtttttctaaaaggcctgaataattcaatcctgacatgatcacaccaattgaaccggtcactgtttcttcggttgcaaagattttatctgcttgagcagaaatatagtaaccaccgctagctgccatgtttttcatactgacatacatcgggatatcatgttctttacggatcgtatctaatttcttagcgatttccgcactttcatagacaccaccaccaggagagtttacttctaaaaaattcctttgactgttggatcttcttccacagctttcagttgttccatgaaattttcatggttatagccttcagaagcaaataaaccagaagatcctcctgcagcaatcgtaccatctactgttagttttacgattttttgcgtactgtctccctcttccaacacatttggtactaactcttcatccccgtataaccaactgttcaacccttcgacttgattgttttcctgaggcttagtcaaactcgccgaaactaacgaaaccacaaataatcccgcagcaatcagaactgctgcccaacgttttttattcattctttctcctttctaatacaagttttttatgacgattacagtttctgactgctcggaagcgtcgaaccgctctgctttttcttcacgcgcatacccggaaaatgattcttttgtccattcatcttctaccgtaaactctcgcgcttggacaacttccaaggcatcaggtgcgatttcctggatgctatcccaaccagtatctaaaaatatttttgtgtcatctgatacaccagctgatgctttaaattcggacaattgtttttttaaccttccaagtgtcatgatttcgatttttgaatccatttttctcctccttcatcctattactttctattgtaccgaactcctgaaaaagatgatagataaaaaccgattattttttgacacaaaacgcacccccaaaaggaaattcgatatataccaatttatttttattctttttttgttgacaaaaacattcgcaaaagggtatgattttaaatgtttccagataaaaaataaaaaaggaggatagttataccttttaggatagcgcctggtctgtgtaaacagatgacgaggagagggtttatcgaaagattcggcggatgaccctagggactgcactctacagaagatccacaaaaagtatctgcaaagataaaacaaaaggattttcctgcagctggaagcattcatacgaattcattatagaaagtaggatgttttttatgtgcggaattgttggaatgattggattaaaaaatgtaacaccaggattgattggcgggctagaaaaattggaataccgcggttatgattcagctggcatctttgtctcagatggcacgacagatcatttagtcaaagcacaaggcagaatccaaaatttaaaagatagaataacttctgatactacaggaaatataggcatcggccatacacgttgggcaacccacggacaaccatctgaggaaaatgcccatccacatacttcacaaagcggacgtttcgtgctcgtccataatggcgtgatcgaaaacttcgaagaacttaaaaatgcttatttaacagatgatcactttatcggtgagacagatactgagattatcgctcatctgattgaaacttttgcgaaggatatgacggcaaaagaggcatttttaaaagctttgcgcatcatcaaaggttcttatgctttcgctttgattgatcgtacaacacctgatgtgatttatgtagcaaaaaacaaaagcccattgttagtcggacttggtgatggattcaatgtgattgccagcgatgcaatggctatgcttgctcatacgaagaaattcgtcgaggtcgaagatgaagagatggttaccgttacatcagacaaaattattatccaaaattttgcgggcgacattatggaacgttcttcatttgaagcgcaagtagatgcttcagatatcgagaaaggcacctatcctttttatatgctgaaagaaatcgacgaacagcctattatcatgcgccgtattgctcaaaaatacgtaacagaagacaatcgggtccctcttgatccaaaactgatcgatacattatctgacagcgatcgaatctacatcgttgcttgcggaactagttaccatgcgggattagctggtaaacagactttggaagaattgacacagattcctgtcgaggttcatttagctagtgaattcggctataacacacctcttctttcaaaaaaaccattctttattttcttgagtcaaagtggcgaaacagcggacagtcggcaagtgctggtaaaaatcaaccgtcttggctatccttcacttacgattacaaatgttgctggctctactctttcgcgagaagcgtccttcaccctattgttgcatgccggacctgagattgcagtagcatcaacgaaagcttatactgcacaaatagcagtactgactttattagccaaagctatcggtgacaaaaaagaagtagaaacttctctttcgttcgatatcactcatgaattgagtttagtcgcaaatgcgatggaatcggtcattgcccagaaagattatttagaggagctggctgcagaatacctcagtgacacaagaaatgctttttatatcggacgcggggcagactacaacgtttctcttgaagccgctctgaaattgaaagaaatcagttacatccaggcagaaggttttgctgctggtgaattgaaacacggaacaattgctttgattgaagaaggaacgcccgtgatcggaatcatcagtgaagaagtgactggcgcgcatactcgaggtaatctgaaagaagtcgaaagccgtggcgctaaaacattagttatcgtctcagaaggattagaaaaggaaaatgaccaactagtactgccagcagtccacccttatctgtctactcttgccacagtcgtaccgactcaattacttgcctattacgccacactattacgagggtttgacgttgacaagccacgtaatctggcgaaatcagtgacagttgagtaacgtttctgtacgggaaaacatttgatttttgcagtcttttgtaaaaaataaaagcatagtatgtaccgaacaccaaaaaatttgatttttagtgttcggtatttttactttatttcccgtttactttttaaaacctcgtttcaataaatcgttcactttctctgtctatgatattggagttcctttaataatttggcttttaattccgtttcttcaactacttcaagtaaatcaaaccctttttgcattaattttgtatcgttttggcagtaccctaatcttacgaagatcgcgcctagaaaatcagctcgttttgctcgtttcgcaatatcttttgctagattcaacatatatcggccatcttctacaagatttttttgtatatatatttgagagatattcatcaaaagtgtcagccttactgtatcgacaacatccaatcgattatatctatcaagcgtagctaatagaatcggatacattatttctaacgtgctgatttctagatgaaatgaaatgatcgcaaatatttgaatatctcttaatgtccacacctctatttttgaaagccgctgccaaatcggagtcaccaaccctttgcattctgttttatcaaagaccataggatcagcagataaatacaagcgtaaaatcaacaggatttcttctatttttttatctgaacaagtagatgtaaattctaaacatcgtctatacaactttcttatctgtgcactttctgtatttgaaataatagaataaagatcctcaataagccttgtacggttatctctattctctatatttgccaaatatctaaattcatctaaagatacatctatcctctctaataaataacaagcattttcaaaccttggctccgtctcatttttttcaatccgcgaaagagttgtcctatctaaaaaatcattacaaacttctttttgagtcattcctttccctttccttatatatcgatacatttcgccaaacctcaattttttctccctccaaaatttttgtgagcttatgcaacaaatctaccaaaaacaattcgatgattataaaatataagggtaacaaagaaactattatactcatattataacaaaaacaaaatggaggttgtcctatgataagaaaaatgcttattatttttgtcactacaattgttgtttcctcactcgtcctgacttctactgcaatcgtctcccttgcttctgaattagatactaccactatcaagcctgatgtttacaaaaatgatagttatatagatgctaacggcaatagagggactggtagaataaccttgactgaagcacgctggagttctacctatgattttcgatggtaacaaaattaacgctcttacgctggtctattctcttttttgatagtatagttgcttctcttgttttgtacttccttattgcggacgggcaaaactattattacgtctatctattggctcaaattcctagttatattattcttgatcatatccacaaaaaaataggattaaaagcagataaagcatgcaaacgtgctattttactagtgatgttgatttttttcatctcttacattggtataatatttcttacacaatatgtttttaaataaaagaaaaagcaaagaccagcgacgaataaccgtcactagtctttgctttttctcttctatcttaggttcttaatctagaccgatttcttctttgactactgctgcgattttatcgacatagtaattgactttctcatcggtaggcgcttctgccatcacacgaagtaatggttctgtgccggaaggacgaactaggattctaccttctgatcccatttcagcttctgcttcttcgatcacttttttaattgctggaacatccatcgcaccatttttatcacttacgcggatattcactaatttttgcggataaatcgttacctctgctgcaagctcagataattttttacccgtctgtttcataatattcaacaactgaattcctgaaagcatcccatcaccagttgtgttgaaatctaagaaaatcatgtgtccagactgctcgccaccaaaattataatcgtttttgcgcatttcttctacaacataacgatcaccgacttgtgtaacgacatctttcagaccgattccttctaccgctttgtggaagcctaagttgctcatcacagttgtaacgatagtgtcttttttcaagcgatttttttctgctaagtatttagcacagataaacatgattttatcaccatcgacgatattcccaagttcatctaccgcgatgatgcgatcgccatcgccatcgaaagctagaccagcatctgctcctttttcaacgaccatctcagctaaacgttctggatgtgtagaacctaccccatcattgatgtttaaaccatctggatttgtgcccattgtatagaagtctgtttcaagatcagcgaacaaacgattgacacttgttgaagttgctccgtttgctgcatcgacacaaatcgtcaaaccggaaagatcgccattgatcgtttgtacaaggaattgagaatatttcaataaaccttctggaaattcttctacagttcccaaaccatcagctgatggacgaggcaattcatctacttctgcatccaataacgcttcgatttctagttcttgatcatctactaatttaaaaccgtctgcaccaaaaaatttgattccattatcctgcgctggattgtgagaagcagagatcatgactcctgcacttgctttttgtaatcgtgtcagataagcaacacctggcgtagaaatcacacctagttggaacacttcgatacccaccgataaaagtcctgaaatcagcgcttcttctaacatttgacctgagattcttgtatcccgccccactagtacgcgtgggcgttttccttcttcttcatgctggcttaggacataacctccgcatcgtcccagcttaaatgcaagttctggcgtaagttccttgttggcttcaccgcggacgccgtctgttccaaaatatttacccatagttgtaaaattactcctttaacttaattttccgaggaatttgttctgctcatttgtgttgattcgcttgtttgcgatgtttcttctgtactcgtggatgaactgcttgttgcagatcccgaactagaagaaatggacgttgttgttgaaggtaccgttactgaatcagcagatgaagtgcttgtacttgtatttgtatcttcttgtgtccgactgcttgtcgaagcggaactgctgcttgacgtttgcattacgggtgtaatctccacactgactgatttaggtttgatacttagtccttcttctactggtatttcgattttacgagttgttcgatgactgattcctgagacattgatcggtacagcgatactgtcgccgattgatgcaagcaaatcgctagatccgcttacttctgcttccaagtctgaaaaactgaaatcatagctttcaaccccagcagccggtgttccttgttgcgtcccataaagtcgtaccgttttgcttggtttgattgcatcagctttcacagttacttgcactggatcggaaatgatacttaatatttctcctgctgcattcagcgcttgtatcggcactttactattgatgccatcatccgtgaccatcgaagcatccacatcagctactactcgtttgatttcggccaacgttttgtcacctgtagtgatagagacttttttaggactaacggaagtatcatctagttcatatccagatggtgtgatcgttgaagggatcaatgtttccacatcgaaatcttttgtcacctttttctcaaccgttactgtaatagtcgatggttccatctttgctgtgacagcactgctcaagttctgaattttcagcggaacttcatgtgttccttcgccaagcttattgatatctgcagtgatgcgaaacatccgtgtatcttcgtttgcttctgcattcaactggactcggttggcactggaaagtttgaccgtcactgtgttttcatatccatggatataatagcgttgcgaatcatatgaaattttgattggtacaccagtgactgtttgattatacgcttcatttccagaaagcgtgttttgaacggactgtccatttgcattgaagtacagtgcaatactgaacagcaatgcaataaaactgtaaagaatacttgtccgtttctcttttgagatcatttgcgatcccctcccttagtcataccgtctaggaaagattgaatcacgtttttcttattttttgttttctcttcagcaattagttctctacgcaagattgccaaatattcttgctgggataagccagccatcagttcattgtctaacgtgatgctgacgtccccggtttcttcagagacaacgatggtgatcgcgtcgctgacttcgcttataccgacagctgcccggtgtcgagtcccgaattctttagggatcaacatactttctgatagtggaagataggcgcttgctactgcgatctttccttcttttacaataactgcgccatcatgcagcggtgtattaggaataaagatattgatcagcaactccccagtgatatctgcatctaaagcaatccctgtctcaatatactcatctaatccagtatgacgttcgatagtgatcagtgcaccgatttttcgcttggacatatattggatggctttgtcaaaagacaagatcatcttctcatcttcctgctgttcgctttttgattgtttgaaaagcgaactgcgtccaagatgttccagtcctctccggatttccggctgaaaaatcacgatagcagctatcaccccgtacgtgatgacttggttcatcaaccaagacaaggtgtgcagaccaatgatttccgctacgattcggataacaataaaaatagctacacctttcagaagctgaatcgcttttgtgcctcgcagcagttggatcagtttgtatacaagataccagacaaccagaatatcaagtatgttcaccaaaaaattcagagagaacaagtcaccggaaaacatttgctgccaatagtccaaattaaaaagttccccgatttgaaatgacataaaaagcctctcttctcttttgagatttcctctctagtatatcatatgttttaattttagaggctgatctgctcgtttttttcttgagaaaaacacataattttcaagaaaattacaagtatgcgttttatttttctctagaataaaattttttaaacctcagagaattattcattacattttttctgttatttttcacttttttcttctgtaacgtgttccatttttttacgtcgttctgctctggcggctcttcgggctgctcttctttcttccgcttcaagatccgtcgttttttcttttttcgtcttaacgactacatcaatagactcttctggttcaagtcttttcttgattttttctaattctcctgacagtgcagcatagttgtaaaaacgtgttttagcatcttggacagtcttttcaaataaagcttttgcaagatttggatttgcgttctctagcgaggaaaagcgaacttgtttcctcatgaaatcaggcatagtagagaaatcaggttttttgtagtccaaagtcattggttttttgtttttttcgaccattgtagggttatatcgatataatgaccaataaccagaagaaacagcttcttttgcttctttaagcgattctttcattccaccaagcaaaccatgtgtgatacaaggtgtataggcaataatcagagaaggaccaggatacttttctgcttcttcaaatgctttgattgtctgcatttgattggcacctgaagcgatttgtgctacatagacattcccatatgtcatcgccatcatccctaagtctttctttgaagcatattttccactagctgaaaatttagcgattgccgaagctggtgttgcttttgaggtttgaccgccggtattggaatagacttcgttatccaaaacaaggatatttacgtctgctccgctggcaagtacatgatcgattccgccaaaaccaatgtcataagcccatccgtctccgccaatcatccattggctgttttttacgaatagatctcttctcttgtatataccttccaattcagggacaattgatcgttcgttttcgatcgctgcttgcagttttgctgctctttgttgcgttccttcactctcaaagagatgttccaaccagtcttccatcaattctcgcagttcttctgatacttttggcaatacttctttgattgaatttgccaaagcctcacgacgagtctgtgccgccagaagcataccataaccaaattcagcattatcttccaataaagaatttgaccatgcaggcccttgaccacatccgtttgtcgtataaggagaagctggagaggcaccgccccaaatagaagaacagcctgtcgcattcgcgatcatcattcgatcgccgaacatttgtgtcaataattttacataaggtgtttcgccacagcctgagcaagcgcctgagaattcaagaagcggttggttgaattgtgtcgataaaaccgtatttttccctttcaatggattttctttttgtcttagcgtcattgcaaaagcccaattcatagcttgttctttctgttcttcataaggtttcattactaaagctttaccttttgcgggacaagcctctacacacagaccacaacctgtacagtcttccactgaaacttggatacggtattttacgccgtctgcgcctcgcatttctctcacgataaatccttctggcgcttcttccatttcctcttcatctgctaaaaatggacggatggcagcatgaggacaaacaaaggcacattcattacacatcgtacagcgatcactaatccactcaggtacttctaaagcgacacctcgcttttcaacagaagccgttcctaaaggcatttcgccagttgtcattccatttgctacaagcgtaccaacagagagatgattcccttcctgtgcattcaccggctcaaggatttcttgtacataccccctgtttcttttattgattttttcaggcatctccaatgttttccaattttctggaatcacaacttcatgaagcagttcgattgtccgatcgattgcctgtatgtttttttctacgatagccattgatttatgcccgtagctttttagcgcttcttcttttagcaacgggatcacttcatcaaatggaatgatgtcagctaatttaaaaaatgctgtttccattgccgtattgattcggcgtcccaaaccaacttcttgggccaatctcatggcattgatcgtatagaaccgaatgttattttcagccaagtaacgttttaattttatcggcagatgcgtttctaattgttcgtcactccaaagagtattcagtaaaaagattccacctggcttcaatcctttgaccaagtcatagctatgcaggtaagctggtgtgtgacaagcaacaaggtccgcatgctcgacaagatacgctgaacgtatcggcgtatctccaaaacgaagatgagagacagttagaccgccagattttttcgagtcataataaaaatagccttgagcatatttgtctgtgtgatccccgataatcttgatggctgatttatttgcaccaactgttccgtcagatccaaatccccaaaactttgcctggaatgtttgcggttctgttaaatctagactttcttttgtttccaaagattgataagtcacatcatccacgatccctatggtgaaccgttttttgcgtatacttggatctttttgcaattcatcaaaaactgccgagatttgatcgggcgtcacatctttcgaacctaatccgtagcgaccaccaataatagccgggcgaaattcagaatcatataacgcactttgaatgtctaataaaaggggttctccccctgctcctggctctttacttcgatcaagaacagcgattgcttttactgtatgaggtaacttttgcacgaatgtttccactggaaaaggtcgataaagatggatattcaaaaaacctgttttccgtccgtttgcattcaaataatcaactgtttgctcaatcgtctgtgcaactgatcccatcgaaacaatgacctcttctgcatcagctgctccgtaataagtcaccaaatcataagaagtacctcgtaatcgattgatctctttcatatatttttgtacgattgcaggtaacttatcataatacggattgattgtttcccgttgttgaaaatgaatatctggattctggttcgtgccactaactgtcggatgattgggattcatccctcgtttacgaaaagaagctaatttctcctgattgaccaaaggagctaattcttcatattccaaaacttcgattttttgaatttcgtgactcgtacggaacccatcaaagaaattcaaaaaaggcaattcgccttcaatggaagcaagatgggcaacaggtgctaaatccatcacttcttgcacactgctttcagctagcatcgcaaaccctgtttgtcttgcagccatcacgtctccatgatctccaaatatatttaaagcattcgtcgtcactgcccgactagcaacgtgaaaaacacttggcagcagttccccagcaattttatacatattcggtatcatcaaaagcaacccttgtgaggcggtatatgtagttgtcagcgcaccagttttcagtgaaccgtgaaccacgccagctgctcctgcttcggactgcatttccactacttttactggttgaccaaatacattttcttttcctgctgctgaccattgatcgactaattcagccatggtcgaacttggcgttatcggatatattgcagcaatctcggtaaaagcataagaaatatacgcggctgccgtattgccgtccattgttttcatttttcgcatgattcatcatccttgttcatattctctcttattatctgttccattataacgtaaaatattccattttttcttttatttagaaaaatatttcacatacgtctatttcaatcatttttttagaaaaacaatctaaatcgttgcctttttttgtcagacatgtgtaaactataaccgaaagaggtgtttttacatggatatatcagtgattgatgcaacaaaaacaactacagaaaaaggtattacttatggttcatcagatgctcctaaaaaaatgattgaattcatcaacttagcttgcccatattgccgacaatggtttgaagaatctcatgagctattggaagaagccgtccaaagcggtcaattacagagagtgatcaaattattcgataaagaaaaagaaagcttgcagcgaggaaacgtgatgcaccggtatatcacgatcagcgatggacaacaagcaatcaaagagatcaaacaaatattcgatactcaagacgagtggaaacatctttcgctccaaggagtagcggattttgcagcagataaattagggctggcagaacaaaaagacgaacagctgagccaagctatcatcaacgaagctgagcaagcacatattcgatttgttccaactgtcatcttgggtaaagaaatctttgatgaatctatttcaaaagaaaaactaaaagaattgatccaagcaaaataaaacaacaagggggctgtgactaaagtcttgtcacagcccattcctagtatgttttttccgaataaacggtgttccagaagtagcttctgtcacaacctctccactaaacagtattcaatcagatatagtttccagtgatcgtttgtgcgttctttaatcctcctggaatcccttcataaagaatatttccaccaccagatccaccttctggtccaagatcaatgatccaatcagcacttcggatcacatctagattatgttcaataacaatgaccgtgttccctttatccactaagttattgataattcgaatcacattttcgacatctgacatatgcagtcctgttgttggctcatctagaatgtatatttgtccatttgttttcaattcattagctaatttcagcctttgtgcttctccgccagacaaggtatccatcggctgtccaagagtcagataaccaataccaacttcttttagattctcaagctttcgctggatctctttctcatcaaaaaattcaagtgcttcttctatggtcatatccataacttctacgatattttttccacgataacgataatccaaaacagctggatcatagcgtttcccatggcaatttgaacaaactacctctgatttgtccataaaggatagattaagctcgattacacccgttcctttgcattctggacaagcccctttagaattgtagctgaaatatccagcatcaacttgattttctttaccaaaagctttccgaatgttattcatgattccactgaatgtggctggatttgaccgtttgttcgtatggattggattttgatcaataagtaggctttctggaaagtcttttacaaatacttgattgaccaatgtactcttgccagaaccagctacccctgaaacaacggtaaatacacctttagggatttctaaacgaatattttttaaattatgcaaagagctctggcggctaatgaaggtttctgaaaatgtccgtacttcttttttgattggtaattgatgtcgcaaatagtttcccgttaacgtaccagaatccagtaatccatcataatccccagtatacatgatctcaccgccgtgacttccagcataaggtcctacatccacgatatgatcggccaccttgatgacatcaggatcatgttcgactaccagaactgtattcccctcatcccggatttttttcaataaatcattaagtaggtggacatctctaggatgcaatcctgtacttggctcatcaaaaatatacatcatattagtcaaactgctagctaattgcttcaccatttttactcgctgtgattcccctccagataaacttgaggtctcgcgtgtcaatgtcatatagcctaatccaatatcaatcaaatcttggatacgttttttgatactggcaatcaacggatgacgctctttgttatctaacgtttctagtatttgtaatagtgaagataattcttttgctgttaaatcgtatatattataaccgtttattttagagtttaggacttcgggtgagaaacgttttccttggcattctggacaagtatccatcttggtatatgtctcaagaacctttgctgtttttttcgttgtttctttttcagtatggacattggttcgcatgaatcgagtgacaatcccttcataagtcacattcatatctcccgcacttggtatattgattctctctgcttttccatacaataatcgatcgtattcttctgatgtgtattcggagattggtttgtttgggtcgaataaaccagtctctgcatacattttccaataccaagtccctaccgtgaaattgggaagcaagattgctccttcatttagtgagcgtgtcgcatctacggcggcatcgatattcaatgttatcgtttttccaattccttggcagacagggcacataccttgaggatcattaaatgaatacgcattggcataacccaatgacggttcagcaaagcgtgaaaataaaattcgaaaaagtgcctggatatccgttgcagtacctaaagtggatcgagcatttcctcccagtttcttctggttgatcaatacagctgtcgataaatgcttgatctcatcaatatcaggtctgctatatttaggcaaaaaattacgtgcaaaactactaaaagtctcattcagcggtctgcctgcctcctgtgcaatcgtatcaaaaacgatagaagatttgccagatcctgatacgccagtaaagatagtaattttattttttgggatacgcaaatcaatgtttttcaagttgttttctcgtgcatgaatcaattcaatatactctgtcatccttgtttctcctttaaaatcgatttttaaacaaatctatggcgaacaacgggcagtaatagggatttatagtttgacagaagaagaaaagaaaagcaagtaatattttgtcaaataaaaaaactgatacatccgcatctctgcttcatgtatcagtttttacattggattacactgcttcttcacgtagtttttccgcaaattcattgattttgcgtatgcggtgattgattcccgatttggatatcgcacctgagggaatcatttcccctaactctttcaaactgacttctggatgctgaagccggagttcagcaatttcctgaagtttttcaggaagggcatgcagaccgacctttgcttcgatcaattcgatgttttcaatttgtttagaagccgcatcgatcgtcttattcaaatttgctgtctcacaattaactaggcgattgaccgaatttctcatatcccgtacaatccgtacgtcttcaaatcgtagcatcgaattggttgcaccaatcagtgtcaagaaatcagcaatcttttctgcaccttttaaataggaaatatagccattgcgtcgttcaagcgttcgagcatgcagtccgtaataattcaacatatcgcaaatgtcttggttatgctgttcataaatggaaaatatctctaaatgataacggcttgtttctggattattgactgaacccgaggccataaaagccccacgtaaatacgaacgcattttttgcgaattccccatgatctcgtccgaaacgtgtccattgaacatcataccatccataatatcaagatccatcaacacatcttttgtgccttgcttcaagcggacgatatagacattgttcttttttaatttcatttttttacgaacgagtagctcacttcgtacctgataatgatctttcaaaagagaatagatacgtctggcaattgcagcattttctgtttggacgttcaaaataaactgctggttcacaatacctaaagagccgttcattcgcaacaaagcagctaattctgctttcgcatgttctcgatgaacttccaaaccagttagttctttcttcacatctgcagcaaatgacatcctattctcctcctttctccaacaataaattgcttaatattttgaaccgaaaactaatcggaacaattcttctaccactttgtctccatcatggaagacaccaccgtctttcaattctaagaaatcggtagaaatcactcgacagccttcatttctcaatccatggaaatcatgtgcaacttgtactaagtactcatcatagatttccgggtccatataatcttctggtactttttccgtattaactagtaccgtgtcgataaagggctgcttcaaatgcttgtgtaagacacgtatatgatcggcatcggtgaagtgttcagtttcccctttttgggtcatgatattacagatatacacggtttcagcagttgtattaatcatagcttcgccaatttctggtatcactaaattgggaaggatgctagtgaataaactgccgggacctaaaacgaccatgtcggcatccataattgctgaaacgacttttcgtgccgctttagcttcacttttatcattcgtgttgcaaacatagacatgatcgatcgttttgcgatcaatcgcaattttagattctcctactgcagtcgttccgtctttaaagaccgcatgcaaggtcaaaggcgtttctgaagaagggtagacgtgtccatctacatgcatcattttcgctaataattgaatcgcctcgtatgtgcttcctcgcatttcggaaactgcagcaatgatcaggttaccgatcgtatgattcgctaagaactgatcttcttttttaaaacgatattggaaaatatcttcatagaattgcggcatatccgataacgctactaagacatttctcaagtcaccaggaggagccatagcgatcgattctctgattgcgccgctgcttccaccatcatccgcaacagtcactactgccgtgatatctgctccctgatttcgtaaactttttagaataaccggcagacccgtgccaccgccaaccactacaatctttggtttccttatccggtaggttttcattttcacgaccggttcaccgtctctttccttttatccttgtcccgatgtgtcacattgactttatatgtttttcctaaagcatttgccaaacgttcagtcaacgccacagaacggtgttggccgcctgtacagccgattgcaaccgtcaagctgctttttccttctttgatatatccaggcaatacagtttccagaagatccaagaatttatggtagaaagattgtgtttcatcaaaggacattacataatcatagactggctggtctttaccggttagtggtcttagttctggaatataatgaggatttggcaaaaaacgtacatccatcacgatatcagagtcaatcggcaacccatatttaaagccaaatgatacaaattcaattcgaaatccttggtctccctttgacttgaaagactcgttgattttttcgcgtaattgtcgtggtgtcaatgtcgtggtgtcaatgatcacggaagcttgtgctttcaagtcgtctaatattgcccgctctttacggattccttcagtgatcaaaccgtccattgccatcggatgcgctcgtcttgtttctttgtaacgagcaactagttcttcgtccgaagcatctaaaaacaagatagaagtgtcgatgaagttcgtattttcgatttcaatcagcatgttttgaatttcttcaaagaaggaacgagaacgtaaatctactcctaaagccatttttgtgactttacctgattctttgatcaattcccagaattttggaatcaatcgaggtggcatattatcgatacaaaaatagcccatatcctcaaaactttggatagctactgtttttcctgcaccgctcatacctgttatgatgactaattgcaaattatctgtcatatttacgaacccctctcacattgtacataataaaattatatcattccgggcgtatcattaccagctttctttctcttttacaaaaagatttggaccaaatatcttttaggatatttgccccaaatccaagatttttctacttttcagatactgtatctaatgcttcatttctttcagctaatgcacgttcgatcgtccgatccgctaaaatagattgagcatcgatcactgggtaatggttatcttcggcaaattcatgcatcaaagataattccgtgcaacctaggataactttttcacagtttaatcgctctaccgcttcctccaaaatctcatagtagagttcttgattcaagtgatctgactctttgatttcatgatagatcaaataattgattttttcttgaagcgcagtatcaggaatcactgtttcgaatccaagatttttgacttcgcgttcatagattccagctttcatacttccttctgttcctagaatcgctactctccctgtcgtatgctgacggacaagttcatttgctgcttctcttggcatatgcaggataggaatatccgttgccgcttgtaattcttcaaaaaagtaatgtgctgtgttacaagtcaacacaatgaagtttggtcgcaataaattttgtttctcaatatcgtccagcagaaacggcattggattttcttctgatcgatctaaaatataagctgtacgatcaggaactgttgcatgattgaataagacataattcaaatattcttgatcttttgtagctttcgttcggtggttgatcaagcgaacaaaactttctgtcgccatcgtgcccattccgcctaaaatactgaaaaaattctccatgaactagccttctttcacatgaaaatactttttgaatcttggaatatagttatggaacatatatttcatcaacatccagcgcttgattgaccgatctttttcataaaatacagtagtgccgtaacgattttctttgatcatttgctcagctagttttttgtcttcattttcccgagcatattctaaaaagatttttttgggcacacccatccataatcttgctttatctgattgattcgttccataggtcgtttcaacaaagggtttgttgaacactcgatcttctgtgacgaaacgagccagattcaagccgttcaatgtcacaaagaaactgctacgtccttgtctcaaattgatttcaaataatttatattctccatctctaggatcatacttcatatcgaaattggcaaagccggtatattcgattttttccaaaaatgctttaatggtttgatagattttttcgttataatctggcatgatcacaacgtaatttccaatcgatgctggtgtaggatcttctaacagtggatgaccaagacacatcatccgaacttgatgatcttcatcaacatacgcatttagcacacgcatattactatcatcacccgggataaaatcttgtacgatcatttcactagtataaccggcttcatagatccgacctaagatcaaatcaaactcttctctcgtttctagaataaacgctttttttcttccttcaaattgaacagaaaggtactccacactgtttgcgggtttcaaagcaaccgggaattcaaaaggcaattcctgttctaagcgtccatttactaacatttcttctctgacaatcaatgttttaggatacggaagatcatattcttcacaaacttcataaaagcttactttattgatcagtctttcaaataaagaataatcaatatacggacagataaaatattctgacagctcttgcttatgttgagagatcaattctgcatacccatcaccacaagcgatcaaaagatattttttactcttatcagaatatctttcttttgccaaacgaagcatcgtctcgataaatacagggtctttatcaaatcctggaatgacttctacattgacgattttactgtagcgggtaggggctaattgatcagaagcatatgcttggcagactttgccgtatgcttcattaaaagaacgtgccataccataaacgttcatgtcgcttcctaataatatagggataaattcttcattttcaatactgttcatcattatctctcacttactcataatctcttgtttttcttttctaactacacaaggaatatcataccataaagaaaaaagcaatcaaaggaaactcctccgattgctcaattcttttttgaacggattgaacttataggaagtttttatctataccaatcagtgtagaaagaactaccatgtaatgattctagaacactggtattaagaaaacaagcaaaaattcatttttttatgtttttttaactatctcagcaatctttcttctttataccattatttttttcaaatagtgacctgtatagctttcttttacatcaatgatttcttctggagttccagtcgcaaggatcgttcctccgccttctccgccttctggtcctaaatcaatgatatgatcggctgttttgattacatctagattgtgttcgatcactaaaactgtgttaccagcgtctactaatctttgtaacacttgcagcaaacgggcgatatcgtcgctatgaagaccagtcgttggttcatctaaaatatagaaattctttccattagagattttgtgtaattcactggcaagtttcatccgttgcgcctcgccgccggacaatgtcgttgctggttgtcccatcgtcacataccctaagccaacatcaacgatcgtttgcagtttgcgatggatctttggaatatgcttgaagaattctacagcatcttctaccgtcatttccaaaacatctgcaatgctttttcctttgtaatgtacttctaatgtttcagagttatatcgtttgccatgacatacttcacaaggaacatagacatcaggcaaaaagtgcatttcgatcttaataatcccatccccacgacacgcttcacaacgaccgccttttacgttgaaactaaaacgacctttcttatatccccgcatttttgcctcgtttgtttgagcaaataacccacggatatcatcaaagacactcgtataagtcgctggattacttctcggcgtccgtccgattgggctttgatcgatgtcgatgatcttttcgatactttcgtagccggaaattgtcttgaatttacctggcttggcagaattcttatttaatttctgcgctaatgatttctttaagatactattgaccaatgtactctttccagaacctgacacacctgttactgctacaaattctcctaaaggaaattcgacactgatatttttcagattgttttctgaagcaccagtaatcttgattgctttcccattacctttacggcgttcttttggcaccgggatcgattttttccctgaaagatatttccctgtcaaagaattttcatcattagctacttcttcaggagtacctgcagcaatgatttgtccgccttgttcccctgctccaggtccgacgtcaatcagataatctgctgcccacatcgtatcttcatcatgttcgaccacaacgagtgtattgccaagatcacgcattttcttcaatgagccaatcagtcgatcattatcgcgttgatgcaatccgatcgatggttcatctaaaatatacagaactccagaaagattcgatccaatttgcgtagccaatctgattcgctgtgcttctcctccagataacgttccagaagcacgactcaaggttagatagtctaatccgacattttctaagaatgaaagtctgtcatttacttcttttaaaatcggtttggcaatcactttttcttgttcagataatgtaaggtttgagaagaagtctactgctttttggatagacaattcatttgtttgcccaatattcgttccattgatttgaacagataatgcttgaggattcaaacgataacctttacacgtctgacaagtcaattcggtcatataaagacgcatttgctcacgcgtgaaatcactgttcgtatcatgataacgacgttcgatatttttcaatactccttcgaaagttgtttctacatcgcgaacgccaccaaaatcattttcataatggaaatggaaaagttcatctgtcccatttaagatgatctcctgatgttcttccggtaattcttcgaatggtgtatccaaatcgataccgaaactttcgcaagcctgcgctaacatttgaggataatattgagagctgattgggttccatggaacgattgcaccttgactaagcgtcttcgttctatctggaatgactaaatcttgatcgacttctaatttgacgcctaaaccgtcacagtctggacaagctccaaaaggcgcattgaaggagaacagtcttggttctagttcaccaacagtaaatccgcaataaggacaagcatagtgttcactaaacaacatttcttcttcgccaatcacatcaaccaaagcatagccatctgccagtcgcaaggctgcctctaaagaatcaaatagacgtgaacgaatcccttctttcacaatgatccggtcgatgacgatcgcgatatcatgttttttatttttctccagctcaggcacttcacttaaatcatagatttcaccatcgactcgaacgcggacgtatccctctttttggattctttcgaatatttttttatgttgtccttttttctttaccacgatcggtgccaatacttggatctttgtgcgctcaggcaaatccattacttgatctgccatttgatctactgattgactggtaatctcgatatgatcgttgggacaaatcggatgtcctacacgagcaaacaacaagcgtaaatagtcattgatttccgtcacagtacctactgtcgaacgagggtttttacttgttgttttctgatcaatagaaatcgccggactcaatccgtcgatgctgtctacatctggtttatccatttgacctaaaaactggcgggcatacgcagaaagactttctacgtatctccgctgtccttcggcatacagtgtatcaaatgctaaggaactttttccagaaccggacaaacctgtaacgaccacgaatttgtctcgtggaatcgtgacatctatatttttcaagttatgggcacgtgcaccatgaatcgtaattttatcgttagccatgttgtcctcctacttcgaagcttttaattctaaaatcatatctcgtacattagcggctgtttcaaaatccaaagcttttgccgcatctttcatttctttttctaatttcatcaataatgtgtctttttcttccttcgtcatttcttcgtacgagacttgtaccgcttcttttgtatcatcttccgattctttcgtaatagaaatcaaatctcggatttctttaatgatcgtttttggaacgatcccatgttcttcattgtacttctgctgaattgtacgacgtcttgacgtttcatccatcgctaaacgcatagaatccgtcaccttgtctgcgtacatgattactttaccttcttcattacgagcagctcgcccaatcgtttggactaaggaacgttcgctacgtaaaaagccttctttatctgcatccaagatagcaacaagggaaacttcaggtacatctaatccctcacgaagcaaattgattccgactaacacatcaaattcgcctaatcgtagatctcgaatgatctctgttcgttccaacgttttgatgtcgctatgcagatatttgactttgattcctaattctttgaaataatctgtgaggtcttctgccatttttttcgtcaatgtcgttacaaacacccgttgatctttttcgacccgttcatttatttcgcctactagatcatcgatttgtcccatgattgggcggacttcgattactggatcaagcagccctgtcggacggatgatttgttggataacggtatctgtttgttcatattcatatggtcctggtgtcgcagagacataaatgatctgattgacatgtttttcaaattcttctagacgaagcggccgattatctaaagcagatggcaaacggaaaccgtaatctactagcatctgttttctcgctcggtcgccattatacattcctctgatttgaggcatggtcacgtgcgattcgtcagccacgatcaaaaaatcttcaggaaagaaatccaatagcgtataaggcggttcgccttctttacgtccgtccatatgccgggaataattttcgattcctgaagtgtagcccatttctaacatcatttcaatatcgtaattggttcgctgttctaaacgttgagcttctagaagtttgttttcatttcgtaaaacagctaaacgctgctctaattctgctttgatattcgctacggcatgctccatatgttcgtcattcgtcacaaagtgagttgccggaaagattgctacatgttccgtttctcctaaaacttcacctgtcagcgcattgacttctcggatacgttcgacttcatctccaaaaaactccactcgtaaggcacgttcatctcttgaagccgggaaaatctccacgacatcaccacgcactcgaaaacgaccgcgctgaaaatctatatcatttctttcgaactggatactgactaagtcacgaatcaactggttgcgatctaattctgctccttgtcgaatcgaaacgacttgtttttgatactcaaaaggcgaacctaatccaaaaatacatgaaacggatgcaatgacgatcacatcatttctttctaataatgaactagtagccgaatgtcgtaatttatcgatctcatcatttacacttgaatctttttcgatatacgtatcgcttgaaggcacataagcttcaggctgataataatcataataagaaacaaaatattcaacagcattgttagggaaaaattccttgaattccccgtacagctgaccagccaatgttttgttatgggcaataatcagtgttggtttattcactttctcaataagattggaaatcgtatatgttttccctgttccagtcgcacctaataaaatttgtgcttttttcccgccgactacgccatccactaattggttaatcgcttcaggctgatcaccagccggttggtatttcgagacaagctcaaagcgtcgggaggtatctctttcaatcattctttgtcctccttttcattcattccttttcattttacgaccaataaaaagaaaaggaaagcaaaggcattccttactaaaaaattataccacaccgaacatactttcgccacttttttctctcattatctatgttacgttttataacatagaatgttagaaactcgtatttttttcattttttcgagcctacagtcttgtctgattcagcacttttcgcctataataataaaatattggaaatttaggaggttgattatgaaaagaaagcatttatttcactcatttgttttcttaatgacaggacttgtgacacttgcgtttggtcatgttgcacaagctgacaacactacaacagcagagtcaagcacaagcgagacaatgcaaaaaatagagcccaaaaaagacgtatacgtaattgccagcgactctgcttttgctccatttgaatttcaaaacgcaaacggtgagtacgagggtatcgatgtaaaattgatggaaagcatcgccaaactgcaaggattcaacatccgaatggactatcgtggattctccgccgctttgcaagctttagaatcaggacaagcagacgggatgattgccggaatgacggtaacggacgaaagaaagaaaagctacgatttttctgattcttactttgacagcggaattcaattagctgtcaaaaaaggcgatacttcgatcaagtcttatgaagatttgaaaggaaaaacagtcggagcaaaagttgggaccgaaagtgcagaatttttaagcgatcatgaatctgaatacggctattctatcaaatattttgatgctgcagatcaattgtatgacgggttgaaagttggcgcaattgatgccatgatggatgattatccagtaattggttatgcgatcaaacaaggacaagaattggaaacaccgattgaaaaagaatctggcggaaagtatgcatttgccgtcaaaaaagggcaaaaccctgaacttcttaatatgttcaatgaaggattgaaagaattaaaaagaacaggcgagtacgataagatcatcaaagaatatgtagcagatggttcagaatcttctagtgattcttccgcagctgatgaatcgacatttcttggacttatccaaaacaactatcaagcattgttaaaaggactttggcgaacgattctcttgactttgatctcctttgctttagctatagtgatcggtgtgatttttggattattcagtgtagcaccaatacgcgcgcttcgcacggttgctagcatttatgtcgatatcatccgtgggattccgatgatggttcttgcattctttattttctttggattgcctggtatcgttggatttacgatccccgacttcatcgctggtgttatcaccttgactcttaacgcaagtgcttatatcgcagagattgttcgaggcggaatcaatgccgttcctgtcggacaaatggaagcttctagaagtctgggtctttcttataatcggacgatgcaaaaaatcattttaccacaagcgatacgcatcatgattccatcattcgtgaatcagttcgttatctcattgaaagatacaacgatcatttccgcaatcggtgtagtcgaattgctacaaactggtaagatcatcgttgcacgtacgacacaaagtacgtatgtttatttgatcatcgcgatcatgtacttgatcttgatcacagcattgacaaaattagcgaaagttttagaaaagaaggtgaagtaagatggcagaaaaaatcttagttgagcatctagtcaaaaaatacggcgataacacagtattaaacgacatcaacgtatccatcaacgaaggagatgtcgtctgtatcatcggcccttcaggttcaggaaaaagtacattcttgcgttgcttgaatcgtttagaagaaccttctgacggtgaaatcattattgacggcgcccacttgatggataaaagcacagatatcaacttggtgagacaacatatcggaatggtattccagcactttaacctattccctcatctttctattttggaaaacatcattttagcaccgatggatctgaagaaagaatccagagaagaagcagagaaaaaagcaatcaaattgctacagacagttggtctagaagataaaaaagatatgtatcctgaaatgctttccggtggacaaaaacaacgtgtagctatcgctcgtgctctagcgatgaatcctgacatcatgctttttgatgagcctacttctgcactcgaccctgaaatggtcggtgatgtcttgaacgtcatgaaaaaattggcagaacaaggtatgacgatggttatcgttacgcacgaaatggggttcgctaaagaagtagccaatcgcgtcatgttcattgacgacggaaactttttagaagatggaacgcctcaacagatttttgaaaatccgcaaaatgaacggacaaaagatttcttgaacaaagtattaaatatttaaatttacttctatagactgagacaaagtcactgaaaacaggtatctccaaaagattgatgtatgaagttacaaagaaatacacctatctcttggagacctatttacttgacttatgtttcagcctttttatttttccgtgataacactatatttttgttgcacgaattccatcaagtatacatatagaacaatcattccacacagaatgcacacatggaacataccaaactcaaccctcgtccccgaattgatcctaaaagttgaagcatttgtattaaatattttaggatatagatataacaaaatattcttgagatcatattttcctagtggtggcaaaaaaagaaaatagcttcctaagagacataggctgaggaaagaattctttacgactgttgtaaaataataacaaactaaaaaggaaagaaatgcgaaccccaataggacactcaattgaagcggcgctttctcaagataagatatttgcctaattaacgcttcatcgatttgtgtcgatttgtcagcctgaacaaaaaatcttgaaaaagactgcaacatcaaaaataaactgagagaagcaagtataaaaatagttaaactaagaaaccctgctcctatcttatgacgattgatttgccattgagaatccaaacagcgcctgattttcattgtatggtatttgatatctgcatttgctattactatcccgtatacccccgaaaaaaaaggaaagagaacaaaaaacgaagaagacaataattgattgatcccgttttggacatttaaagctgcaaaactggaatgataagcaacgtaatgatatttcaacggattgtcaactatttcagtattttcgttcatactgatagaaaaaggttgttcaagtatttcttggatcgtttcaccccttgccaaggcttcctctacataatattggaaatgacgaaggtgactttgaatgagcattatttgagaaacgaacattaaagtagaaagcaacaatattactgaaagaaaaaggtaaaatattttcgaacgtctttgataataaaattcaaaaagcatttttacctcctttttgttgaaataaaaaagctgcgtagatcctcggacgtgataggttctatttttccgttttttacatttaataactcatcagccatttccaagtaatattcttcatgaccacttaagatgactgtagcttcttttttcagctgaactaagcaataaagtagcacttttcgattcttttgatctaatccattcaacacttcatctaataaaacaactcggggcgcaagcaacaatagcaatagcagcgaaagtatctttttttctcccagagaatagttcttaactttcacatacgataaaaatgaaaggggtaaaaaatcgattttttgtttagagattagttcttttatttgccgatttcttgtcagtaaaatcagattatctaatccagttagattcaagtaaaacggggtggagtcaaaaacacaaaaacaactacctgttttttcaatcgttccagagtagctatcaataccgacaatgcagcgaaataaagtggttttgccaatgccattatccccataaagataatagattttattttgatcaaatgtgaatgacagatgatcaaataagattttttgcccaaatcgtttagaaaaatcaataagtttcatagacaaactcctgaatagattagtaccatgtagaaccaccattaccatgtactccataataatcagtataatcatggctatatataactatatccccccatggagtaacacttcctgctccaattgtttttgttcctcgccaaagatgtgttgttgctgctgtactcgtacgaacaatacctcgtgttctaacaatgttaggaaaaatccaacctgcttcttgaaatccagaactacttgtcacccttcctccacttatattaaaatttatattatcacgcgaccacatcataaaagtcccacgatagaatgatgcacgtctacctgagcgaagtacatcagtttgttccattactttgttatttgtgaaatcatcaataagctgttcaggtttgatttgggagttagtaaacacttcttgaacagtttcgtctacttcaatattatttaacgttgtcgtcgcgtgcaccgagctagaaaacaataacaatgctttagtcgttaatagaattatcaatactctttttgcaacttccataatgattccctccatattttttacttttttaaattaaaatttctaatagattctcctttcacaatatttttcaaacaaatatatttttatacatatttgaaattcaaacaaatttattcaatcaatcgacttttttatttattcatattttaccaaagtatagtaatggctcattaacaactttttatcaatatagaaagtaatagccatccccttgtttcatttcctatattcctttcccccccctaataaacgctattgaaaactaggattactaagtgttaatacataaaaaaataaaagacttaccaattttttctagaaatagaaaattttggtaagtctttttgacacttgtgttttttactagaaaagctacttccgctttttcccgccaaaagcatctttgaatttatcgaagaaaccatcttcttgttgttcttctactttgatgccgccagcttcagcgaatgcacgtaacgcttctctttgttgttcatttagatttttcggcgtgatcagttttactttgacatgttggtcgcctgttgcaccaccacgtaacttcggagcgccttttccacgtaaacggaagttcgtacctgtctgtgtaccagcaggaattttcagtttcacatctccatggacagttggtacttggacttcatcgcccaaagctgcttgtacaaaacttaaaggcaattcatagtaaatttcagagccttcacggtcaaagatatcactttcttctacacggaagaccacatacaaatcaccaaatggtccgccgttttctccggcttctccttgaccagctaaacgcatttgttgtccttcttctaccccagctggtacattcactttgactgagtgagctttcttctcatgacctgagccatgacaggttggacaaggttctttgatttcttttcctgtaccatgacaaacatcacaagtttgacggctcatcactcgtccaagaggtgtttggcgttctacattgatcgtacctgcaccatggcatttatgacaagtagttggttgcgtacctggttttgccccatttccgccacaagtatgacagatctcttcccgattgtacttgatttctttctctacgccaaaaattgcttcttcaaaagataagtcgatcgtatattgcaaatcagcaccttgacgaggcgcattgggatcgactgaacgacctccccctccaaagaacgagtcgaagatatcttcaaaaccaccgaagccgccgccagagaagccgccgaatccaccaaatccgccaccagctccaccagcaccgtaatttggatctgtacctgcatgcccgtattggtcatatgcagcgcgtttttgcggatcacttaaaatttcataagcttctgatacttctttgaatttttcttccgcatcaggttctttattgatatcaggatggtatttttttgaaagcttacgataagctttctttatttcatcttctgatgctccttttgagagccctaagacttcataataatcacgttttgttgccataggctttcctcctattggttctcatcattttcacgtcgcttgttatcatatcatattttgtttgaaacaaaaaccgatacttcaaactatttttcaaaagaaaaagccaaagtagcaactttggccttctctcgaaattcagtgaactgattatttatcgtcgccatcgacttcttcaaaatcagcatcaacgacatcatctgctccgccttgagctgcttctgggttttcttgagcttgttgttgtgccgcttgttcgtatagtttaacagtcaagttttgaacgatttcgttcaatgcatcgcgtttagttttcatttcttcgatgttgtttgcttcaacagcggctttcaattcatcgcgagctgtttctgcttttttcacttcttcttcgtccactttgccttctaattctttcaatgttttgtccacagagaatagcaatgcgtctacatcattacgtaggtcaacttcctctttacgagctttatctgcttcagcgtttgcttctgcatcttttaccatacgttcgatttcttcgtctgttagacctgaagaagatttaatcgtgattttttgttctttttgtgtacctagatctttcgcagatacatttacaatcccgtttttatcaatatcgaatgttacttcgatttgtgggataccacgaggagctgctggaatatctgtcaattggaatcttcctagtgttttgttgtcagcagccattgggcgttcaccttgtaatacatggatgtctactgctggttgattatctgccgcagttgagaacacttgtgatttacttgttgggatcgttgtattgcggtcaatcaatttagtgaatacaccacccattgtttcgatacctaatgacaatggcgtaacatcaagtaaaacaacatcttttacatcaccagtgattacgccaccttggatagcggcacccatcgcaactacttcatcagggttaactgatttgtttggttcttttcctgtttctttacgtactgcttctacaactgcagggatacgagtagatccaccgaccaaaataacttcgtcgatttctgattgtgatagacctgcatcttttagtgcttgacgtactggtactttcgtacgttctactaagtcagctgttaattcatcaaattttgcacgtgtcaatgtcatttccaagtgcaatggtccagattcaccagctgtgataaatggtaagctgatttgtgtgcttgatacgccagataaatcttttttcgctttttcagcggcatctttcaagcgttgtaacgccattttatcttgagacaagtcaatgctgttttcttttttgaattctgctaccatgtagtcgatgattttgttatcaaagtcatccccacctagatggttgtcaccagctgttgacaatacatcaaagacaccgtctcctaattcaaggattgatacgtcaaaagtaccaccaccaaggtcgaatactaagattttttcgtcacgatctgttttatccaaaccataagcaagagcagctgcagttggttcattgacgatacgttctacttctaaaccagcgattttaccagcatcttttgttgcttgacgttgtgcatcgttaaagtaagctggtacagtaataactgctttttcgactttttcacctaagtaatcttctgcaaatcctttgatatattgaagaatcattgctgagatttcttgaggtgtgtatgatttgccttctacatctactttgtaaccagcttcaccgatatggcgtttgattgatgaaatcgtatttgggtttgtcacagcttgacgttttgccacttcccctacttggatttctccatttttgaatgatacaacagaaggtgttgtacggtttccttctgggttagcgatgatttttgcttcgtttccttctagtactgctactgcagagttagtcgtacctaagtcaataccgataattttactcataattaacgtctccttctttaattgaaagtgtaagttttatatccgcacaattattgtgcaacaatgaccatagttggtcttaacacgcgatcatgtaatttatagccttcttgtagtacttctacaatcgtatcggctggtgtatcttcagtcgctggaacagtttgtactgcttgatgaagattaggatcaaaggattctcctttagcagggattttctcgattccttcttcttccagtgcgttacgtaaactttccaagaccatttccacgccttttttcaagcttgctccttgatcatctgacacttctgtggctaatgcacgttccagattgtcaattgatggaagcaattttttggctaaatcttgtgaacggtatttttgtaattgctcacgttcattttttcctcgatttgccatatttgcgatttccgcacgagctcgcaaatatttatcttccatttcttctaattcagcttttaattttgctgattcgaattcttccgcttcaacttctgaaatgcctgaatcttctgcagcttcgacatcgatttccggttctggttgagcatctgtcatttctttatctagttcttcttgattttctttcacgatacagtcttcctttcattattcagtcagctgtttgattgctcttattaagaaagagagaacgatcagctgcaaatagcttcgttattcacattacgagtttgacaagtcaagtgatcgatagtaatcagcaagcttagctgctagttctcttcgataaacatccactagaccaaacatccgagaataaggcatactagtcggccccaacaaggctattgtacctcttccatgaccatctatctcgtaacttgcttgaatcatgctcatattctgcaataaatcattacctaattcagcaccgatcttgatatgaatattactatccatcggagtgatcatttgtgtaagtccatcggagtctttcataaaagaaaacatcgatttaaactgatcaagatcttgacggggctcataatccaagagattcatttgtccactgacataaactttttcttcaaatacatgaccaagaacggtgtcaaacaactgggacatcccttctgtcgtctggaaatatttatgaagaatcatcggaatctctgtacgtagtttatggtacaccgtcatcagaggatccccgactagacggtcgtttacaatttgcaccattttttctagttcctgacttcccatgtattcgggaagagtgaacacttggctttctacatttcccatatctgtcacgacaatcgcaatgatctgtcgattattcaagggtacgatacgaaagcctgttaatcggcggtcttttatttcaggtcccaacgaaaaagtcgtataacttgtcagctcagataagatctcagcagattgcttaatgatctcattgatctcgtgaaattctctacctaaagactgacgtatcagcagcagatcatcttctgctacgcgagcaggttttaacaaatgatccacataataacgatagcctaaagcagatggaatccgcccagaagaagagtgagtcttcaacagcaacccttcatcttctaatgccttcatatcattgcgaatcgttgctgaactggccttgactccctcagacatcaatgttttggaaccaacgggcacgccactactcgtatagtgttggatgatcagacgtaaaatgtcgttttgtcgctttgttaacatcttcctcacctctcattagcactcatagattctaagtgctaatccacttataaatatagcaagaagcccttctcctgtcaagagaaagacttcattttttagcactctatcgttcagagtgctaactctgagcaatcgctataaatccagttatatcaacgtttcaatagttctttattgtatttttaaacttttttatttaaattccgataaaaaacaaatattctttaaactatttttcaaacaaaaaacgctcaaacacattgtttcccaaaaaagttcctctaggtgtcaaataaatacggtcttcttcattaacaagtaacccttcttcctctaacttcatcaacacatctccgtataccgattcaatcgtttgttgatagcgatcatagaagtgttttttagcaatcccagttttttttcttagacccaagaacatttcttcttctatttgattttttcgtgtcaatttttcttcttccaataccgggcgttcattgactcgtaatggacgtaaatagtgttggattggtcctttgttgcggtaacgaatatttccaagataaccgctagctcctgctccaaacccaaaataatggtcattgttccaatacatcaagttatgctgcgactcgtgtccggaaagcccaaagttacttatttcatattggtgacgtccatgtttttccattgcttcaatggtctcttcaaacattttagtttccgtttcctgatcaggcagttcgagtcttccttgtcgtacccagttcatgaacattgttttgttttctaggatcaatgagtacaaagaatagtgaggcagatccaaagccaaagctttttccaaagtatcccgatacccttctagtgtttgtcccggtaatgcataaatcaaatcgatgcttacattggtaaaattttctgcttctaaaaattgcatcgtttgatacacatcttctgcggtgtgtttacgtccaatttttttcaataagcgattgtcaaatgtctgaactcccatggataaacgattgacgccatagtttttcatcacttgaagcttttcacgggttaaatcgccaggattcgcttctacagtaaactctttaccatcctgaaaaggcaagatctctctagctcctgataacaatcgatcaagctgtttagcagataaagaggttggtgttccgccccctacataaagtgtttccaaattcgctgtcggatgactttccagcattaatctcatttcattcagcagcatttccacatactcatctaccggttgcccttctaaaaaaactttattaaagtcacagtaatagcagatatgctcgcaaaatgggatatgaatgtacgcagaaaccttgttttctgcgggatttattgtttctatcattgaacttctttctccttacgtcgaaaagtcgtaccgattttcgaccactcttatatacgcatactaaacgtatttggcaaacaaatccactaaaaaatccaagaatcgacttcttggatgattttttctttcattgaactggttacctggttatatacctctagggttgttttcatgtctgagtgaccaacacgatccatgatggcttttataggtaatccagcttctgctaataaagagatatgggtgtagcggaatgtatgtgtgctgaccttcttttggaattccgggtatttttctttcaggatatcttgcacactacgaacggtttttttattgttgccacgaccattcagaaattcatttagcgaatggtaaacaactggcgtaccattttgcgtttggaagatcgtttcagaaaaaatgaattttttcgaagtagctatccttctattataagatgctttttctgttcgtttgtatgtttgataaaaattgccttcttctcgttgtttcatttctacttggcgtgcttgattgatcctgatcctattttgaataatttcgacagagcgtgtatctaaagcaatttctctaatggaagcaattgtttttggtggactgcgtacatactcttttacggatcgtcctgccgccactactccttcgttaattaaaagctttttcgcagaaaaatcgactttctcaatcgtcaaagcacttacttctccaatacgcagaccatttcgaatcataaattcaactaaatcaagataaagcttccccattttgttgatttctttattagtttcatatttttcatggatcgctgctaataaaatgcgtacttcctttttttctagaaatttctttttcctacgctgaatcgctcgaatttttcgatcattgggaatttttaatacaatcttattcaaatcgaataagattaaatcatgacgataaccataggaaaggatttgtttgagtaaagaacggatcttttctaacgttgctttttctaaaagggttttggtttgtttcgagcgaaccatcagaatatccgcacaagccccttcaacaaataaaggagtcagctgtttcagtcgcagattatctacgaaatgcggttggaggtatcggtgaagaatttctttctgataatgtacagttgtttgacgaaccgttggcgaccacgccttcagccaaagagccgtcaattcaccaaacgtctcacattgatttacatcagaaaacattgtatatttgttgaactctttttcaatctgttctttcagatagcgtagtgcttgtttttcactcttgaaaccttttgctttccaattgacacttttctttctcgtctttcctttgaccggatcataataagcctggaacgtacgcaaataattctttttatcgattgttgtatacgaacttcgcaaatactgtttccattctgacgaccgcagcaactcctcctcctttcgtaaaaataaggagcacaaaagtgaaatattttcttcactattgtactccttatacggttacattcactttttataactggatataattgcgctcaaattattcaacataggttgaaagttttcaaagttgattattttatagtttttcattatataatttgaaaaaatttcttttccgtaatgctcatcagatttaaaactcttatttctacaaaaagttttattattgattttatgttctagtgtttctgggagaaaaagatcttcaatctcgcattcttttttattgtctacgagtggattaactaacagatatgcactttcattcaaattaacatattcttctttttctaactctgtacatttattctcagctaatgaaatatgattaacaaattttctaacaggcttatttccttctgccaactcattatcaaatataaatatagttggattacttggcaattttttactgagacctttaaaatatttcatataattagtaatgttactatttttataatcataaaaataatgatataaattttgcatagcatctgcgccatctttattaagaccaaaaaaataatttaatcttttagtacgcttcaaaaacataattttatactcaaacttatgatcatcatttctaacaataagttcagggtaatttaaataatatttttttaatgctgcttgtatatatttaatatcagtttttccttcagttattacgattggcttatcatttataaagaagtacttataaaatagaaaagcttgatattgtttttctcttgcacttaaatttctaaagtcatgtttattcgagtctctatggttattatgtcgatcaatttggttgataaaggatagtctaccttcaatttgctttatagttcccgtgttaccttcgatttcaaaagtatcagttttatacaaactattcaacatagctcttgtttttttgtaatagcacctatctacatttatttttttattaactacaagaccagtcactatttgctttgaatctttataccgcaaattagtttttttctcattaatcttaaagccggctttctcaacttctccagaaagctcttcaaaaaaatattctttatcatctataaatcttttatcgtttgttgaaaaagttaaatcgtcgacatatctagaatagtctaatctatatcttttagctagtttcataattctcatatcgaaaatattacatattagatttgtaattataggagaacagggtgaaccttgtggcaaagttcctttatagcaagttaactgtgcaattattgtcgctacttcaagaggtaaatcaaaatatttattcttctcaaaaaaacctctcacccttccaaaatgaaaagactcaaaaaaattttctaaatctacgttaaaaacgaaacgtttatttttatgaacctcggcatttgtcattattccttttttcttttcaaatccatgcgaaatatttggcttaatttttctctttttccaaatttcactttgatagtctactagaatattcgctaaattcttttgaatatcttttaaatccttttcaggagcatgtatttttcttacacccccactttttttaggtatctcaaaagtagtatataattggtcagttccttttatatacaaaacgtatgttagtttctttttgggtatcctaagtttccaagctaactcagttctactttttatttcatttatttccatcattttattatctccaataataacgtgtggctactcattatgcgcatttaagcatgtttcagagtccttaggcctcttccttctgccaatctttctgaggtagcaaaacttcctgccattttagtcaatacttgcgaaacacaagtacaaaatctagccacacgtcttaatagaaataattataccaaaatatattaatttcacaattttattttaattagatttcaatactcccttttcagcgtattataggtcatttctgctattttgttgtcttcgacttttgcaagcagtaggattcggatgggcgatccgttttgaatacaatctagtaaaacagcgtattcgtcttgatcgttttgataaatggccgtgactttgccttcgcttcctaaggcgttcccagtctcgacattgatgccgttcatttggatacattcttctgtcattaagtcttttagtttttcattgcggtgattgattgttttgaaattcgcataagcttcttcatatgcttggagtaattccatatgatcttctgtaggattttctcctctatcctcttctacgatttcttgtgtttctgttggttgactagactctgcttttgcattctcaagcttcaagttactgttttctacagcttccatgatacttgaatcttttacactctcagtagtttcaacttgttcatctagtgaactacatgctaccaaagcaagtacggataaggtcgttcctaatagaaatactattcgtttcatcttcttccctgctttctatttgatgtcactcgaaccatttctttcgcaaagacgatctgagaaaatctacctggtgaaaactttacccgatattctttatttctcaatgatactaaaaaaccatcttcaaatcttctggcaacaaattcgttttgtgaacactggaatttggcgcagatttcctttacttgccttcttgttaatcctgggtgagtaaaaaacataactgatctccttttattttttccgcacaacactggctactcgattgaattctctcccccattgccgtgcgtatttggcacaaatttgtccttgttctgcattttgttcataggtaataaatttcccttcactttcgacacttgcaatgattcctgtatgtccatagattcctggagatagagcttctcctgcataccaattaatgacgtctcctgcttcgatttctgaaggtttaggatcaaatatgaccgcccatccgtatttttgccaatcataatcgctgccgatcgattgagcatacataaatcctgaacccatcatctgtggtccacctagttttcgaacataataagccgtgagcccataacattgaccaccattgatcgtttgccccatgacagattctaaaatatcgattttgcctccaccaatattagcggagcctcctcctaaagaaccttcgaataattgtttataccaatttacggcacttgtctttcgcttattttgttcgactggatcatcttttgttccggcacgttcccaatatttcaatatatcgactgccaacttttcaatttctgttccattagacatattcttcaataagtcactatccgatccgtcatgataccaggcaaaatccatttgaaaagccacagtcttccaatcttcattttgctctctggcaaggttcaacatgttcacacggcgactactatcccactgcgctaatcccatcgcatagccaccaatttcaggattatatgcccatactggattaaaggccaaatcactttggatgcgggaagggatcaatccactctcatgttccatgttaccgatccatgctgctgcaaattcctttgttcctcctttttgttgcacatattgagccacttctaaagcaacttgttcttgaggtgtacctggttcaaattctgacgtacttccattttgattggcggaaaatatacctataaataaaagaaacggtaacaaaaaggcaaaacaagttcctaaaatgatatacgcaatttttttcatttttcacctcactttataaaaaactttgtttatctacaaaaaagaagactgatcaattaccagtcttccattggttcctgttgttcttcttccaatgcatcaaaaaatgtttcttcggactccaaacttttgaaattctcctctatttgatgaatcggttctacttccgacgaatagttggcaatcaactctggatcatatgcatgatcaaaataggcttgttcctcttgtgctaattgtagttcgtcaaaattatcgactgtcacattcattttttcagataaaaccgttggatcaattggtatttcattctcactcattgctacctcatcctgttcaaacaacgcttctgggtcattcgtcaaatcagaatcagataaatcagacataagaacatcatccgaaaccaacgcatctgattcacttaaggattgatcaaaagtcggatctgcttcattgatttctgctaatacatcttctaatgctttgtcatctacttcttcatcaactagcacttcatcttctacttgctgatctacttgatccatttccattttatcttcttcagggatagacaattctgtatcatcataatcagacggacggaatagggatcccaatccttgcttgacaccagtaaattgattttcttcatccaaaaagtgttctttcccaagagtcattgctttatccggtagtatttttgataacccatttaaggctatgttcggatttcctgtgtacgcaccagcagctaattgtgctgcccctatgctcgcaccactaatttgttctgctccttccttagtcttttcgtttactttcttttcgaatatcggctgttgtatctgaccatcagcaaagaatcctagtattcggtaacgatttttccacactgtacttataaaaacaatttttacaagaaccatgatcaatctagttcctaatagaagaatactgcctgataagacattcaatagattttcattgattccttgagcagcatgtaaaaatacttgatcgattagttgattgacccaaaaaagaactgaaataaaaacaccatagatcactggcataaataaaatgccaatcagtgttttgaaaaatttaaacatgagcatttgacatctaggaaaaaaagaggctaatgcaaggattggaaatgcaagaatcaataggttcactaaaatctgaatgatagttaacatcatattaatgtataaaactggtaaggctaggataaacaaattcgcaacgcctacccaaatcgcaaagcttttttccattgtctttgacccatcttgagcaaaataaggattttcattttcaagtgaatcgatatattgttctctatcttttttgaaagtctctttttcttctttggacaaattcggtacttgtaatagttttgcctcgtccaatttctctccattctccatcgttccatccaatgaaccactattcacaaaataaaatgtctgtttgactgttgcatcaaacatcgggctttgatctgaatctgaaccataattcgtgccagaaataaactgatttttaactgtctttactatactgttgacagattggataaagaaactagacatattgtatgttccttgcctagtggttatttgtccaaaccaaccaaaaaacaacaaaaggaccacgacatagtgcaataaagattgagaaaaattatgtcgattggaaaagaaatgatacagcaagtagtaagcacttaacataattgctaaccccatcaacgtgcctctaccaaatcctgtgccaccaaaattccttaaaatttgtacagacatatcaaacatctctgcttgtttagcgataaaataatctgactgattcaatacactttcacagaacaaaaagaaggacacacatagtttcagaaaaaagaaaggcaagcctacaaagaaccaattaacaacttgccaccctttatctaataatccaccaccgaccatataagcatcatagctatcgatcaaaaacttcattgcagtcctcctttctaaacagcaaagtgattttccattactgaggcatctgaatcgtctacagtcttgaagagctccagccattcttcaaaaaggacatggacaactacacgattgacctggttaaacatgtctttcaataagcattgaccttgcaccatattcgagacccacttcatattttgttcgtttatcggcaaattcaaatactgcaggattccctctcgattctgcacttcatcaaagcaaataaccgtaccaaatcctgtgccatcttctttatcatccagatcattgaccgattgcgtgattaacactaagaagttattgaaggaacgaccgatccgtttcatagatttcaaaattgcttttccttctggcgatgattgaaagatccaactttcatcaaagaaagtcactgtttcttgttttggattgcgtgaaccgaatttcgaacaaaaggtgcccagtgcaaacatcaaggttacagacaagcgcttgttttcgtccatatgttcatttttatctgttggcagatccaaatcttcaatttctaaaatcgtcactttcttttcaaaggatagacctggaacttctccatgagaaaatgccaactctaaaatcgatcctttaattgtcgaaatcaaaaatctgcccatgtcttgtacatctggaatactactagaagctaacctttcaacaacctgccaaaagcctatttttttgccggatttacgttcttttacaactgttgcaatggtttcattgatctccgttttctgctttaagttccaaattccttcgtagatattggtcagcatggctttggctgtcgcaatggcttctgtttcatcaaatagaacgattgggtcaagtacgcctaggttctttttatctcgtatatctaaagtcacaaaattaaaggaacggacaaaagctgtatctaaaggatattttttctgatacattggatcgttgatcgttcgcatgaattgtcgtcgcatttcttttttcggatcgatatatagtactcgatctttcaatgtagcacattccatgaacaattttttagcagtcactgattttccatttccagtatcgcccgttaatgcccaatgcggattattggttttattaccaacaatatcttgtttattcgctaaaaagagattcatatagatcagattcttagaattcaataaaatactttttcggtcttctttttcttccaacgtcgtatcgacacgaccaaaataatagcctaagtttgttccagctttaagcgaagtgaagaaattcaactctgcaaaagattcaatggtactcgtatgttgccattttttgtctttcattcgcaggaagttcccaaataaagtggattggaaaagatacggatcatcgaatgttgcttttaataatgggatacctaatccatcaaatcgattgatcaaatatttcttccgtgcttgcagttgttttttagtgttaccactaacaactaagacaactttccaatcaagaatatccacaccatcatcgattttctgatctagatcgtctaaagaaagctgtccttctacgatttttcgtttctgctttgatccggctaaatgcgcttcttgcatgatatttttcgttcgagtacgtgcacgagcggaacgaccagataatgctaattgccctttactttccgcaaaagaagcttggattttcacttctactggaaaaggcattttttgcacgatttccagcaaatgatttccatctaaaaacacgccgatatctccgactggcaaataggaaacatagctttcgccataatcgcactgaaagtgtaagccaccagaaaaaataggttggatctttgtttccatcaaattttcaaatgtttggctcgctaagacatcttgacgttcatgaggaatattcttcagaaattggtaggcttgataataatacagttcgtcttctgtcaaacgttcgatcaatagttcggataaattctgatagatttcttgctcctgttcctggtaatctttcgcccactctttttccaatgccacatcaaatcctagccctttcacaattgtttctgttacatggttgactgctttggaaatattttcttttagatcgatagcaatctcttttttcaccaatggcaccccaatgatccaggcatattcatagaccatgcccatttcattttctaaaatctgtgctgttttcatcaatttatcaacacctactgcgtgattttcaggatcgatcaatgaacgcatggcacccatcttccttcgaatatctgcatttacaggtaatagattgatttcaaagccgccgctgccttttaaccgtttcagcgcacgggcaacttttttcttcgttttttgtttcttttcaaaatccgtcaacatcaccgtttcagaacgaatcctgtaataagcaatcgcagttttctcttgcgtcagaagcatattttcatgcatatattctgacaaagggtattctaattgcatctcattctccttttcttttttatcgtttgaatgaaaattcttctagttgatccactcgttcaaaagctatgattggacgtcgatctaaagcaaagttctttagataaatgataaaatcttttaaaaataaattggtcgatttcccgtctaattctgcctcggagtaccatctcgctactttatggggaacagaaagcatcagcaataaattcaggttgattccagctatattaggaatccttactttataccaaaagacccctgtgacaaaaagcaaaaagaataacatcaatagataagacatattcaatggctgagcgaagacccacagcgccttcccttttggtgacgagatcacctggatcgagtatggggctttcagtcctctggagtaatcgtaatgtttcattgtcccacctcacatagtaattccaaatagaccaaggaaccatttcactaaattgaaaatgttccttccttgatttgtagcaaaatcatttaaaatcaatgcaatcaaaatgaccgaaccaatcttaagccattctgctcctcgccaatgtttaaagatcagcaaaatgactgcaaaacttaaaagcgtgataaaacctgttcgcataaaattgtctaaattactcacattcataaattaatttccttccttttccgtaaagtaatgtttgagggtacgcacaaaataagaattttctgtttgagtaagccacaacgaaaaatcttctgtgtgggtcattcctgtttgtttatcgacaaaagtgactgaaacttgtatcccattgacttctttttgcttagtttcaaagtatttgatttcattctcatttaacgaaataaactctgtgacgccagaagtttgaacgggttctttcatcaataacatcaactcttgcttctcaccgtttgcatatttctcaaaaaatagggtcaagaatttttcgacagcctctttttcttgctgaggtacgtctaaactcgcttctgcttgttttagttctgttgttttaccttgtggcaaggtggtagctaagaaataagggcgccccacgatagagaacaactgattttttgtttggattggcaacaccatttcttgtgtcagtgtctttttctcctcttccttttccgtttcataaacgacgttcaaataaaccaataagcactctgcttcctctttgactcgaacgagtgaagcactcttcaatcttcgaacaaaatcctcttggttcttactcgtctcatccactacgtcgacatcgactgataaatacttctctaagcgatcgagtcgctcttttttctcttcttcattcgctgaagcatcgtaatttagatattcttctgcaaaactagtcgcataaaaagagagcgctgaataatcaaatacttctttttgtatcgacttttcatttttagatttagctaactgatctactttatctgttagattatcaaaatttgtagctacgacattggctcgaatgacacctactgcagaagcgatcattagtagactcatacctgtaaacacaattttatttgctcgtttttgtgataattttttgacttttggtttcttttcttttttctctttctttttgatggtttttagtttcatgagtcctcctatttcttttttttaggcaaaaaaatagacctagttaaacttgatttttcaaggaaataactagatctatatgctataaatgacaaaaaatagccgttaatttagctaagactactttttggctctgcttagccacacgaatataactaatgtaaccagcaagccccctagtactaccccaagaatcgtgtggacacttcccgttttcggcaaggtcgtttgttttttgggcgtctctgacttgttttcttttggctgttcaggtgttttgaagttgacagtttgttctttgttggtgagatcatcttctcgagcaacttcattgagttgatcttcttcgtaatagagaacgtgtgtagcggtcagctgatccccgtctttcactgtgttgcctttgagatctaaaaagacgtcgaactcatcttctttgctttttgccgtatacgtcgaggtagcttcactgaccacttctcctgttgtagtgttcttatattgcgtgaagacagtgtaggtatgcccgatctcgatggctgctcctttgacccataccgtgtccttcaaacgatgatcaaccgttggatcaagttttttcttcccatccatatccgtaaataaagacatcaattccaactgttctcgttcattaaacgcttctagtacgatcaattccccatccttttcaaccgtaactgaaaaatcgattgattcttctaatggtaagtaaccttccagcggttcgccttccacaaacttatattctccataaggcaatccttcgatattgatttcgcctgcctcgtctgtcaaatattcatcgagcaacacttctgtcgattcccctgcttcgtctgtttccagtttgaacaagttgaatggcacgttggctaatggttgttcattcaaacgatctcgtttgattaattggatattttgtcgggctaagcgatttggtacttccagacggatcaatgcgccggcatcttcttccgtcacactgaaaacaagtggttcttctaatggcacatatccttctggtgctttgatctcatggagttcatatcgatcgattccccaagccagactttcagtggtgacgatttcgcctttttcattagtttcaaaaatatcggtgctttcggtatcattcggacgttgcatggagacaaaatcgccttcaccctcatttgcccaggtgtcgaagattttgaattgagcgccggcgtacggaatgttttcgcctgtctcctcatccactttgacgatatgcaaacgagattcaatgattttgtcttccaacaagaagaaatgcgtatacccttcttcggtaatcgttacgacaaaaggttcaatcaacaagtaaccatcgacgcctttcgtttcttcaatcgtataggtgtcgtacggtaaattttcaaatttgaagtacccatttttgccagtcacttgtacatattcttgtcctgtggtatgagaggtggcagttaactcaacgccttctaatggcggtttgatatcttgatttttattgccaatttggttcaagatttcggtgatcgtttgtggtatcaatggacgagagccaaatttataaccttcaacatggcctttgatgacacgatcagtcaccgtgcgactatgaatagcaacagtctcattctgtccagcatacgttaactgaacggtatatttggttggatctagattgtatccttcaggtggttcgatctcctgtaaatagtaagttcctaattttaagcctttcaattctgcttgcgctacgccatttacatcttccatcgtcaattgaccaacagcggccccattcccatctgtcagttcataaacagccccgattagttgtgccgctccttgtggtgtattgcctgtttcttcatcttctttgattaccgttagattcgccaattgttctttattatccatcgttacggtcgtagtctcattggcacgaatcgtgatagtttgtggcgttgaattcaagatatagccatttggtgctttgatttcttgaatggtaacacgtgtatccacgagcaaatcattccaggtcgcatagccatctgatccagtggtgatttctctagattgaccatcagacgtagtaaaccgaaaaacggctcctgccaacggttgtttggtcgtttcgtcaatcttacgaatacgggcattgccgttttttaagacgttgatattaacagttgttctcgtagggtcactcgctcgtcccaagactacattttgtgtaaaaggattagtataaacaacaggaactccttgataattcgctggtatagcatacgcaaaaccaacgcttcctttttcattagaatttctattagcggttatcgtaagagagttattctcttttctcacacttactcccgctgaattaccgaatggcatactttcataattactaaatgcaccagttgtatccgttaaagtaatactttccccaacttttaaagtaattgttcgtccatcaaatgaaggttttgtataaaatttattgacattcgtcattacatttgtcttgaaaacttgatagtctgccatagaaaagataccagaaatactagtaggatagattccttgttgttcataagctagtatctgagtcatgatttctctttgtagcgtatgccccggtaagattataccgtaatacttgatcaatgaaattcttttcatcagttctgtatcctgtaaaaccgctgtatatcctccatttgagcctacattaagcgctacaccttgttcgatacaaagggcaatttgaccgtttacacgttttccataccacccatattcccggcttccattcgataagtgaatatcaatatttgccacattcgtagatggatctacgtaaactacttgattcgctgctttcgtcaatcgatctcccgataagatatcatggatcgattcattgacataggttgaaggagtcgtggtatacagctttccgttctctcctcgaatcaaattgtctttttgaagaaactgttcaactatgtttggtacgttttcttgttcattttggacactttcagttttttccgattgtccttgattattagtaatggctaaagctgtcatgggctgactcaaaaatgagccaaatagaatgccgagcatcaaccagattctcagcttgatttgatattttttcatatattcctccagtttttagttgattgcacgagaaaaagcccttcaacaagaaggacttcgacaatagttactcaatttaatagttcacctcacaaaaaaagaagacgaaaactcatcttctcattaataaaactctaaataatatttttctgtgccatctgaccaatattgcgtaatgatattatatcctctaatatttgaatttatgtctcgtaatttctcttctcctgcagaagaagctgctgcaaaggttgaatattgtgtaccgttaccggtataaggtactagtgggtacggtgcttctggcataggtatcggtgtcgtgcttcctcctattgaaccactggagtttccacctgcagatccaccactcgtgttgcctcctggagtgcttgtggctcctcctgtatttgaaccacttcctggattcgctggcggtgccacgggtgttgtgggttgtactgtaatattttcagttacattttgaactggtgtattcggtgttgcaggagaagctacagaatcaattgcttcagattgggtttcaggtacttccgtttgtttcattgcttgattcgcaactgcttgttcttcttgacgtttggcttcttcagcagccactcgctcagcctcggctttttcgtctgttgttattttttcttcaatagcttttaacggttcattaaacgactttctcgctttttcatttttgatcagttccacttcttttttcgcagattccaatgtttctctggttactttatctgttggcttgccatctttgtaaagttcttcgactacttttcgagctctttcaatttgggacagttgatttccagcagcttccattgcttgggtaacaattgaagtaaactcattttcttctagattttcaagtacaattttttctttctgttcttcaatcatttcactgtttaagtcatcgataatgattgcttcttcattgatctcagcattttcgatataaggtgttgaaaataaactgtttactgcttgtgtttgatcaaaaattacttgaacttcgttgattttctcgtctagcttcgtaatatctgctagttctttttgacaagtttcttggtcttgttttcttaacgtctctactttcttagcatgggattcagcttctgatttgtatttttcagtcgtcttcttcaatgaatcaatcttcgcttgagttacatcactggatagaaactgtttatgctcatcggcatatagaccagccatttccgtctcgattcttagcaattgttttttgtgtgtactcaattcactagtcacagcttctacttgtctactataattttgctcattgatcgtaaaaacagccattcctccagccacaataagtgtggcaccaacaacaccccaatgtaattttttcttcatctcttctcctttttcagtatatatttacctcattttcagtgagatttggtatcattcaaattaacatagctctaaaacttcaaattctttttactcacatggaactcctctcgttcttaaaaacagcatcagacaacattcttttagaaatcgttttctatatagtagcatgttcaagcttattctttctttacagttattttaaaatacattcattttttaaaaagttaaaacgttggagcgctcgtaggacatgttttctattggattgctcgcaatacatgtttattttttgtgcccgatccccataaaaataagttgctttataaaagcaatactcctgtcgaaggacaacgccatgtttatttcttacacaaagtccttcaataattaaatacgtatatttcgatattcttctttcatagcaaacgtctaatacggggcgaaaaggcagatcaggtcgcttcagacgttcccgaacttcctcatatacttcataatctttttgaatcggactggccgtcaacatcgtaaatccataatcacgtcttaaaatcaccgacaatggttccgaaaacgacactgcttctctcacctcttttctgtttttcttaatgattggatcaatgagtcttctaaaaattcttttttcaactttttgtacgctagctgctgaatgtgtttgttgactgaaatgcgatcctgttcgtaaccaggaagatattcatcttgcatctcaaagtatttctctgcccgattacgttcatatttttcgacaaaaaaaagatcctgttcttcaaaaacaagacctgacagcagcttttcaattttcagtaattcaatatatttatgaatgaaattatcaacggaaagaatttcttctggctgaaacaattctaaccgatgtactccaaattcggtaattttcctctgcaaaaaagcataatcaggctctctacgattttggtcataaaagatataaaaagaagtttctgctttacgcatttctgctcttaataaagcttttattttttctgcatcaaaatctacaaaagacaattcacttaacacatgccgaatcatttcttcgtaacgatccatatattcgccaaatctgattggttctccaagttgttcaaagttcatcattatcgttactcatcaatagttaaacgccacgcatattcttcccacacttctcgcaaaagctcttcatatcgaagttctctgatttgatgaaatcttttcaccataatctgacggctatctcgcaaagtcattaaaccatgtattattgctgcatcatcttcatggaaactagttttcctcgcttcccaaaagtcttttaattgtgaataaaacaaacaataatgctcttcgtaaaccatttgatgatcaaatatttcacctgtcagaccttttttctctaagtcagtccaaaaatttttttcaaaatcttccatttccaactcaaaaatctcatcagccatcaaactaattctttctcgtacgtctcgcattttctcactcctgttctattttatattttcatttatcctgaaaaaacttttttaacttattaatagctattcaaataaacaccgaaaaaagcaagaactaacattctcactctgataaagattattctcattgttcgttctctcttttgttttttgaattaaaaagagaattagttctttcaataaaaactactaaaaaagagatacccaaaactgtttgaaaaatatctaataaataatagggtaaggctaaaaatatgattaaacaagaaaatcctagactatagacagtaactttaaaatttgaaaatctaaactcaatttcctgatcagtaaccttatttttccgtatctgccaaatataataacagccatgaaaaaaagttaaagagaataaatttaacatgatcaacatggcacctaataacatagtcatactaccaattatttgatatatttttgcatgttcaaaatttaaatcactttgctgaggaaaatggaaatttaaaataatcaaaactgtatttcccagtaatactaaaaaagcaattgaagtcactggggataaaaatctccagatccaaacatcatccggctttaactttatcttaactttcatgattactgctactaaattaattaaactgatacaaaagcaaaaaatcaaccaagaccaaacctcactactcatcccatcatctccaataaaatttattattactgtcattttatcagagaatattaaccatttttcactatgtttttatttaattataaatatatgattcgttatttttcagactatttcattgtcttttatttcccattcaaaccattctgcaaaatcttgtttgaatccatctactctatgcttattctgtaaatatgcttctttctcatttgtcggatctagatatgtcggtttatcttctggacgagcgtataccccaatccaagtgacataatctccttcaaagtaaccatccacgatatagcccattttattcaaaatagtgattactttctgtttcaacccttcactgtttggcggtgtataatatttatactgctctacaaaatttttaaaatcttcaacgaccagatgaaatttctttcttagtttcatatagtcagaccagacaattgtatcccgccaattatcttcttgtttccctagaaaagttaaagagttgattcgttttatttcattgttgcatgcatctatttcagaagctcttttctcaattatttttttcaagtatggcagggtcaattcttgcgattcatctaacgccttcactttgttcatcgtgtttaataaacgagtaatgaccttttccaatgtttctttcatcctaaaactttcccatgtgattctttcaataaatttgtgttctaccacctattttacctccttttttagagctgatattcttcttccaagtcaaattcttgtttcatgtagttacgaactttgctttgtgtttcattggtaaataataagtcttttgcactcacacatacctgttcaatcatttcttcgtgtttttctttcaattcagcaaaatcgatccgttccatcaattcattggttcctaaacgaagatcaatcagtttgagcatttttagcgaaggcgcaagataattggagacccagcgcaacgttttatcgacggatggtttttctccctggacggacaatttcagacctttcattttgtctattacgtcataccaggatttacagtaaacttgcatcccatcttctatttcaaaaactgttaatgattgattgactatttccttgaccaaccaatctaatgtttcaccactggataaaaaatattcgacaaataaaaaagctttctcgtcagaaagccgaatttcatatcgattcttgatttcatattttttccgtgcttcttctacggaaagactttcttttcgtgctagttcaaaatctttttgatagaagttgaagtatagcggagattgtcgactgccaaaatatagagacaagcctttattgaccatttgtcctttttcatacgaaaagccaccactaaaatcaaaatttttgaatgtggtatggactaatccttgctccattttttctttcagactgtaaagatcaaaattttcttttccttcaacaatcaattcatccagagcaatatcgatccgagtgatttttgtatccacgataagattttttccaaagatatcatcctcatacagcgaacgaaaaaattctgtccaacttcggtcattatcctcttcaaaaatttcttccaactgacgacagccttcaccagacagatccagcatgattcccatatttatatcttctggatttcgaaacaatcgaatggctccataagaaaaggtttctgtataatgataaaatccacgagactcatgtgtgaaccaagcttgatccatatgcagcagcttttcgataatcgtttgaacatctaaggttttgaatcgaattcttaaaaaatcgatcttggcttctactgtagcttttccaccatctaaatggagaacatcaatgatttttgcctctaactctttggaaattagacgtttgccagattcgattttagagatcaaactacgttcgatttctagtttaactgctaattctttttgttttaaacctaattcttttctaaatctctttaaatcaacacctctcactgttttaaaccctacttccaaaaatgtgacaagattccttaaaaaatgtgacaaaaaccaaaacgcgcaatcccttgtgggacaaggcttaaacgtgactctttatagcggtaattaaaattctacccccatgttataaaaggggggtagattgtgtgtggtgggacaagcccaccacacacaaaccttgcagtacttgggatatttgttactacttacggctacaaagaatagagggcgagcgctcaggcgctgccctctattctttgaccgaaggacgcaacaatccctggcgactgctcgtttagctaaactttttgacatttgttaatgacctattcatatccatccacctgatacatagccaatttgccgttctattaataaccaaataaaatagctccaaacaaccagacaattgtaaaaacaatccaactgatacttcccacataaaagattttgttttcatcttcaaacgattttggtataattctatccaagatcgttttttgtatttgaaataatttttttataaaaaagacatgcaaaaaaacccatataaagaatgcaatgatcggcactaatcttattatttcttcaatcatttaagagtttatcctccaattttagtagcctttctcggaactttgtattttcatgtaagagatttttggtcaatgtgattaattctttcatatctcttttattctcttagtattccaattttgaaagtaaaatctcttcccgtttcttcttctcacgttcagacataaatacttttttcatagcttcttctaaagggatgttttcttctctcaataaaatgagctgctgaaaatcttctagatcagtttctgtaaatactttgtagctatacacatttccagcagtatttttggcagaatctcgtttaaactttcgatcagttaccttttcaattttgtttgcccaatttttcatggaaaattattgatgcagacagatatttcacttgtttcttaaacgattaaaagtgctagaatttccaatggtgttggaaattctagcactttttataagtattcttttgctctctttatcctcaaataaagaccgtgaccatacttcctactacgatcagcaacaagccgataatcgttaattttttttcttttggtgtcttattttcatgcaggatgtacataccgcctaatgtagagataactacgtttagctgtgtaatgatatatgcagtagcaaccccattttcattcgctgaaaaaatataagccaacgctgacacactgaagatggctccaactattgttgctttccaactcttatcttcagaaaatgcagttggttttcggaaaatcacataaataactgcccctaaaaagacaccgatcatttgcggaaagaaaatggaaagtccgcttgcatcaactagtttgggcaatgcactgtaaacccaataaccaatacttgttgatgctaatagactgattccttttgtgataccgcctttttttccaggatcatcactgattgccgttaaagcagaaccaaatacaagaagaatgatcgctgctgcaccaatgattttccccatacttccagaccattctccaaaagcgaagacaccaatcaacgaggttccgactaactgtaatgcagtcgagataggcatcgttttagaaacaccaatcaagttgaaagatgtatactgtcctgtttgtccaataacccaaaatgcaccagaaagtaaactaatcaaaaatgtagtcactgaaataccagctggagaagcgaataattgaacgagtaagccaacgagcaccgctccaataccagttcctaatatctcatttgttggtctgccgccaatctttttcaaaatcagtggctggatcccccacccaactgccgggatcaatgcaatcaataaacccatttttattcacccttatccttttccaccttggaaagaaggatataaagtcatcccaccatctgcaaatagtgtaatacctgtaacataactggattcgtctgaagccaaccatgcagctgccgctgctatttcttttggttcacctacgcgtcctagtgggatcatactttccaagagttctttttgttcaggatcatcaaattttgccgcattaataggtgtacggatagcgccaggtcctatactattgattctgattcccttaggtgcgtactccattgctaccgtttcggtaaataattttactccgccttttgaagcagcgtaatgagcaaatgttggccatgggatttgttcatgaacagaagacatattgatgatatttccttttttatcattctctgtaaaataattcaaagctgctttcgttccgataaaaacgccagtcaaattgacttttaatactctttcccaatcttcaaggctaagttcatgggtcggatgctgattttccatcccagcattattaacccaaatgttcagtgtcccaaaattttctaaagccgtatcaagtaaacgctgtattccttcttcagaactgacatctgcttgtacagagactgcttttccgcctgcttcttcgattgctttgactgctttttctgccccttctttatccgaattatagttgacgactacattcattttttctttcccgaatcgttgagcaatcgctgttccaatcccttttgagccgccagttactactgcgactttgttttctaattccttatacatagtacccactccttttttatacctaaacctgttattacggataacttttatttccgccttaaagtgagtgtacaccaatatatatagtctaaagcaaatgatacgctctagtaatcgttttcatcaattggcagcatccttctatttttataaagaaagaggttgtgacagaagtggtcagcttcaagaaataagaaggaattgacgaaaattgcttttcaaattttgtgaaatttcggcttatttccgaagaagctacttctggaacatcgtttattcggaaaaagggctgtgacaagacttttgccacagccctttcatacacttatttatcaaccatttcgttgtaattgctagttatgcataaagattagctctcacggacattattttattgctgagaaaaatattcagctgttgcttgttcatcctccttgagttgttcgatcaattcctctgcacttgaaaatttcacttgatctcttaaaaattgattccaacggactttgacgtgctcgccatagatatcttgattaaagtccaaaatatacagctctacagtcagctcccgtccttcaccgaatgtatcgttatgtccaattgaacccatggctggataccaagtttccccaatttttatttccgatacataaacaccttctttaggtaaatggactgtgctctttactttgacatttgctgtagggaatcctaataatctgcctcgtgcatcgccatgaacaactaccccttccacctcgtatatgcaacctaatagttttgccgcttcttttacttgaccgctgtctagcaatcctcgaatacgtgtagagctgattttttcgccttgttcttcttctttagagactgtgacgattttgaatcttcccttagcatattcaggaaaatgagcgacatctgcaatgtcttttggtccataggtgtaatcaaaaccggaaacagcatatttcgcatgtaatcctacgatatattgatcaacaaactcttgtggcgctaaatgagcaaaagaagaagtaaaatcgacttcatataaataatcgatacccaaagctgccattttttcttctttttgcttcaggctagtcaaatacttcacactgctaggatcgatcttcttaaaaacaatcgatggatgttgattgaaagtcatcaatgctaatttcaatccttctttttgtgcaatttccatacctgtctttatgactttctggtgtccgatatgcacgccgtcgaaaaatcccagtactaaaacgacatcgtcttctggaatttgttctggttggtaaggatgtctgatcttgatgatattcattcgttattcctcatttctcaatactttactaggttttagtttatttttttctttcgggtttggctggtagatacttacgactttttctttataaaacaaggcaatttcctctgaaggcatttctgggagcgcaaatacagtataatcaagtctcataccgttttttactttctgccatacctcatcagtaatatctactcgtttgaatcgttccactcctttttcaattggcagcaaatactcatcgattgtaccgttttctacagcttgagctacttcttctaatgttaacgcttctttttgggtcataccggcacttgctgttcgagtgagatcagacatgtgtgcagggtaaccaagtttctttcctgtatccacagctaatgtacggacataggttcctttcccgcattctacttcgaaacgccaagaaatggttcctgccacttcgtctcttgtcagttcacttgttcggataaaacggtaaatttgagcctttctaacaggccgctccactggttcattattccgtgcatattcatataaccgtttaccgtttacttttaccgctgagtacattggcggtatctgggtgatctcaccaataaatgaagccatcacttcatctattttttcttcagataaagacatatccactggttttgtttctactcgttctccggatcgatcttccgtcgttgtactgaaacctagagtcatctcgcccacatagattttcccagaatcagtcaaatattcgataacttttgtggcttttccgatacaaataggcaatacaccgcctacatccgggtcaagcgtacccccatgtccgatttttttcgtatgtaagatttttcttaatttgaatacgcaatcatgacttgtcattccgcgttctttccataaaggtaataacccgtccatgtcttttctccatttcatttttgatttaactgaattattataacacattgcatctattactgacgaatttgacatcataatgaacggtttttatttttcggcaataaaaacgtaacaaaattcatgctcatgtaaatagaaaccatgttatgctttttttaaaggagggaatagaatggaagattttttctttgcaccatttgattggatttatgggtggcttacaggtaaatagattggttctcacttcccaaaaacgaaaaaaagactggtcattcttccagtcttttttccgttttttttatttattttttcagtttcttgatcaatgtaaaaaaatctgtttttcggggttgattttatcactttattggtcaagatttttccatttccaatccaatacttctggcagatcaataccattttcacgaatatagttttgatgttcttgtaatttctgatccattttttttgcaaaatcttctgcttgacttcctttgatttttaaagctgcatcttttgccaaatgataacggtcaagttcatttaccacacgcatgtcaaatggtgtcgtgatatctccgttttctttgtagccatgaatcattaaatgatggttatgacgatcaaagaaaatcgtgcggaccaatgtttcataaccgtggaaagcaaataagatcggtttgtcttttgtaaaatattggtcaaattcttcatcgctcaacccacgcggatcttgacttggatgacgtaatttcaataaatctacaacattgatgaaccggatttttagttttgggaattcttccagcagcaaagtcacagctgctaatgcttctaagttagattccgttcctgcagcagcaatgaccaattcaggttcctcctcttttgctgtcgaagcccaatcaatgattttcaagccttcattcactaagacggctgcttcttctgctgagtaaaattgagcacgcggatgtttggaagagatgatcaaattgattttttctgacgagcggaatgctttatccatgactgcgagcaatgtatttgaatccgcaggcagatattcacggatgaactccgccttcttttctgccaaatgtgtcaatattcctggatcttggtggctatatccattgtgatcttgctggaagactgttgagcttgcaatgagattcagcgaaggataatcatttcgccaagaaaggtcatgtgatttccgcatccatttgaagtgctgagtcaacatagagtcaaccactcgcaagaatgattcgtaacttgcaaaaaaaccatgccgtccagtcagaacgtacccttctaagaacccttcatcttggtgttccgataattgactgtcgatgacgcgaccagatggcgaaagccattcatcattttctggttcgattttttccatccattggcgatttgtcgttttgaaaacttgattcaatcggttcgattttgtttcatctggaccaaatatacggaaattttctggatttttctcaatgatctcgcgaacgaatttaccaagttcggtcatatcttctgctttaacggagcccggttgttcaaattgcaaagtatattttttccaatctggcataataagcggttttggatcgattccgccattggtgatagaattttttgccattctttggtcaccagtgggcgcaatttctctgatttcttctaaaatacgtccttgtgcatcaaataatttttctggttcataggatttcaaccaacggagtaaagcatctgcatgatccatatgttcttgatctacacgaatcggtacttggtgtgctcggaaggttccttcaattggctccccgtcccattcttctggaccggtccatccttttggtgtgcgtacgatcaatactggccattttggcatcacgacgtctgtcgctgtcttcaggcgagcttctttttggatggatttgattttctcgattgcttgatccattttttcagccataacaggatttaatttttctggatcatttccttcaataaagaaaggttcccagccaagtccgttaaagtaatttgctaattcttcatctgatttacgtgccaagatcgttgggttggctattttagcaccatttaaatgaaggattggtaaaacagctccatctatcaccggattgataaagacatttgagaaccagcttccagctaaaggaccggtttctgcttcaccatcaccaatcacgacagcagagattacttcaggattgtctaatacagctccgactccatgtgaaagagagtatccaagctctcccccttcatggatagaacctggtgtttctggtgctgcatgagaagcaatgcctccaggaaatgaaaatcgcttgaataatttttgcattcctgtctcatcttccgttacttctggatagatctctgtgtaacttccatctaaataagcattcgataccatgacttgtccgccgtgtcctggcccttcgatataaaacatgttcaaatcatatttattgatgactcggttcaaatggacataaataaaattttggccaggaatcgttccccaatgaccgattggatgttttttgacatcttctggtttcaatgtacgtctcagtaagggattatctttaagataaatttgcccgacagaaagataattggcagcacgccaccaagccgtcattttatcaaagtattctttactagaataatccatacgtaacactccttttcattattactcttattctagcgcagatactcctaattgaaacctaataagcacttctgttcatttgcttggattttatatcttgtcaataactccaacgtgatttttcttttaactggtggcagaccgacaaattcaaacttttatggtgcaggttccactgatcttctagttacttggctatataacctgactgtcactacaatggattacaatctagcttccgtcatcggtatcttgatctttatctatatgcaaaaatttatatactatagaaaaaagaaagtcgaattttttacttttctttttctcttttttggttaactgacacgccgcaagactaaagtcatggaactcttaagtaatacgtcttaatgaaaacaaaaaaatcccgcaacccctgatttcacaggatttgcaggattttttgattagtctttgttcaagtcacgaagtaattcatcgatatggttgccatagacaactgattcatctaattcaaaggacaactcaggtgttttgtaaatacttagattgtgccctagctctcgacgaatcaatcctgatgctttatccaatccttcttgtgcttttttcttttcagatgctaaatcagaaaggatgctgtaatagattgttgcttgttgaagatcgcctgttacgtgtacatcagtgatcgttacatcttgcacacgaggatctcttacttttttacgtaggatcgcattgacttcttttaagatttcttgaccgactcggcggtcacgatagttagccataatgattggcctccttttatcagtttttagtcatttttgacttcttccatgataaatccttcaattacgtcatctactttgatgtcattgaatttttcaatcatagcaccgcattcatagcccattttgacttcttttacgtcatctttgaaacgtttcaaacttgccaattggccttcgtagataacgataccgtcacggatcacacggacaccgctgtctctgcggatatagccttctgttacataagcaccagcgatcgtgccgactttggatactttgaatgtttcacgtacaatcatttgaccagtgattttttcttcaaattcaggatctagcattcctttcatcgctgtttcgatttcatcaatagctttgtaaatgatacggtgtaaacgaatgtctacttcttcagcttctgcttgcgcttttgcttgaggtgtaggacggacgttaaatccaatgatgattgcattacttgctgctgcaagtgttacgtcactttcattgattgcacctaccgctgaatggacgattttcacacgtacgccttcaacttcgatttttttcagcgaggcagctaatgcttctgctgaaccttgaacgtcggctttgataatgacgttaacttctttcaactcgccttctttcaagctttcaaacaagttgtccaaggttacacggctgcttgcagcacggttttccaataatgcacgttttgcgcgttcttcacccgctgcacgtgctgtcttttcgtcttcgaagactacgaaacggtcacctgcttgaggtacatcattcaagccagtgatttctactggcgttgcaggtcctgcttctttatcgcgacggccaagatcgtttgtcattacacggacacgtccgtaagtattaccgacaacgattgggtcacccacatgaagtgttccttcttggacaagtaaggttgacacaggacctttacctttatcaagacgtgcttcgatcactgttccgattgcgcgttgtgttggatctgcttttaaatcttctacttctgcgactaacaggatcatttccagcaattcttcgatgttttggccgaatttcgctgagatctcaacaaagatcgtttcgccaccccatgcttcaggaattaactcatactcacttaattcttgcataacatgttgagggtttgcacctggtttatcaattttgtttacagcgacgataattggaacgcctgctgctttggcatggttgattgcttcaacggtttgcggcatgacaccgtcatctgcagcgacaactaaaatcgtgatatctgtgatacttgctccacgtgcacgcatacttgtaaaggccgcatgtcctggtgtatccaagaaagtgattggtttgccatcaatatcaatctgataggcaccgatatgctgtgtgattccgccggcttcgccgcttgttacacgtgaatggcgcaatgtatccaataaggttgttttcccgtggtctacgtgtcccataatcgttactactggcggacgtgagactaatttgtctggatcaacttcttctgactcgaagaatttatcgatatctgcaatatcaacttggactttttcttgtggttccataccatagtccgtggctaacagttcaatcgtatctttatccagtgcttggttttgattgaccatgacgccaagcataaataattttttaatgatttctgctggctcacgatgaatttttttcgcgatgtctgctacgttcatgccttcagtatactctaatacatctggcaattcacggaatttgcgtggtggtacagctggcttagttgattgttgctgtttgccttttttaccctttttattataacgattacggttgttattattaaatttgccgcgattgttattgtttggtttgttgttggtacggttttgattgccgccttggctcgttcctggacgattttgactgctagtattccccgtattattttggtttgttgttggtttttttccttgattcacttgaccgctcccttgaccgcgatcttgataactgcggttatttttatttttttgttgattatttgttgcttcttttttacgttgatcgttcggctgttgattggctggttttctgcttgcttgttgtgcagcttgttgtttcgtgcttgggtttttgaacgcttgttgcaatttcttctcatcactgctagtaatcgcacccatatggtttttcacatcgatgccaagttgttgtgctttttccacgacatctttactagattttttgagttcttttgctaattcatagattcttttattgcccatgcaatcaccttcctaaccttcaattagctccttggtcttcttcgcaaatccggcatccattattccgaataccttgcgaggttttccgatcatctgcgtgatttctgcttcagaaaatagctcaaagcaaggaacttcatagtatgaactcttatcttttatcttttttcttgtattctcacttgcatctgttgccacaaacaccaattttgctttttgtttgcggatttcagcaatggtcagttcttcgcccgtgatcagttttcccgcgcgcatcgccagacccatgagattcatggctttttgccgattgactgtgttcattttccaaataactctttacgtgctttttggtgagtgacatagtcaagtagttcttgataaaactcatctgttaaagttgtttcgagtactcgatcgagaatttttttatcccaagcttgttgtacttcttccggctcaagtgagacatacgctcctcgtccaggcatttttccagttggatcgatcgatacttccccttcttttgaacgggtgattcggaccatctcttttttaggtttcatttcacctgaaaccacggatttgcgtaaaggaattttcctttgtttcatctctttgcctccttactaaagttaagcttctggcttttcttcgaccgtttcattattgaacgcaattgtttcatactcatcgtctgtcaaatctgactgaacgattgcttcgtcatgcaattcttctgtttcgttttgttgttcttgtttttcataaaattccgccatatcagattctgatttgatatcgattttatggttagtcaatttagcagctaaacgtgcgttttgtccacgtttaccgattgctaacgataattgatagtctggaacgacaactgtgcaagctttaggattggtttcatcaaaaatcacatccatgacttgtgcaggattcaatgcatttgcaatgaatacagctggatcttcattccattcaacgatatccatgttttcgccttttaattcattgacgattgcttggacacgttgtccttttggtccaacacatgtaccgactgcgtcaatgttctgatcgtttgaacggacagctacttttgatcgatcgccggcttcacgagcaatgctgacgatttcaacgattccatcataaacttctgggacttcttgctcaaataagcgacgcaatagatccggatggctgcggctaacaaatacttgcggacctttagacgtattttctactcgagaaacatagactttgatacgatcgtgaggttggtaaaattcgtttggcatttgatcttgtttagaaagaactgcttctattttgccaaggttgacataaatataacgtttatcctgacgttcaacgattccttgcatgatgtctttttcataagcactgaattcgttataaatgatcgttctttctgcttcacgtacacgctgcaagataacttgtttagctgtttgcgcagcgatccgcccaaaatcttttggtgtgacttcaaaacggatcgtatcaccgatctcatatgctggattaatcaaaagtgcatctttcaatgagacttccaactgtgaatccatcacttcttccgttacttcttttactgcatagacatggatctttccttttttctgatcaaattccacttcgacattttgtgcttggccatagtggcgtttgtatgcagaaaccaatgctgcttctaaagcatcgatcacgatttcttttgagatccctttttcagcttctaaagcgtctaacgcatttaacatttctttactcattttttctgattcctctccgtgattaaaattggatagctaagcgagcttttgcaatattttttcggtcaaaagtcaattctttttctcgtgtttttatgcgtattttcaatgtaagctgttcagcatcaaatgattgaagaaatccttcgtattgtttttcgccatctactggttggtataaggagacatggacataatcgccaagtgccttttcatagtcgctttcttttttcaatggccgctctgctccaggggaggatacctccaggaaataagcttgaggaatcggatctggatctgctgcatcaagtttttcgctcagtttctcactgacaaaggcacattcttcgatatcgattccgccttctttgtcaataaatactcgtaagaaccagctttttccttcttttacaaattcgacttcgacaagttcaaaatgttgttcatctaaaatcggtgtcaccatttccgtgactgtttcaacgacgctactcaaaagtttcgcctccttaaaaattaagtgcgtaattccattaaaaagagtgagcgaaaaatccgctcactcacagttagtatcattacctataaaaactataccatactctgcttaaaattacaagcagacaagataacagatgcttataacatatcgaataacgataattggttttcgtctggtaaatccttcaatacaccattatcgttcatatattcgatcaatgtttttgaaactttcccgcgagtagcaagatcttctttagataaaaatggaccatcttttcttgcctcaacgatttgttttgctacattggttcccaaactagggacagctctaaatggcgcaatcaacgtatctccttcgataacaaaattaactgcatccgatttgtacagatcgatcatcccaaatttgtatcctcgttctaacatttcattggctaactctagcacggtcagctgatttttttcttttacggaagcatctagccctttgtccgtgatttctttcattgcttgcttcacagcatcttttcctttgcacatggagactagatcaaaatcatctgcacgtacagaaaagtatgcacagtaatacaaaatagggaaatatactttgaaataagcaacacgaagagccatcaatacataagctgcagcatgggctttcggaaacatatacttgatcttcgaacaagagtcgatataccaatcaggcacattattttctttcatcgcggatagataggtttctctcaattcatcaggaatcttgttccattgtcctttacgaacagtttccatgatcttaaatgccatcccgctgtctaatccagcatgaatcaaataaaccatgatatcatcacgacagccgattacttccgccaatgtcgcatccccacgtcgaatcaattcttcggcatttcctaaccatacatctgtaccatgagatagtccggatatttgaagtagttctgcaaaagttgtaggatgtgtttcttctaacattcctcgaacaaaacgagtgccgaattctggaatacctaatgttcctgttttagaataaatctgttcctgggttacccctagtacttcagggccagcaaatatccgcatcacttccgggtcatctgtgggaatcgtttgtggatcaatccctgataaatcttgaagcatccgtataacagttgggtcatcgtgtcctagaatatccaatttcaatacattatcgtgaattgagtggaaatcaaaatgggtcgttttccattccgaattttgatcgtctgctggatattggatcggcgtaaaatcgtagacatccatataatctggaataacgatgatccccccaggatgctgaccagttgtccgtttgactcctgttgcaccctttgccaatctgtcgacttctgcacttcgaaactgcagattattgtccctttcataaccttttacatacccatatgctgttttatcggcgactgtaccaatcgttccggcacggtaaacatagtcttcaccaaacaatactttcgtatagttatgtgcttctgcttgataatcacctgagaagttcaaatcaatatcgggcactttgtctccatggaatcctaaaaatgtctcaaatgggatatcatgaccatctttatttaagcgtgcaccacattttggacattgtttttctggcatatcaaatccagaaccgtatgtgccatcttcaaagaactcggaatattggcactctggacagtaataatggggagctaaaggattcacttcagtgatcccagtcatcgttgcaacaaagctagagccaacagagccacgtgaacctactagatagccatcttcattacttttatgcacaagtttttgggcgatcagataaataaccgagaagccattaccattaatagaattcaactctttttctaatcgtttttggataatttcaggtaacggatctccgtacatttgttttgcttttgtgtaactcaattctgatatctcatcttctgaacctggaatcttcggtgtataaagctcatctttgactggaatcacttcttcgcagatatctgcgattttattcgtattatccactacgatctcttttgctgtttcttcccccaaaaagtgaaaagcggtgagcatctcatcggttgttcggaaatggacatctggcaaactatgacgattcaacggattcgctccgcccatagaattgatcaaaatttttcggtaaatggcatcttcttcgttgagataatgaacgttgcctgttgcaacaacgattttatccaaactttttccgatttctactaagttttggataatttcttccaaatcatgttcattttttaccaattcttgctcgatcaaaggtgcatagactgcttttggcataacttcaatataatcgtagaattttgctctgtttcttgcctcttctacccctttttgcatcatggcttcgaagatttctcccttatcacaagctgagccgatcaatagattttcccgcatctttttcaattgggagcgtggtattcgcgggacacgttcgaagtattcgacattcgacattgaaatcagtttgaacaaatctttcagtcctgcctgattctttgctaaaatcgttacatggaaaggtcgggctcgtttgtaagaatctccttctccgatatgctcatttagctgatcatgataaagcatgtgatgattgtccattgcctctttcacaaagatccaagctaaatgacctgttgcttcagcatcatagattgctcggtgatgctgttccaagctgacaccaaattttttggataacacacctaatccgaaacgtttgaattgcggatatagatatctggctaattctaaggtatcaataactggattggctgcttcaggaatgccatatcttgcgtagctagtattcaagaatcccatatcaaaagccgcgttgtgggctaccagaattgtaccttttgaaaattcaaggaacatccgcaagacttcttcttctgacttcgatcctcgaaccatttcatccgtaatacctgtcaaatccaccgttgttcgggataaaggatgtcctggatcgataaattcatcaaagctttcgatcacatttcctttgtacattttgactgcagcgagctcgataatggtatcgtataccgcagacaatcctgtcgtttccacgtcaaatacgacatatgtggcttcgttcaatgcttcatgcgcatcattataagcaataggtacaccatcatctacgacattcgcttccacaccgtataagattttcacgcctgcttttttcccggcactatgagcttctggaaaggcttgtgcgccaccatggtctgtaatggcgatggcacggtgtccccattttcctgcttgtgccaccagatcagaaatgctattcgttgcatccatcgtactcatattgctgtgaacatgaagttctacccgtttttccccttcaggagcataatctttacgaggggtatgtttgacttcaacgatatcttgggcattcatgaccaaatcacggacaaacgtatcttcttggatacttccacgtacctttagccaactgccgacactgatcgcatcaaatatctgttcatctttttcgccatttgagaattttttgacgataaatgatgaagtataatctgtgattttcaaagtcaagatcttgcgttttgagcgtagttctctgacttctttatcgaacacatacccttcaagagtgactcgccgttcttcttcgacgatattgatcattggtgttgtgggctcatctgctggaatatttcgtcctagctggatgggtccttcaagagctggtgactgttcttttctttcttttttcttttgctcatgaacaactagactttcagctgcttgcttcataaaggcttctgcctgttcttgtttacgttcttcaaaaagtttcaatacacgttccgcttgctgctcatccacttctggttcgatacgaaatttcgggaatccgtaactgacgaacaactcttctactaacggtaagtattgctgtttcaaatatgaaatagcccctgtactgtcgattggcaagatgactttacgatcttttatcacaggtacttgcgttttcaatacttgctgtgctagtggtgtatcgcattgctgattttccaaagcttgggcccagtaatcttgcaagagctgttcatcgaatgtctggtcatctgctaagatgttcaatttgacttgtgcaatctctttaaaagcgacagtcagatgctgagccaatgaccgatacagcataataggcaaaattttagaaaaatgcagcgtaaattcccataaacgcgatttacgatggaccactacactatccatttcaccagcagtaagcagtggatgatttttttctgcttcctctagttggatttgttccaacagtttttcaaataaatctcgtttttctgacaaagatatacgccctttctgatgagaaactatgcaattgattacatcgtatcctcttctttttcagtaccttttagtatactcgttttttctgagttttacattaaaaaattggaactgtgattcacatcacagttccaattttaaaagcgaaacatcaggttgtcaaaaacagctgatccagctattttacttttctgtgttttaacgcttattattcgccttggttcaagaggattggtaaagtattcgccaattcttctttacgtacttcaaccatttcgccagttttcttgattttcacttctacgattccatccactgcttttttaccgacagtaattctgattggacagccaatcaaatcagaatccgcgaatttcactcctgcgcgttcatttctgtcatcaaccagtacttcatagccagcttttgtcatcgcttcttctagttcattcgtcaagtttgtttggtattcgtcttttagattcatttggacgatatgcagatcaaatggcgcaattccttttggccaattgattccttgttcatctgaatgttgttctacgattgctgataataaacggctcacaccgataccataacagcccataatcacaaatttttcccgtccgttttcgtctagaacggttgctcccatagattcactgtaacgagtgccaattttgaagatatgtccgatttcgattcctcgtgtaaaggcaagaacaccgttgttgtctggtgaaggatcgccttcttgtacaaaacgaagatcttcataagaaagcacagtgaaatcgcgttctggattcacatttttatagtggaatcctgtttcgttcgctccagtaatggcattcgctaaatcttggacataacggtctgcgtatacttttacgtcatctgaaacaccgattggtccgacagaaccaaactcagcacctagatatttttgtgcttcttcttccgtcgcttcttctaaaaagtcagcagatagatagtttttcagttttacgtcattgacttcatggtctccgcgtaccaaaacaaggacaggttgttcatccgcaatgaacaatacagacttgataattttttgaggttcaacagaaaagaaatctgctacttcatcaattgattttacgttaggtgtagctactttctctaattcaagctgtgtttcatgcgatttttttgatacatagtagcttgtagccatctccaagtttgcagcataatcactttcagtcgaataacagatcgtatcctccccaatctctgagatcgccatgaattcctttgagtcttttccgcccattgcgccaccgtctccgatgatcgaacgaaattccaaaccgcaacgcttgaagacttcggtataggctttttcataatctttatatgtttcgtctaaactttcttctgttgcatggaaagaatacgcatctttcatgataaactcacgtccgcgaagcaaaccaaaacgaggacgtttttcgtcacgatacttaggttggatttgataaagattcaaaggtaatttcttatacgaattgatttcattacgcatcaaatcagtgaaagtttcttcgtgagttggtccaagaatcatttttcgatcattacggtccttgaaacgatacaagtttgggccatatgtttcataacgtcctgactcttcccaaagttctgctggtaagatggcaggcatcagcatctctaccgcaccgattttttcaaattcttcccgcatgatacgtttcagcttttctaacacacgatttgctaatggcagataagaatagatacccgctgatacttgacggatatatccagctcttagcaagatttgatgacttaatacttctgcatcatttggaacttcacgtaatgttggaatcaacatttttgattgtctcattctatatactcctttatttcctcaaaatagttatcgtttgttattataccctatttgtcaactttttctagaaaaagaatcgttgaatatcgttccatgtaactagcaccatcaacaacattaaaaatccaaagccagctaatgtcaatattccttctttttcttgacttaatggattcccacgaatcccttcaaaaatattcaacactaatttcccaccatctaaggcagggattggaagcagattgacgattcccaggttcattgaaagaagcgccatcaaaccaataacagttgttacaccttggtttgctgcttctgaagacaattggtacatcataacaggtccgcctaatttatctaaactaaaacctgtaaacagtgatcctaaggctttgaaaatttccaatgaaccgctaaaagcttgacgtgttccgccgatgatcttatccataaaacctgtattcattggggcttgtatgccaagttggccaactttttcgccatttgactctacagatttcggtgtcacttcgacagattgcatcttaccttctcgttcgatctcaaaatctaatgttttacctggatttttcgtgatgactgttgtcaaatcgttccaagagtggatttctttaccgtccacactaactaccttatcattttcttttaagcctgcttctgccgcagcaccattagggataatctctcctacacgattagtatttgtcacttgaacaccgccttgcatgaatgcaagaataatgaataacacgattgccaagataaagttattcatcggaccggcaaaattggtcagcatacgctgccacagtttagccgattggaactgtacatcttttggtgcaattctgatttctgttccgtcggtttcaataatcgtcgcatcgtgatagacaggataggtcactacttctgtttcatccccattcacataaccagtgatagtcagctcatcttctaaatcataacggctcaattccatcgggatagcatttgtcaattggattttcttacttaaatttatcttctctacgatgccgtcagaatttagtaaaagagaaagaggcatacctggtgccatttctgtttcatcatccccattgcctgccattcgaacataaccgccaataggtaataggcgaagcgtatatgttgtcccgtcttttgcttgatgcccataaattttcggacccataccgatagcaaattcgcgaacgaggattcctgatcgtttcgcaaagaagaaatgaccaaactcatgaacaatcactaatataccaaaaacaatgataaatgttagtatcgttttcatagcttttttctcctttacttgttttttgtgtgtttttttaaacaacgttaaaacactataattttaccatagtatacctaagacaccaatagtatcaataaaatgagaaacaaaaacctgcgtcttttatgaaaatcacaaagaaacgcaggtatacttactaaataatgccaaataaatgcatgatagggaatacaaacagcaagctatcgaaacggtctaagattcctccgtggcccggtaagatatttcctgagtctttcacatcataatggcgtttgattgctgattcgaccaaatcgccaaattgtccgactgccgaaaaaataatcgtcatcagaagcatgacaaacataccatgattgaatagttcttttgctgggtatagcaataaataaagaaatgcgactacaacagcacttccgatcccgcctagcgcaccttcaatcgttttgttcggtgaaatatccggacttaacttgtgttgtccataacgacggccaaccatataagcaccaatatcagttgcccaaacaataaacagaccaaaaatcaaaacagctaaactttctgttcgtgcattgacgaaattctggaagcctattcctacatacaaactgacaagtactgggaaacctgcttcatcaatcgtatacgtatttttagaaataactgacgtccctaaaaggatcataacgataagataaaatagcataaatgtactgacgttctctggaagaaagaagaaccatctttcttttggcaagacaaggagcactgcaccaatagcggataaaactccttcaaaacttaggagagtcaatcctttcatccggaaaagctcataaactcctaccacagctaagactgctgcggtaagctcaaccgctatgcccccaatccatataatcggaataaacaagacaagcgccacggctgctgtgattacgcgttgtttcatgactgatcccctttctcattttctgttttttttacaccgccgaatcgacgatctcgattttgataagaggcaattgcttcttcaagatgcgcaccgtcaaaatcaggccaaagtgcttttgtaaaatacaattcactatatgcaatctgccataacagaaaattactgatccgctcttctccgcttgtacggatcatcaactcaggatcttgtaattctttgggcaagaaacctgtcattagatggttggcaatcacttcatcatcgatttcttctgcctgtatttctccctttgctacttcttcagcaatgttttggactgcagtcacgatttctgctctgcttccgtaattcaaagcaaagtttaacaccattccggtattgtcttttgtttgctcaattgcacgttttacagcgtcttgcgtatgttctggtaacacgttctcataccccatgacatggactttgacgttttctttgatcaattctggtacgaacgtatcaaaaaagtcgacaggtagttgcatgagaaaacttacttcatcttttggtcgcttccagttttcagtcgaaaaagcataaagcgtcaatactttcactccaagccttgatgctttctttgtaactttctttactgtttccataccttctttatgaccagcgactcttggcaaacgccggttttgcgcccaacgaccattgccgtccatgatgatggcaacgtgttgaggaattggtccatcggcattaaattgaaattcgcttttttcttgaatatatttgtttttttgcggaaaaaaacgtaacattctttttcctcctatacttaaaagattcccactatcttaagtattatagcaatatctaaacgtttttcctatgaaatcattgtttttttatttaaaaactgaataattttttctttttttaatctttaaataaaagaaacataaataaaaacagaggaagcggaatgatccgcccctctgtttttatggttttattaaacttccaataattctttttctttatcagcagcgatcttatctacttctttaatgctgttatctgtcaatgtttgtacgtctttttctagtccgcgcaaatcatcttcggtaatgtcaccatttttttgttgttttttatattcgtcgatcgcatcacgacggatgttacgaatcgcgatttttgcattttctgcttcttttttcacatctttagctaattcttttctgcgttcttctgtcagttgcgggataaccaaacgaataacatttccatcattggtaggactgattccgatatcacttgccataatagctttttcaacatcttgaagaatgctcttgtcaaaaggcgtgatcattaaaacacgtgcttctgggatttgtattgacgccatttggttcaatggagttggtgcaccgtaataattcacagtgattcgatccaaaaggctagcattcgcgcggcctgcgcggatttgcccaagttcacgttgaagattttgtgctgcttttttcattttttcttttgcttctgtcataattgcatctgccatttttatttcccccttacagtcgttccgatattttcgcctaagattgcccggcgaatatttccgtgttcatttaaattgaagacaagcaatggaatgtcattatccatgcttagtgaacttgcagttgaatccatgacttgtaatcctttagcaatcacttccagatgagtcagttcttcaaatttcactgcatttgcatctactttcggatcagcagaataaacaccgtctacattgtttttagccatcaggataacatctgcgccgatttctgctgcgcgtaatgctgccgttgtatctgtcgagaagtacgggttgccggtaccgcccgcaaaaataacaatccgtcctttttctaaatgacgttctgctttacggcgaatgtatggctctgcgatttgacgcatttcaatcgaagtttgcacgcgtgtcggtacacccacgttttccaacgtatcctgtaaagctaaggcattcataactgtagctaacatacccatgtaatcagcttgagcgcgttccatacccatttgtgctccgatttgtccgcgccagatatttccgccgcccacaacgattgccatttcaacgcccagttcgtgaacttctttgatttcttggatgatttctttgattactggtggtttgattccaaatcctgcatccccagctaaagcttctccactcaattttaagactacacgctgatatttcggtgtgaccatgttcattcctccaatattttctattgccattttaccatacttagatgatttcgacacgctaagcctggtttttcttgttttgcttaaaaaaagggagcgcacaaagcgtgcgttcccgtctgtcattcaacagaattattttttcacttggctcataacttcttctacaaagttatcttcgcgtttttcgataccttcgccaacttcgaaacgtacgaatgttttaacagttgcgccttttgaagcaacgtatttttcaacagtcatatcaggatctttaacgaatggttggtcaaccaaagcgatttctgctttgaatttcttcaagcgtccttctaccattttttcaacgatattcgctggtttgccttcattcaatgcttgttctgtaagaacagttttttcatgttctaattcagcttctggaatttgtgattcgtttacatagcgaggattgatagctgctacgtgcatagctacgtctcttgcaactgtttcatctgttgttccgtctagaacagtcaatacagcaatacgtccacccatatgcaagtatccgccaaatgcagcattgtcgtctttttctacaacttcaaagcgacggaagctgattttttctccgataacttgagttgcttcgatcaagtcagattcaatcgttcctttatctgttttgattttcattgcagcttccatgtctgctggtttattttcagcaacaagttctgcgatttcttttactaagtcttggaacatttcatttttagatacaaagtctgtttctgagtttacttcaacgattgctgcagtgttacctttcacagcaactgaagctaatccttcagcggcaatgcggtcatttttctttgcagcctttgccattcctttttcacgtaaaagatcaactgctttttccatatcgccttctacttcaactaatgcttttttcgcatccatcattcctacgccagtcatttcgcgtagttcttttaccattttagctgtaacgtctgccatgtttaactcctcctgtgtgtgttctttttaaaaaaagctgcttcaaaggagagtgaggcttgtcgcccagcctttgaaacagctccatcattcaaaattattctgctgaagaattgtcgccttcaacaacatctacgatttcttcgattgatgttgctgtgttttcttctgtgaaatcttcttcaactacttgatcttcaccttggtttccttcgatgaaagcatcagccatttttgaagtaatcaatttaacagcacgaattgcatcgtcgtttgaagggattactacgtcgatttcatctggatcgcagtttgtatcaaccatagctacgattgggatatttaatttgtgtgcttcttgaacagcaatacgttctttacgtgggtcaacgatgtacattacatctgggattcttggcatatcagcgataccgcctaagaatttttcaagacgttcgcgttctttgttcaaaccagcaacttcttttttaggtagaacttcaaaagttccatcttcttccattgcattgatttgtttcaaacggctgatacgtttttggatagtatcccagtttgtcaatgttccgcctaaccaacgatggttaacgaagtattgtcctgcacgagttgcttcttctttgattgcttcttgtgcttgtttttttgtacctacgaataatgctacgccgccttcttcagcaacgctcttcatgtaatcataagctgcatctactaatttaactgttttttgtaagtcaatgatgtagattccgtttctttctgtgaagatatatttcttcatttttgggttccagcgacgagtttggtgaccaaagtgtacgccggcttctagtaattgtttcatagaaattactgccatgtttgtttcctccgatttggttttattttccctcttcttatcttctaccttgccggcaaactttttcaagcacctaccgacaatccaataagaatgtggatttgctgatgcataaagcaccctcagctattatacagacaaaagatccgtatcgcaagagcaaatgtacttttctgctcaacattcaatagtttacctgaaagacaaaaagaattcaagaaaaacagtagatttctctttgtttctttattctcttttttccataaaataattttagatataaaagacgaatattattgggcaatccttcttttttttgttatgatacatgtgaaatctttcgtaaaggagaaagaaaatgcgcaaagctcaaagacatttgctgattaaacaagtcattgaagaattcccgatccgtacgcaagaagaactattaaacaaacttgggcattatggcgttaccgcaacgcaagcaacgatttctcgagatatacgtgatctgaaaatcgtgaaagcacctgatgaaaacggtatttcccgctttgtgttgtttcgcgaaaaaggtactcctgatactaagactgaagaagaggatcggctgattcaaatgattgaagacattgtgttgaaagtcgaacgagtccactttttgacaatcgttaataccttgccagacaatgctcatttatttgcatctgttttagatgagatcaagcctcctcctatcgtcagtacgattgctggatttgatacgatcatgatcatctcagaaaatgaggaggatgcaaaacgagtagaagaatttcttcaccatccgactgaagtatcacttttttaatcagaacacgtgttcctaataaggaatgcgtgtttttttattttcaatattttccttgttaaataaacctttacactctttacaaaaatacatcagtttttatttaaacttttcataactttgattaaatcacaatactcatcatttatattggatgttagcaagagcagagtcttgctctttgtgtatgtcaataaaaaagaaatgaaaggaaatcgcatgtataaattattaacgcctggaccattaacgacttctgaaacagtgaaaaaagcgatgctgaccgatcattgtacctgggatcaagaatacaaagagatgacacaatggataagaaaaaaattgctggagcttgctcaagtaccggaagaactatacacaacggtcttgatgcaaggcagcggctcctttggggtagaatctgttttaagttctgtgatcagaccagaagatactttactgatttgttcaaatggcgcatacggtcaacgaatgattgccatgtgcaaatgtctgcaactaaactatgcagtttatgaagtacctgaacaccaaatcccccaagcatatatgattacacagttgattgaagagaatccgtctatctccgcacttgcaatggtccatagcgagactacttccggtattttaaatgatttggaagaaattgctgctgtcacacaggaaagagatcttttgttcatagtagatgcgatgtctagctttggtgggataccgattcatgtagcggaactagggatcgattttttgatttctagctcaaataaatgtattcaaggtgttccaggtttttcttttgtacttgctaataaagtggaactagaaaagcgaaaaaatgcgagtcgaagtttgtcacttgatttgtatgaccagtaccgcgtgatggaaaacgagaatggcaaatggcgtttcacttcccctactcatacggttttggcttttcaacaggcattaaaggaactagagctagaaggagggattgaaactcgatattcacgttatctcgccaataatcatgtgctacgacaaaaaatgacagagatggggttccagcctttcatccaagagtatcaggggccattcattacctcttttctttaccctaaagactggcgatttgatttcaatcatttctatcagcatttaaaacaaaacggatttgtgatctatcctgggaaaatcagcgatcatgaatgttttcgtatcggtaatattggcgagatttatccagaagacattttagaactgacagcaattatcaaagactataaggagaacattaatgattaaaactgtaatttttgattgggcaggaacaactgtggactttggctgtatggctcctgtccacgcttttagaaatgcttttctagaaaaagggatccaactgactgacaaagaaatccgcgaaccgatgggaaaattaaaatgggatcatatccaacagcttctttccctcccttctgtcaaagaacaatggatagcgattcaaggacaactacctcaggaaaaagaggtggaggaattgtatcagcaatttgaacattatctgtttaaagatttggcccaacattctaccttgaaacccgacacattggaaacgatcgaacagttgagaagcgctgggatcaatattggttccacgactggatttactgctcctatgatggcaatcgtagcagaaaccgcaaaaaaagaaggctattcaccagacttcatggcaacttctgaagacgtcgaaggatatggacgaccatttccttatatgattcataaaaatatacaatatttcaaaaacaagtcagttgatgaagtaatcaaagtcggagatacggtctcagatatccaagaagggaaaaatgctggggtgtttacagtaggtgtgattgaaggtagttcgctgatgggactttcatatgatgcataccaacaaatagagatggaggaaaaagatcgcttaaaacagtctgttgcacttagattccaacaagctggtgctgatctttgcgtaaataacttgaaggagttaacagagtacattttgtgcgctgacaagaatccagaatgacttttatacaaaataagagctgtgacaaaaatattgtcacagcccttattgcgaataaacggtgttctcctgccaactcctcggtcacaagtcacaatatccaacaaacatgagaagctgttttttgaaattgttccttgtgactcggagctgaacactgatttcacattcttttttcttacatcttatctggtgcatgaagtcctagcaaacgaagatcttctttcaataatacagtcactgcatacactaaagctaagcgtgcttctttttgttcatcgtcagctaaaatcttcgtatgagcatagtatttgttgaatgcctgtgctaatttgattgcatgtttcgcaatcactgaaggttcatatttttccccagcggataagactgtttcaggatatttttgaaccaatttgactacttcccagctgatatcgtcattcaacgcatagtctgctgtttctgaagggacgaatcctgctttttccaacagactgactgcacgagcatgtgtatattgcacataaggtccagtttctccttcaaaacgaacaacttcttctaagttgaagtcaaatgtattgagacgatcgtttttcaaatcatggaagatgactgccccaacccctacttgtttagctacaacatctttgttttctaaatcagggtttttctcgctgatctgctctttagcagattggattgcttcattcaatacttcttctagtaagacgatttttcctttacgagttgataattttttaccaccttgtgtgatcaaaccaaatgggatatggtgcatgtcgtcagaccagtcaaagcccatttccttcaagacagctttcaattgtttgaaatgataactttgttcattccctactacatatagagattgtttgaagtcataggtacgtttacgatacaatgcggcagctaagtcacgtgtgatgtatagtgtcgcgccatctgatttcttgattaatgctggattcaagtcgtaagcagaaaggtcaacgatctccgcacctttatcttcgttcagcaaatgtttttcttctaaaagttcgacgatttcatccattttgtcattatagaaagcttcaccgttcaatgaatcaaactgtacttccagtagatcatagattttgttgaattctttcatcgattcatcacggaaccattgccacaattggatagcttcttcatcgccttcttctagacgtttgaaccaagcacgagcttcttcatttaattccggttctgtttcagctacttcatggaattggacatacaaacgaagcagttcattgattggctctgctttgaccgcttcttctgaaccccattttttgtaagcaacaatcagttttccgaattgcgtgccccagtcacctaaatgattgatgcggattggctggtatccgattttttccataatgaagccaatcgaattaccgataactgtcgaacgtaaatgtcccattgagattggttttgcaatatttggagaagacatatcgatcggtacggttccttgattcccgatattgctgtccccataatgttctttttctttcactactgtttgcaaaacttttttgctgataagttctttattcatgaaaaagttcaagtaaggtccaaccacttcgattttttcaaagttggcagagtcgattttttctgctaaatctgcagcgatttgctgtggcgcttttcggtaaacttttgctaatgaaaaggctggaaatgccacatccccgtgttcggctgattttggattttctagtaattgttcgacttgttcaagtgtcaaatcgtctttgacaacgtcatagacggctttagcgacaagatctttattattcatctttattcctcctaaaatactctcttacttgttcaacaaaaaaaatctctaatgacgacatacttagtatgccatcattagagacgagatttcccgcggtaccactccaattgtcctaaaaaaaggaccagctccatctgatatcggtagacgaccgtctgtttaaaacagaattctccaagtgcgcttcgttgtatctccttcattcggcttccaccacttccgaattcgctagccaagaatgatacaagtactctcttgttcaacaaatcttaatcttattaaactttcttgaattatatcagaaaaaaaaacgaaaggctagtcgtttctaataaaaaaaacaatccagatggcctaaaggagaagaaataccacctggatagttataaatcatttcgtaaatacgaaagacttaacaaattaatcagctacgataatcgttccttcttcagaagctaaaagattttcgatattttctaaagaagtgatgattgccttagcgttcggttttgcttcaacaaatgcaatggctgcttctactttcggaagcatgcttcctggagcgaactgtttttcatcaatgtattgtttcatttctgaaacagtaacagtttctagtttcttttgatccggtttttggtaattgacatacacattgtctacacctgtcaatacgatgagcaaatctgcatcgatgatttcggctaatttttctgaagcaaaatctttatcgatcacggcttctcgcccttctaatccggtcgctgtttctacaacaggaatcccgccaccgccgacagacaccgtgataactccttgttcgactagcgtttcgatgacacgtgcttctttgatcgagattggtttaggggaagcgactacttttctccatccacgtccagcgtcttctttgaatgtcacagtagaatcagcattcatttgttctttcgcttcttcttccgtgtagaatgggccgactggtttacttggatttttgaaggaaggatcattttcatccacaataacttgagtgactaaagaaactacatctttatcgatccctttttccttcagtacttcacccatcgcgttttggagccagtagccgattgacccttccgtcattgcgacacatgtatctaaaggcattgctggtgttttctcagaatcagcagcttgctgctgaatcaataggttgccgacttgcggaccatttccgtgagagatgattagttcatctccttgttcgataaatttcactaaatactttgctgtttccgttaacgcttcttgttgggcttttgcacttgcatccgtagacaagatggcattgcctcctaaagcgacaactacttttcgtttgaccatttcattcgtcctttcttcagttctcctgaattttctagataacaaaacgagccagcgttttgtgattttccctcaatgctgactcgttttttcgtgagatgaatgtggttatgcttaaacgcgagggataaacaagttacctaatgttgctgccatgattgctttgattgaatgcatacgattttctgcttggtcaaattgacgagcatatttgctgcggaatacttcatctgttacttccatttcagtgatgccaaagcgttctttcatttgttcaccgtaaacagtgtttgtatcatggaaagctggtaagcagtgcaagaagatcaaacgatctgtattgtgtgttttttctaccatttccatattgatttggtaaggtttcaacaatttgatccgttcttcaaatttatcttcttcacccattgatacccatacatcagaataaagcacgtctgctccgtctacacctttatcaacatcgtcggtaatcatcaattgtgcccctgatttttcagcaaaaccttctgccattttgacgatttcttcttcaggttgtaattcttttggtgcaacaatacgcatgtttgctcccaaaattgcacctgttactaataaagagttagccatattgtttcgaccatctccacagtatgcaacagtgataccttctacagttccaaagttttcttggatagttaaaaagtcagcgatcatttgtgttggatgccattcgtcagtcaaaccattccaaactggaacgccagagaattctgctagttcctctaccattttttgactgaatccacggaattcgattccgtcaaacatacgacctaacactttagctgtatcttctgttgattcttttttacctaattggatgtcatttgcacctaggtattcaggatgtgcacctagatcgattgctgcagtggtaaatgcagaacgagtacgtgtagatgttttttcaaataaaagtgcgatattttttccttctagatagtgatgtgggatcccacgttttttcaagtctttcaagtgttctgaaaaatcgatcaaatattgtaactcttcttttgtaaaatctttttctgctaataaacttcttccttggaatactgattctttcatattaaacattctcctttagattgtttttatttaagattaaagaggaaatcctgacgacagctgacagtaagactgtcgtcaggttataaactacttcaagtcttcacggacaagtggttggctcatacaacgtggaccgccacgacctcgtgacaattcactagaattgatttccaacactttgataccatagctacgaagcaattcgttcgatacgtaattccgattgtaagtgactacgacacctggagcgattgccaatgtattggatccgtcattccattgttctctaggggcaacgatctcatccccattaccagttggaatcaatacaagatcatctaatccaagagcagctttcatcgtttcgtgtaagttatctgaatgagtgatcttgatatcatcaccatctggttcgatcgtaaagacatccatcttaccgtctttactttggattgctggatggatagtgaatttgtcatgatctaccattgtgaatacggtgtccagatgcatcattgcacggttgttcgggattttgattgctaatactttttcaaatcctgaattttttgcgaatagatggcgtgctaatttttctaaagcttttgcatttgttcgttgagaaatcccaactgctactactttgtcgcttaagattaattcatctccaccttcgatatgatcaggattttcacgatccaaccatacttcgatccctttattggcaaatcttggatgatgtttcaaaatatattctgtaaacatcgattcacgacgacgtgcttcaaaagtcatcttattgacggtcattccatttcccattgatgcggaagggtcgcgtgtaaagtacaagtttggcattgggtccatgtaaaatggatagtcgtcgtctgctgaaagatcatacaagctgctagaacgtacttcgatatcttttgtacgaaccccagccatgattttatctaccatttcttgtgtttccattgatagaaggaactcatgaagaccatctcttactgcattcgatgcgatatgagattcatccaacattttattcaagaattgttctttgacgttgcctgcgtcaatcgcttctgctgctaatttttccaagtaaagagtttcgacgccttcgttttgcaaggtctttgcaaagttgtcatgctcttcttgagcaaccggaagatatggaatatcatcgaacaacagacgatccataatatctggtgtcaaattttccacttcttgcccaggccgtttcagtaaaactgtctttaatttccctatttcagagaaaacgtgaataggtttatccatgttgtgttgcctccttctttttgattacatgtataggatagcctccttttgtaatcactttcataattttgtctcattcaaaatgagacatccctcacattaatattcgataattaaataattaaacgtttttctaattttaagcgtaatttattcattttttattctgtatacacttccaaaaaaatatttattcatctaaaaattttttttgaataaatcaaaaaaataaactatactaatattgttagcgcttgctatatgtattattattgttttttatacacaaatacttatcttcaaaataaattattcaatgtagatgtatattttttacataataacaaattttatttgtaaagtattaaaacttatgtttaatccagatgtgttaaaactttacaaattctttaaaaaaagtaacaataactatagtgaacaataaggagaggactttttaatgcgtgttaataaaatcgattttcacttttcaaaactcagatatcaacctgattttgaacatttctcggatgaagagttccaacagatcaaggaacatactgttcttcgttcctataagaaaggacaaatcctttttgatgatggagatcctagacaacgattatatatcttgaccaaaggacttgttcgtttagaacgttacgatgaaagtgccacctattattattatgattacgtgactaccaataacctttttcctatgtcaggaatgtttggagaagatacctacacttatacagctcaagcgatgactgatatcgaaactttctatcttcctgtttcctactatgaaaaattagcacgaaaaaatcctgaacaactgatctatatgatccaaaaaatttctaaagtagtcgaaatacatgagttacgtatccaaattggattaacctccagtgcttttgatcgagtgaaacaaaatctattcattttgaaagaagaacttggcgtaccaacagaagacggccatatcaccattccttatccaattaccttaaaagaattagcagtgaatagcggtacgacacgtgaaactgctggacaagtaatcaaacaactacgtgattcaggactgttagattatcacaaaaagcattttactttctgtaagaccgctactactccagctttgagagaataacgcgacaaaaagaaacagcgatcctgatatttatcgggggcgctgtttctttttgtttcgtctattcaaatgattggtaataataagtgagatcactctctttttttgttccattgtaaactacacctaatatatttgcttttgcaatctgcaacagttctttcgcttttaacaactcttgtttctttgtctttctttctctgacaacaagtagcgttccatccgtttttgctgcaaggatttgagcatccgttacagtcgctaccggaggcatatcaaagatgaccagatcaaagtcaagtatcagttcctctattatctcttccattcttttcgtccctaaaacttccgaagggttgggcggctttggaccactgggcaagatccaaagattttctatatgtgtttcagttatgtaatcgtccgctatccgttcacgctcactaagtaaattactcaatccttcattatgcggcaattgaaaagacaatgctacagttggtttcctcaaatcggcatctacaagtaagacctgttttccactatttgcaaaaactactgctagattagcggcagtaatagatttcccttcatctgggccggaagaagtgatgaccaatgtattcaattcacgatcaatcgctgcaaactggatattggaccggatcgttcgatatttctcggcagtaatcgattgatcagctagtgcaactaaaggaaccggagaggcagctattttctttttcttcatattctctctactttcttttttcattttatattcagactttctatgtacacgaataaatcctatgatttattgaattaatcatagcacaggaaaaaaacgaacacaatttatataataactattttttattacagatatcagcataaaacatttttaaaacaagttatctcataaatttaaataacacattcaattaaaaataggcaaaaaatagggttgtgacaaaaatctgtcacaacccttattacaataaatagtgttcaaaagcttgcatctacggtaataagttcaaccaagtcaaaaacatgtgaagctgttttttctttgctgttcttataacttgatgcaaggcagctttttcacactctctttcatttattcagataaaaccaagcttggatcagcatttaactgatagctggcaaaatttcttttttgcatttccacatgtgctgctgctccaatcattgcagcattatctccacaaagtctcagaggcggaatcactaattctacttcagggagtttagctgacagagcagcttgcaatccttcacgcaacccttgattggccgctacacctccagctacaaccagttgcttgactggataattttgacaagctcgaagtgttttagtaatcaatacatcgatcacacttgcttgaaagctagctgctaaatcatttttgtctaaatcttctccacgctgttgtgcattatgcaccaaattgataaatgcactttttaatccactaaaactgaaatcataattatcttcatggatcatcgctcgtggaaaatgataattatcttttccttgatgagctagctgatcgatttcttttccacttggataagaaagacctaatactcttccaactttgtcataagcttctcctgctgcgtcatctcttgtctccccaatgatttcatatgatccatcttcttgcatatagactaattctgtatgtcctccgctaacaagaagtgccatcaatggaaactggaatggtttgaccagacgtgcggcataaatatgacctgccatatggttcacaggaatcagcggcaattggtgtgcccaagcaaaagccttagctgcagaaataccaatcaacaaagagccgacgagtccaggcccataagtgacagcgactgccgataaatcttctgccgatacaccagcttctaccagtgcatcttccaagcataaggttatttgttctacatgatggcggctagctacttcaggcaccactccgccaaaacgtttatgactgtttatttgggaagcaacgatgttagataagatctctgttccatttctaacgaccgctacactcgtttcatcacaacttgattcaattgccagaatcaattcttcattcatttcatcgtctccgtttttaactttctgctcataatgatcgcatcttctgtcggattgcgataatatgatttccgtttacctaatatacggaacttttctgattcataaagtttccttgctgcttcattagacagacgtacttctaaaaaaacatgcagcgagtcttttatttgttccgcaatcagcagatgtagcaaatgccgtgcatagccttttccttgttctgaaactgcaacagcgatattcgtgatttcgacttcatccattactttcgaatacccgacaaaaccacagatctggttatcttcaactaaaagcagataatccgtgtggggctgttggatatctgtcaaaaactgcatcttcgtccaaggtgagccatatggataagcattttcgctaattgcccatacgcattctgccaaatatgcttcatcaaaatctttttttctgcaaatcaactaatctcactcattttctaaaatttttatcatatccaacgcatcttcttttgtttcagtgtaatatctttttttgatcgtcgttgcttgaaaccctaatttccgataaagtctttgcgcatcctgattactcatgcgtacttccaatgacatcgtctcacagcgattcattatagcaaagttctcgatttcgtcaataagcagcgaaccgattcgtttacgctgatatgccggtcgaacagcaatattcgtgatatgacaatctaaaccgaacgcccttgagccaacaaacccgatcattcttccattatcaaagatccctaaatatagatgaggaagtggtgacttcaattctgacataaaggcacttttggtccatggcaattcgccattatagacttctcgttcgacatccaacagctctttgatatcttctgtagtcaattctcttagtatatagcgacgatcgatttgttcgattgttttttctgcatagatcattttatcttgaaaaaggcttctagcatatgctttaaattttttcaacatagctttcgtctccaggtgtgtgcgtctctaaccatttctcttcagcttctactcgttttaaataacgagggagaaaagcttgtttatctgcaactggttcatccaacgcacctaattgagccacagtcacaccacttgggatatcccatgctggaactgtattaatcatcgcatcaggtagcatttcttttatttcagagatgaatttatgacaatcactcccaacgaaataaatagcttcattcagctcttgtagttgtgcaaacaaatcagaagcagcaatatgtacatcttcaagtacagtttctaatctattttctttccagcggtatgccccagcatagacattttttcttcgagcatcaaacatgggcacaatcattttatccaccccgacacaattagccgcgatggctttcaggctagatactcctattagatctttatctagtgtataagcaatcgttttcgctgtcgttacacctatacgaagtcctgtataagaaccaggaccatcagaaaccgcgattcggtcaatgtcttggggactcatttgaagatctgcaaacaattggtcaatggcaggcatcagcgtcacactgtggttgcgtttgatatttgtctgtatttgcccaagaatttgtttatcttccaccacaccgatcgccaaagtttgatttgcagtatctattcctaatgtaatcatatatttgatcctttctgctataacattctcgccttccattgtagcatacttttttattccaatgatgaaaatatcaaaggcaaaactagtacaatgatacatgattatctgctgaccggcaaatctagtttcttccttacatacacaaaaaaagttgcggtatcacgacactttaccacaactttttctttttttatttcgtcgactctcgaacaatcaactctgtttccacaatgatttttcttgaaactggtgctttggaattacttagttgaaggatcgtctccactgctagctctcccatccattccgtataaactttcacagtagaaagagagggtgtcacatatttcgctacactgacatcgttgaaacccatcacggaaatatcttctggcaccgctaaacctgtttcttgaatcgctttcagcgcgccaatcgctaatgcatcattagccgcaaaaagtgcgtcaggaatctgctcgtttgtttttaaatattttttaaccgcttgatagcctgactcgacagaaaaatctgcttcgataattgaaccttcgtcgtagcctttttctgctaaaacttgttggaatgccatgattctaggatcccttagtcgctgatggtttttctttgtatattctgttccagcaagcatagcgatatgttgtgcattctgggaaacaaagtgctcaatgactttttgaacactcgacttaaaatcgacaactatagaatcgattccttgagaagtgccatcagaatctaccagaagcaaggcttgttgggattgtttcaaatccaacagctgagcttcatcgaatttccctaatgcgatcgttccatctgctggaagctcactaatggaatcccacgtttctttcaacaaagtaacgtttgcttcttctgcctttttttcgattcctaaacgaatagacaaataataaagatcttcaagttcttctgtatcatcgtaccattggatcagacgaagggtttgcttagcatttgctgcatttttgcggtgcttcgtataattcaagcgttccgctgcttcaaaaattttttgctttgtggctaagccgacggaaagttcaggatcgtagttgagcactcttgaaacagtagcaggagaaactcctgccaactgagcaatgtctttaattgttgccatttgtctctcctcctttttttccgtttataaaatcgcagtaaaccgctcaaacgctgcttgtcctttttcatctcgcttgaacactccagcatcttctaggacacgagcaaaaacctgacctacagctttttgtacaacatcagtgaccgcgtctttcgtcaaatcaggatgctcttttttcaactgttctgcccatggacgatgatattcagccatctggttctcttctcccaataagaaccgctctacttctgctagttccgatttcaaacgaggtggtaaaacagcaagtcccattacttcgatcaatccaatgttctctttcttgatatgttggacatctttatgcggatgaaaaataccatcaggatgctcatctgaaacattattgtctcgaaggacaagatccagctcaaaataattgtcccttcttcgtgcaattggcgtaatcgtgtggtgtggtgtaccatctgctgaaaaagcccggatttctacagtttcatccgaatatcctttccacttttccaacactgaattagctgcttcaatcagcaactctttatctgttgattgcaaacggatcacagacatcggccatttcacaactcctgcgatgacttgcggataatctgctaatttgatgagtttttctatcggtgcttttgccataggaaattcatgacgtcctgcctgataatgatcatgagaaagaatcgatcctccaacaatcggcaagtcagcatttgaaccaacaaagtaatgaggcaagacttcagtaatccgaagcagtctaacaaatgtttcctttgaaattttcattggacggtgctgctctgataaaatgatcgaatgctcattgtaataagcataaggagaatattggaatccccagctttcaccatctagattcattcgaatgattcgatgattggtgcgggctggataattcaagcgtcctctatatccttcattttccatgcacagcatacatgtaggataatctactttggctgcctcgcgttctgccgcaatttgttttggatctttttctggtttagataaattgatcgtgatttccaattcaccatatgctgactctgctggaaatttgatatttttagcgatggctcttgttttgatgtaatcatttttcttacttaaatcaaagaaataatcagttgcttcctctggacttttcgaataatgctgtgcaaagaatgcattgacaacggaaggcggcggtgtaagaaaatccatcaattgtgcttcaaaaatctcttgttctgctggtaattctgaaagaacaccattttctcttgccttagcgacaagctgatccaataagtctactgattcttccttaactggtcttacttcgacgctttctagagcgtcttctcctaccatccctaaaagacgattctgtaaatataagcggtccatttccatccatccgccagcttcgatcgcaagtgtggcaaaatcacaaatcgtttgactgattgacatatctcattcccctattcttcataaccatttggatggctgacatgccaatcccatgctgttttgataatttctttgatatctgtgtattcaggtttccagcccagaatctctctcgctttttcacttgaagcgactaatcggctaggatctccagctcttcttggtgctatttctgccgggatttctttccctgtcacttctctcgctgcttctaacatttccttgaccgagtaccctttattactgcctaaattgaagaagttgctttcgtttccttctttcaagtattccaaagctaaaatatgtgcggcaatcaagtcttctacttgaacataatctctaatacatgttccatctggtgtatcgtaatcgtctccataaacagccaatgcttttctttgaccaagagctacttgtaaaatgattgggacaagatgcgtttctggtgtatgatcttctccgatagatgcatctgcttttgctccggctacattgaagtagcgcaaagcgacatagcgcatgccatacgcttgatcacaccacttcatcattttttccatcatcaatttgctttcaccatacggatttttaggatcagttggtgtattttccgtgattggagactctttcggctctccataagttgctgcagtagaagagaatacgattttattcacgttgaactcgtgcatgacttcaagcaagatttgcataccgtatacattgttgttaaaatacatcaatggtttttcgacagattctcctactaaagagcttgcagcaaaatggattactccttcaatcggttccttttcaaatacggaacgtagaaattctttatcccgaatatctccttcataaaaatgagcatctggatgtactgcttgtttgtgacctgtgagtaaattatctaccacagcgacttgataccccttttgaactagctggtctacagcgtgtgaaccgatataaccggctccgcctagtactaaaattgtcataaaaaacactcctttgattagtgaaattgtgtttgttgattctatataatttaaaaaacgaagtctactttatggtagaaaagaagaaagtaaaatttcgtaaatttatctggtaaatttataataaaacatttagtaaacattttcaaggattttttgcaaaggtttacaaacaaacgtaaaactagcctttttttctcttttgttccataatagatataacaaataataaatgaggtggattcaatgaaaaaatttgtatctggaatattagtaggtagcttggcaacagccgctgccgttgctggtttggtcgcttctgtgaaaaaaacagtgatcgatccgattgacgaaaaagaagcaatgatcgaagaaaatcgtaaaaaagcaatgcgcaaacgcgtttctcgttaataattatttaaaaaatacgcatgaagacttgtgaaagaacagataagtcatcatgcgtatttttatttgtcagtcaatataagttgtgctattttatctgcttgtctcaaattccatggatctgtataaggtctagctgctgctgcagttaaccaatccacaccttcaactggtattccatagcaataaaagccagactggattttcccggaagcatcaatcacgcgattcgtacctcgctcaacatctatagcttctgaatgataacttcctgtattatctgaaaacgaaaaagagcgaacaagtttattttccttcaaattttttatgacaggattacttgaacgagaaaagcttgtttgtggcaaacgagcttcgatcaaatagcgactgctgatttctttatcttgtagagaaataacataacggttttgcttttgctgaatatcaagtggcggttcgatcaaatgaaaaatacccgcatctatcagtgctgctaactctttcgtccgaataactggcggaccaatcgttaaaaagctgtttagatgagtaaaccatccccacagtatttctttgtattccttagccgaaaaaacgtgccattcaatagcctgccggattggatcacgccagtctttcaatgcatcaaatgtcgaagtcaatgcccctgtgcaattgcctttttccgcttcttttatctgcctttcaataaatgctcggctagcttctgcaaaggactcatccagataggtaagaggagtttctagccacgaccaagaccatttgtaaggaagtaatgctggatactttccaagacactcttctgaagagagggaaagaaaatcatgctcaaaagttttcattgaaatcggcaagtgatgttcttcgatgattttcttgtaataaaacaactcagcgtcttttttcagatagtcaaaaaatgtttcgccagtcaaaagtcccgatcgatgccattgctcaaggttctcttttgtaagtagccgtggccatgccattgctccaccttgcttttgatttctccctcgaggatagtaaggcagacctcttcttgacccgctgtatacaatcggttccttgccagatggatgatagaccagttttccctttttgttttcgaagcaccctcctcttgataccgtaaacaatccgacataatcgaaaaagcttaaaccaagccctcttagaaagacattttcttttggcggtatctttgaaagatcgacatctgcaggattagaaggaagctgatacagtaaatcatttttctttgcatagtctatccaggctctttcctcttctgtctgatcattttcccaatgaccactcgctaaaatgagctgatcgacaggatagctttgctgatctgtctgtaataggaaaccgtctttttctttgctgacctttttcactaaagaatagacaagctgagtagaagttggaaattcttcttgcaactttgagaaaaaccagcgttgataaagtccgtataggcaacgagtagattgttggtctttttccagacggttaatttcttctataaatagttgcttatttttggttaccgtctgttcgatataatctgtagcaggtcctttactccattgaaacaaattaggtcccggcattaccgttccctcactggacaacgtctcgtctgtaaaaagcgtcacttgttgagaaacagagttcattaataattctggcggctgattcaaccgccaaactcgaccgcctggaccttctggatcaaaaagaataagttcaagagaatgtctgccctgattattatacagaatcctttctgctacacttaatcctctaggtccggcaccaatgatccctattttcatttgtacacctccttttcgataaattcttttaacacaacggcatggttctggtgctcgttttttgcaccataaacgaaagtaatgactggatgttctttcataagttggatgagttcggaaacagctcgcgtcttttcttcttcaaaagacaattcttgctgatatttctttgcaaataaagcaaaacgttctggtacgtggtcaaaagctttgcgtgcttcattactaggcgcaatttctttcaaccatagatctaagtgtgctttttcttttgaaatccctcgtggccagagcctatctacgagtatccgaaagccatcctcttcttcagcatcaaggtaaacacgctttaatttgatcatagttgtttccttctttctgccttttttcttttatattttatatgtagataatagcacaaaataaaaaatgaacgacacaactatccctcgcgtcgttcattttttcttagtcaatacctgattattgatctagtttttccaaagctgtcataaaaatatatgctttatacttttttgcttttgatttttccagaccagccgtcataaccacccttaagcaaataaatctctttataacctgctttacgtaatttatttgccgtgcggatactcaagcttttcttttgatcatagatatagacaggttggtcttttcgaatcgatcctagtgaatctttcaaaacagtgtaagggatgtttcttgcacctaagatatgccctgcatcaaacacatctttttcgcgaacatcgattacttgtgcttttctcattccttctcgaaactcttcttctgtcaaagtcgttgctgaacgcttggccattactcgtagatagacttcccaaaagatgattgcaagcacaatcaatagcaaaatgatattaattacccataaaaccatgtaatgcctccgtttttttaagcaaatttcaaggctaatgaggcagcgccaatgacaccagcttcatttccaagctctgctaatttgatttttgttgattctcttacttgcgggaaagtgaattctttaaaatatttctctacacggctgcgtaaaaattctcctgccgccgatactccgccgcctaacacaatacttgacggattcaatgtattccccaagtttgcgcaagctaagcctaaatagaagcatacgcgatcaacaaccatcaatgcaaacggatcgtcttcttgagccatttcaaagatatctttacttgttacttcttcaccgttatctaacattgctttcagttttgaatctcctgcgtattcttctgccaagtaacgtcctagacgtaccacaccagtagcgctagatacagtttctaaacatccgcgtttaccgcaagtacattcgaacccttcaggatccacagtgatatggccgatctctccgcctgctccgctcacgccatggatcaaattcccgccagcaacgataccaccgccaacacctgttcctagagtaacgaatacaacgtctggatcgttttctccagcacctttccatcgttcacctaaagcagccacattcgcatcattatcgatagcgaatttgattcctgtccctgcttcaatcagttttttcacaaattgtacttctgtccagttcaagttatatgcaccaataactgttccagcgtcactgtccacgcttcctggagtacccataccgattccaataaagtcttcggctttcatattatataaattcaatcgatggttgattgattcgatgatttcaggaacgatatgtttgccatcatccaaaatattggtatcgatgctccatttttgttgaatctctccttctggtgttaaaattgcaaattttgctgttgttccacctaaatcaatcccaataattttcttgtccattacaaatttcctttctttcggctttcttcaattcggtgctctctttttaatatgcgccacgctgtcatgtatgtatcatgatcgatcaaacggctatcatacagattccgcaattcaatagtcatcaattcaatatcatagatgcgtgcacccacatagataaagatgccaaattttttgaacagctgctgtacatcatataagctctccatctttaagcacttccttcatattatacaagtaaaccatatttttttaaacccagtaaaatacatattacaaaaagaaatacaaaaactagtgtagaaagaatcttctggtgtatcgaatagcttgtctgctgtttcggtagccctaaaatgttccctaatactaaaccgcccaccagtccgccgagatgtccccaaacatctacagaggtgtcaagaagaccaaaaacaaatgtcatcgcaataaataaaagaaaatgtctgactagttgttggatcgccgtattatatttaaaatgaaatcctaaaataaacaacgcaccaaacaatccgaatatcgaagtgcttgcaccaccagacaaaacattcgcttcgttgaaagcaaaacttgctgtatttcccattatcccactgaacatatagatcaggaaaaaccgccagtgaccgtatattgcctcgatttgttgccccataaaatacaatatcagtgagttcatgacgaaatgcatcactccaaaatggatgaagattggtgtcactaagcgccaccattcattgaagtgaacaagataaggaccatacattccagtataataaggaatttcaagacgcggaaacaactccattataatgaagactattgtctgtatccctaaaaaaacataggtccataacggtcgcctcaaccatgcacgcatttttatttgctgttgataattcatgaaaacctcccatttcattttagtcaataaataattgttggatcttctgatcaaaactctccggttgccattgttcattcaattgttctcgaaaaacgaggctgcatgtttttcgatggaaattttttaaataccggtcgtaataaccaccgccaaaaccaatacgataaccggctctattgtagataatccctggtacaatgaggaggtcgatcatttccggcaaataaagcttctctgattgtggctcaagaacgccaaaactcgaacgttcaaaaatggtgtgttcatccatttcataaaacgccatctgtcgttttggtaaagttttaggaacaactattttcttttgttcttttttcgcccgttggataatcggctgtgtatccagctcaatttcatttgacaaagtcgtccctatcacttgtgccgacttccagtactcgcttgcgaatagctgttcatagattcgctgttctttgccctttttcttgccgcttttggccagatttttcagcttttcaattccttgccggcgtaatttttctttcatttgctccaaaaaatcacctttccttctctcataaaatggtataggaaaaaaagaaaaatagcaatcgaactttcaaataaatgtataaataaaagaaaaagaagacctaacgatgattggccttcttgccttttaatgaacttcaactgctcagcacgtgtttttgtctgataaacaatacatacagaaaatatggcgcaccaaaaaaggcgatcaaaatccctgtcggtatttccccacttggtagaatcactcgtgcaacaatatctgcgctaagtacaaaaacggaaccgaacaaactgctcaaaataaaggtccaatgattttctttacgtacgactagcttcgcagcatgaggagccagtagtcctacaaaggataaactccctgtcaccgctacgctaccgcttgctaaagcaacagctaacaacaaaaggattttttgacttttattcacatttagccctaatccttgcgcgcgttcttggccaaatgatagcaagccaatccgttgcgcataaaatcctcctagcggaatcaagataatcgcccatggaagaagcgcccaaacataggaccagctcgcaccccaaatcgatcccgccaaccatgcattgacaaatccataattttcctttgacaattggatggtgcacaacaacgttaatgcagaaagaccagcattaacggcaataccagacaataagatacgattcatccctaaaaatccatttcgatcataggccgcaagatacacacagcaagcagcgagaataccacctataaaggctacaactagcaacagaaacggcagagaatattgtgaaaagaaacctaaataaagcatcactagaaatccagctcccgcattaatccccaatatgctagaatctgccaattcatttctcgtcactccttgcaagatatagccagaaacgccaagacaagctcctgctaataaactgatcagtaatcggggaactcgaaactctccaacaatcagcgccaaagccaaagaagaggagcctttccctatgaacgtgtcaaaaagctgatcaagataaataaaaggcgtgccaatcatcaaactacctacagacaagacgataagtagaaaaagcaagaaatacaacgtccaatatattcttttcaccgtcgttccctccttacttgtatcagtaaaaacggaacgccaatcaatgcaatgactaatccaaaaggtgtttcaaaaggtggattgatcatccttgctacaagatccgccaacatgaccagtccgcctccaactaaaaaagagacaggtaggacataacgatagtctgtcccaaccattccgcgaacaatcggcggaaccaacagcccaataaatgaaacaggtccgactaacgaaacggcaatggctgctaacactgcaactagacagaaaacaatcaaccgtgttcgtttaggacgacctccaagagctaatgcatgagtttcactcaaactaatcaaggatatcgcttttcctaatgaaaaagaaaccaagacagcaagcacatatacagggaacaacactgttaactgtttccatgtgatattggcagctccacctacaaaccaaaaggcaagatcctgctgtagattaaaaaattgggtaagtgcttgactgattgcagtaaaaaaagaactaatagctacgccagctaaaatcagctgtaaaggattcatgcccattttcgaaaactgcaaaaagccaaatacgagcaaagtcacagcaaaagaacctgccaatgacaccagaaacacagaaaacccagaagctttgggccaaaaagcaaaactaagagccattgccaacgaagcaccagcgttgattcctagtaaacctgaatctgctaacggatttcttgtcacaccttgcatcaatgcaccgctcaatgcaaaacaactccctacgagaaatgcccctgcgacccgaggcaagcgaatgtttcttatgatttgatgactttgttttgatccatcaaaatcaaccaaagcctgccaaaaggctgtttttcccacactcgctgcgccatttgaaagagcaataaaaaaaatgatcaaaagaacaaaacagatcaaaagcaagagtttgttttttttcctagccttcataattgatcctcctgctcttttggcaacagatcatacgtcagaaaaactggtttattcgtttttggtagtgtgacaatcgttgcatcaatctcaaatatttttttcatacactcttttgtgatcacttcttcaggtgtaccttccgtaatcaattcaccgtctttcatgcctagtaaataatcagaaaaacgtgaagcaagattaatatcatggatcgacatcaagatcgttgtttgttttatttgattgatttgagacaataactgtaggatctctaattggtgtgacggatctaaaaacgtcgtcggctcgtccaagatcaagatatctgtttcctgagcaagtgccatagcgatccagacacgctgggtttgtccaccagacaacgttgcgatatctcgcgtgcgatatccagacaaacctgttgcatccaaagcccactcgattgcttcatgatcttgtgcatccataccactaaacagtttttgatagggatatcgtccgtaagatactacttcttctactgtcatacctataggatgttcactagtttgtgctaataaagcaattttttttgcaagttcttttgaactgtatgtagatatatcagagtcattgacaatgatctttcctgatttcacaggtagtatacgggtaaagcttttcaataaagtagattttccacttccgtttggcccgatcaagctcgtgattttcccttcaggaatcgtaacagacatgttttcaataatttttttattttcgtagccggctgcaatatcagctgcccttagtctcgtcatttcacccaccctttcgctgaaaatcattctcaattatgacgctgtttcactatttcgtcaagcgctactttcatatctatagctaaatgaagcggttgacagcattcgaaatatcaggaataataaccaatgagaaagattctcaattatgtcaggaggaaagaaatgaacttaaaaacaaaagtattcaccttatctagcatgttgctgctggctggagtattgagcgcttgctccccctcttcagataaagaaacagctacaactaccaattcgacgacttcatccaccagcacgcatacagtcacagatacgcttggacataaagtcgacattccaaacgcacctaaacgaatcatcggcagttacttagaagactatctgatttccctaggagaaaaacctatcgcccaatggacagtgggcagtggttctatccaagattatctgcaagatgatttgaaagatgttccaactatttcttatgatcttccttacgagaaagtattaagcttcgaacctgacttgctgttgatttcttcttccgctactgtcgaaagtggaaaatacgagcaatatagtaaaatcgcgccaacttatgtcgtaaaaaatggaacagacgtcacatgggaagaacaactaaaagatgtcggcaaggctttggcaaaagaaaaagaagcggaaaaagtcatttccgattatcaaaaatccgtcgagagcactcgcgaagaattagcagataaaattgagaacaagacagctgcagtgttatgggtgaccaataactccgccttcatggtcagcaaaaatcggtcaagcggtagaatcgtatatgacgatctaaaatttggtgtgcctgatttagtagaagaagtgtccaaagaagccacttctgactggtctgctgtttcttcggaaaaactagctgaattagatgctgattacatcattcttgtaaacagtgataaagatgctgctatgttcaatgaaccaagctggaaaaatctcaaagcagtgaaggacaatcacgtactgcaattcggccctgaatctagctggctatataatggacctattgccagtcaggaaatggtcaatgatatcaaagaaaagctaaactgattttaactaaaaaagcatcttcacgttcattcgcgagatgcttttttattattaaaaactaaatacccggatattattcttcttttgaaacaaccttatttcttactctttcccatttttgaaaacgatgggcatataaattttcctgatccgttattccctcgtattcctctataagagcgaagtctgaaaaatcgatatccccaatatacgtatctccttcaaacgtgctatcaatcaatgtccgccagattcgaccggtgtaaggaagaagttcttgaaaaatccgactgccacccgaaacatagatatcttctgagattgtttgactatacgccaaaagttcatcgattgaatgcatcacttctgcattttctttcgtgcgaaagttcggttgcgttgtcaacacgatgatatggcgataaggaagtgagagatcgcccattccttcataggtctttcttcccatcactaagattcgatccattgtatgttcacgaaaaaaacgcatgtcatttggcaatcgccacggtagcaatccatttttgccgatcagaccattcctatcttgtgcccacattgaaataaacatatcatccgctccttatgattttagatggtttgagataaaaaaagtctcaattctttgaccagcaaggaattgagaactttaaaaacattattttgtttcacggtgcaaagtaactttgcgttcgcgtgggcaatatttttgtttttccaaacgatcaggattgttacgtttgtttttgcttgttaggtagttacgttctttacaagaagtacactctaaagtgatgtttacgcgcatgtttttccctcccatttttacaagaatcctctaagatgactctcagacttgattatcttaccatgattttttctagattgctagtgtttttcacgattttgttaagtaaaactacttgacgataaatacaacggttttacttctcaaacaaaatcttttcctttttgtataaatacccttacacttgtttatatagattatgttttttaataaagggggatactaatatgccatggaacatgaaggactttcctgcatcaatgaaaaacttagataaactgacaagaaaaaaagcaatcgacatcgcaaatgcactgttggatgaagggtaccctgatagccgtgcgatcccaattgccattgatcaagcaaaaaaatgggatgaagatgctagtgaatcagaaaaacgaaccttcgaaaaagaaaaaaatccaagcaagacggatgaacacgatacgaatcctcgtgccggaaaactgcttgattcagatgtgatcgtagaatatgaggaaaaacaatggatcgtgaaatctaaaggggcaaaaaaggcaagcaaccattttgatacaaaaaaagaagcaatcgaaaaaggaaagcaagtagctcaaaacaaacaatcaactttgatcatttataaaaaagatgggacaaaagaaaaagaaatcagttactaagcgcttaaaaagaagcatagaaacaaggagatcatctaacatgcttctatgcttcttctcatattgttgtttctttttttatcaaacagtcacatagtcgattgcttctgcttgcggaatcgtttcatcgacaaagtaaactttataccatgtcaagaaactgaagatcgtccagattttacgttgttcttctttacgtccttcgtgatggtcatctagcaacttcataattttttcttgatcaaaaaattcttttgcaaaatctgcttcgaatagtgctttgacttgttcgtagccgtgttcttctttcaaccaagctttgattggcacagggaatcctaatttcacacgattcgaccactcttctggaagatgtttgttcgcagcttgtctgaaaatatcttttgtgttgttttgattcaacaagaacttacttggtatttgttgagccaatttcatgacttcgatatccagtaaaggtactcgaacttctagagaactagccatagaaagtttatctgccttcaacaaaatatcttttggcatccattgatgaagatcgacgtattgcatcttattgacttcatctttgattccttctgttttctcgtaatgaacagtcatgatctcattcacagatggcgctgtttgatattttggcgtcaacacttctgatgcttctgattcttcgaacactcgagcatgcccgataaaatattcttttgctggcgcaagtgattcatataaatggatacgtccatggaaatttttcatttttccgattttacgtcctaaattatagcgtgtcccttttggcaattttttcagtccttgcgcaatcacacggataaattttgaattcgtgtggaatccatacgtttggtatcccgcaaatagttcatctgccccttctcctgattgaaccacccgtacactttgtgaagcgagatttgctaaaaagtacaacggcacacaagaaggatttgagtctggttcatctaagtgatactggatcaatgggaatgctttaaaagacatgtctccgtcgattacagctgccgtattgtctaagtccaacaattctgttagttttctggcttcaatcgcttcattataggttttatcatcaaacccaattgagaaagaatgatctggtttcaatacagaggttacataactggaatcgaccccgctggataagaaagaaccaacttctacatcgctgattgtgtgtgcttcaatagaagcttgaacagtttcgtcgattttttcgatccattcttgtcgggaatgcgtttcttttgtttcaaaatctgcatcccaatattgttgaatgtccagttttccgtctttatacgtataataatgaccttcaggcaaacgatagacacctttgaagaaggtttcaccgttcaatggagaatattggaaagtcatataaggtttcaatgcttctttattcaattctttattaaaatcaggatgaggcaaaaaacttttgatttctgaaccaaacataaatgttccgttcatttctgcataatagtatggtttgatcccaaaatggtctctcgcaccgaataactcatttttttcattatcccaaatagcaaaagcaaacattccgcggattttttgcaataattctgttccccattcttcgtaaccatgcaaaaggacttctgtatctgcatgtgtttgaaaaacgtgaccagctgtaatcaattcttctctcaaaggctgataattatagatttcgccattaaaaataatgatctttgttcgatcttcattgtaaataggctgagtaccgccctctaagtcaataatacttaatcttctaaatcctaaagcaacgtgtttatcgatatattcccctgaactattaggtccacggtgaacgattcgatccatcattgtattaataattgtttttttgttgtccttgtcgttaacaaaacctacaataccgcacatttaactttcacatcctaatataaaattactgtttatttcatccatatgcatcttaacatagaataaatagcggacgaatattttctctcttacagtttcgtcacgtgaaaacaaaagatgaaagtttctgtttttacagaaaataaagtcccgatatctaatttaccatgttttcttttttgaggctatcttattctcttcgtgttaaaaaaatattagtggatgctgttcaaaaaatagcctccaaacaaaaagacacgaccgaaatcgtgtctaaacatggatatataaggaaggtacgggatttgaacccgtgcaccacattactgcggctcgccggatttcgagtccggtgcattaccactctgccaaccttccgcaagtactatttttaaacttttcccacgaaatgtcaagcctatttctaacagataaataacagaaaccgtttttttacaaaaaaagtccattgacagtttacagccaacggacttaccgatcaaattcatcatgatagaacactatctgattgtttcaggattatctagtgctaaaatcgagtcaattgtccgtttgatcagtgcgatgatttgttcttctgttggatgcatgatgtttgatgacatcaatgatgctaagccagtcaccgctacccatgtaccagtatgcaaggcatcgatataatcatccgataattgattgtatctttcatcttctttgactatttcacggaaatagttgtaagaaaaatcatgaattttctttccgtccccatgttcatcaatgtacaatgccatgtaaagactatgatgtttctttgcaaagtagatatagttcaaaccgagatcaatgattttatcacccgtacgctcaatagggaaaacatcttcttttagttgttcaaagatcgaatccaataacgtatttttcaaatcttccatgtttttgaattccagataaattggctgagtcgaaatccccatctttttcgcaatgtttctcgcagtaaatcctttaaacccttcctttgcaacaacatcataagcagcttttagaatttgatccttggtatagacttttcttctcattaaaactcccccacttctttactgcagtatatgttgttttattgtaccctatttttagtattttttgcaaacattttactcaaaacgttatattttaaatttttttctcagtcttctttaactttttttgcaaaattaaaaaaatttggttaaattcactgggttcccttacatttttagttttaacctaaatgatagttgaccaaatctttcatttcaagttatagttaaagaaaacgaaaaagaaggtgtgtaatggaaaacgaaactgacgttatttatattcatcctcaaaaaagaatcgtttcacagaaaagaaaatatttttatcttagttttacaggtgctttttttctttttattggcttagtttctggtacacctgccgctaattggagtggtctactgactattcttacctcgccaagcaatcttctgacagattattttgctttgggtggttttggaagcgcatttataaacgttgggatcttgaccttactttctgtgcttgtggcttaccggcaaaaggtgattttaaatggccccttattcgcttcgattttaacagttaccggtttttctttttttggcaaaaacctttataattcaatctcgatcattttaggtgtatacctgtatgctgtatttgtcaataaacctttttctcagtatattatgataggactgttcggcagcgcattgtcgccggtcgttagttacattacttttggtatgcgctttcctttgctagtaggaattctactgggaaatttggctggtatagcaattggtcttcttcttccgccgttagctgctcaaactttagttttccatcgcgggttcacgctttataatattggatttacctcaggcttgattgccatggcttttactgctgttttgcgattgttcagctactcaatcgtcgagaatacattggtttccaatgaataccattcccctctcgtctggatcattttcggcttttttttgctgacagtcggttttggtttctattataattcctttcgactttcgggtattcgagagattttcgattcatctggtaaactgacaactgatttcattgctaattctggtatcggtgctactttgatcaacgtggggctagttggtctaatgctttcttcttatgttttgctggttggtggtaagttaaatggtcctgtcatcggtgctattttatctgcggttggtttcagtgcttttggttgtcatttaaaaaacagttttccgatactagtcggaatttttcttgcttctttgtttgggacgtttcatgagatcaccagcaccggcatgctcgttgccgctgtgtttggaacaggcctcgcgcccataagcggtttttacggcagtttttacggtgtaatagctggtatgttacatattgctcttgttgctcttgtccataacgtcagcactttgcacggaggactcaatttatataacagtggtttttcaactggattcgttgcaggtatccttgtaccgatactagataactttactgctgtcagaaaggaaaaaaagacacttggaaaaagaattatcaaaaagaatcatcgatgagcttcttacttatctatattcccacgaaataactgaaatacgtattggcgtagaatttgctgaggagggacttttcatagaaatacagggcacaacagaatctcagccagaagatctagatgtacttgctgatttgctgaacaatcctcgagaccctagcatggaaatctactatcaggagctattaggtaatcctcgacatgatcgggaagattatcatctgctaggtagtttgattgacgatgtggaaatcatgtatgcccagccgattatcaatatcaaaatttttcggcgtgcttctcctcgcccttattattagcctattctacaaaacagcttcatccacctaaaacagctcctgaaagttcgattaaaaatctacttttaggagctgttctaagcttgatattattgattttccaatccttcgtataattcatctgttacaggttctaaaaactctgaattaccagcagtgatcgccaaatgttcaaaccaactgtcttttgtcgcaccatgccaatgtttgatccctttgtgcgttacgacgacatctccagccattaatcgtcttgctggctttccttcttcctgataccagccttctcctccggtcacaagtaagatttgataaccgtctgtatggacatgccagtgattgcgacagcctggttcaaaagttacattacctacaccaacagaaatttcgggatcgtttactaacatattcagatagctttgcccggtaaatacttgagcgtaagcttcgtttttttcacctgctggaaaaatcacgcctttttgtatttcttcgtgttttgtcatcatttatgcctctttcttatcttcactattttcttctagatagatttcttttgctaaactaaaagccgaccaagcttttggccaccctacataaaaagctaaatgggtaatgatttctgctatttcttcactagtaatgccattttgcttgccaattttcagatgagccggcaattgttcaaaattcccttctgagatcaaagcagatagggtgatgatactacgctgatgaggagataattcttctcttgaccatacttctccaaataaaacatcgtcattcaattctgccatttttttacttcctccgttcgtgattgctaggtgattcaaacactgttcttaagtaacatcattatctattgtttcttcgcattttattttaagccctattttttaacctgtccaatgcttagtttactccatcagtatgctttccaagcataattgttaacgttttctatcttttttctatttttgaaaaaacaagatattaaataagtctttagttggatgtttttttgagattattcttttatacttacaatgaacgtatgatgaacttacaaaattgtttgttttctgtcatcttaaaaagtggcgcagacagttgcttttctagtaaagtatagataccaaagaacctctaaggagttgatgaataatgaatattgctgcctctcgaaaactgataaacttcatttccattattggattaggtctatcgatcgcgctgacgatttattttattaatttaggtgttttcaaagatttgaatgctttaagaggattagtaggtgattcgatcattttaggtccggtcatttttatcttcatccaaatcttgcaagtggttattccaatcattcctggaggaatcagcactgcagcgggtgttctgatatttggtccttatgctggctttatttacaattatgttggaatctgtattggttcgattattatctttcttctaggacgacgttacggaaaaccattcattctttccatgatcagcgataagacctataacaaatatattggctggttagacaatcaaaaccgctttgagaagctgtttgctctagctatttttcttcctgttgctccggacgatgcgttatgtttgatggctggattgacaaacatttcaatgaaacgatatacactgattattttgatagctaaaccactatcgattttcttatacagtatggctttgatttatggaggacaatatctaagtggtcttcttggttaatatttattttgcaaaatcagttattgattgattaccaatgttaattctgggaaaggatctgcaagatacattgcaccctttcctttttcattggatttgcgctacaatgtgaaagtaggtgataggatgaattatttgaaacgtagcttaggcaacgcgtgggattttttgaaaggaacacaagcttatttccgtgatgtcttgctgatgcatggctttattttatttatttgtttacccttattgagcagtacgactcgttttattttgcaccgaggagcaattgactatttgtcttatgacaatattcctttgattttctctcagcatcctggagttctgctgtcgttaatcgccgttttattgacgattttactattggtttatttcgaatttgcatttcttttgatgagtgtcttctttattaaaaagaaagaacccgtttctttaaagcagctcttgcacttgacgatacttcaactgaagaaagtgagacctattacttttctgttttttcttgcttattttttattgattctaccgatcagcgggttaagtttcaattctgatctactgtcaaaaataaaaatccctgcttttatcatggattttatttttgctaaccgttggatcgtcgtcagttcctttttactcgtttacatttttcttggctatattgggattcggctgattttcgctttacctgaaatgattttacgagatcgaccttttcgagcatccattcgagaaagctggttgctgaccaaatcacgtctttttgctatcacggggcaatttatcgtgattggtggtacgattttacttctttcttctttgggatatatcgttgttattttggcacaaagtgttgttgaagaatttttcccgaattacgcattgatcagcgctgtatttgcgatgacgcttttacaaggaattttattattcaatatcgtgatgtctactgtaggaattttttatatcatcgttgatttcatggatgacgaaggtttcttaccagagattcccaagtggtttacgcctcaaacgtccaacgtgcatttatctgcgctgaaaaacactggtttgaccctttttgcagtttttttcggtattggcgtttgtctttacaatatggattatctgacttcggcagttcagacaaaaccagtgactgtatctcacagaggtgtaagtacgcaaaatggggcgcaaaatactttagaagcacttgaaaaaacaagcagagactatcatcctgattatatagagatggatgtgcaggaaacaaaagatggccgtttcgtagtgatgcatgatgcaaatcttcgtcacttaactggggtaaatcgaacaccacaggatttgacgttgaaagaattgacaaatcttacggttactgaaaatgggttccaagcccctgtgtgttcttttgattcttatttagaaaaagcgcatgaattgaaccaaaaattacttattgagattaagacctctaaaaaagattcagatgacctggtcgaacgatttgttcagaaataccgcaaagcgattttagagaatcatcatattttgcaaagtttgacgtaccaaactgtttctgatttaaaagaagcagaaccaaacttttatgtgggctatatcttgcctttcaatatcgttgggcctcccgtaacgcctgctgattttttgacaatggagtatagtacgatcaatcgtaacttcattaattctgcccatcaagatggaaaaaaagtatatgtatggacgatcaacgattcagatgctatgagtcgcatgatgttttatggtgtggatggtatcataaccgatgagatgggactactaaatgaaagtgtgaaacaaacagatgaagaaatcacttattcagacaagctactaaattttgttttgggtgttggctaatcaaaaatcgttaatgaaataagtttttatacaacaaaaaacgcataacctgttaccgcaggtatatgcgttttttgtttgacattcataacgtgtccttaattatctcttgattccttcatcgcacgaacaatagctaaaatagcaggaattgcagagatcactgcaagaataattcccattttccctgaactttttcttttaggcatatcttctcgctcccttctgtctttatttatattataagggagttcttgcgaattctcaaaaatactgtttaagaaaccaattcagcaggtgcactaatatcacagaattttacgagcatgcggtacttgctttcataaatgattggatagtctcgttggtcataactttcaacatacacgacagccgtgttgttatatgtacgttcaatacagccaattagttcgtgagatacgccaatcggtttgcatatataagatcttcctacttctgcttttaccatttcattccctcttttctttgtttttctttattttataataacaaatctcccttcaattgaaaacgttttatttaatttttttatttttatttgatttattttttactttttagataactattttcttatcataattctagatgttgtgacaaaaacgtttgtttatattcctatgttgttcgtgtgttcttttcattatcctgctaaattatttacaaggggtgagtatatgatttatatccaagcaatagtctttgtaacgttgatggttgggctacttattggcttgaaagaaaacagctgattgatttaagaaaaaataaataagaaaagtgataaatgctttttaattgcatgaaaaaacggacgatgctaaacttgttataggttcgaaagtttaaaggaaactttcaagaactgaattacattacaaaggagatgaattttatgacgtttacaaaaacaaatatgcaataccgcgtagcctttgatacaacttctaaccgttttatggcgattgatgcacaaaacgaaaataacgttgcgtttggtattacaattgaacaagcagtccgagcattaaatgaatctagatagggagtgacccattccaaatggcgactgatgagatctcggaaaatcaatagaagacgtttgtaacggtgatccgcgacagacgtctttttatattttttacatacatttggtcattatatctgtcatttgttcttgacctaaacaaaaatatagttttaatatcaattatcgtcgctttttatgacaattttgttagctgtttcgatgatgatattttgttatgatttgtataatattctatagaataaaaataaaaaaggagaattttcatgaaaaaaattttagggttaatcgttatcgtattgattgcttttataggttggaaaggctgggactactatcagtctacttatgttggaaaagattattatgcagtaatcaaagcaccgatgcctgcagaaactgatattaaagcagataatggagaagtaattggaaaagggtttaaatataacgtagatgcgtacgctgaaaacggtgaaaaaagacaattggattttgatgtcattacttctggcgactctgctaatggttctgcttatcccgaaggaacaatcttgcagttgaaagcaagcgaaaagcgaattatagagaaaaaagtaatcactagcgataaagtaccttcatctgtaaaagacaaattagggctatcttaacactaagaaaatatcgcaaaaaagcactcgaagtgagtgcttttttacttactgattttagaaaaaaatagaattggtcttcgaagtcactttcctgttcttcaagtccttaactaaagaacaaggcaatgaatcgattcccatacaaacaagaggctgggacaaaattcttgtcacagccccctttttccgaataaatggtgccgatatgtgttaagtacctaaatgggtaccagctttcattttaaagtcagcatgtttctatcactaattatttaaatctagtgaaaaacccttatcttacaggcgttcgttcaattctttggcaaggtcttcaaagcctggtttgcctagaagtgcgaacatgtttttcttgtatcatgtatacatttattactttttttctcttttataccgttagaaaacgccgaaatatcagcattttatctatctcttgttttttctatcttttctgatttttaatatcactatcaccaaagctatcactagtttttctattatttttacttttttatatgtatattgaaacaggagttagaaaaattaatagaagaacgaaaaaagacctcaaccaaatttaattgctagggtctttttataagaagaaatgcatattatcgtttagatattgtcaatacatattcaggaaaatctattttagggtttacaataagaacgtttgttcgtatactctttttgaggtgaactttatatgttaatggaaggaaaaacacaattatggtttaaatttgatccttcgaacaaattcattaaagactttcacaaagtatgggattcagaagttttctttttagcaatcgaagatagcttattaatcaatctctactattctaataagaactactttaaaattcctgctgcgaaaactagaatgaagaaagatgtatattttttgtttgatatcgtgactgacgtgccagacgcacggagcgatcatcggcgttatgactatataaagtatactttcgttgatccagaaaggtatatagattaaaataagttacctaaaaaggacaaatacaaattttattatcttatttatagtaagaagataatttaagattgcgaaatacgatactatttgtaatctatagtatcagtcctataaaataaacatctaattaattactctaaatcctaattataagccttttttctcactttttttcaaatatatggtatgcttcttagtgaattcaaatatatggtatgcttcttagtgaattcaaatataaaagagtttaaagcgtaatacacttatggggaagtggtttggggtgcgctttaaactcttctttattattatctcacagcatgcttaaaaggtctatgtctatggattaagttatgtaaaaaagtgcctctttaaacgtcctaaaatccaaacaaggatagcataatatacactatcgttgatccagaaaacaggtaaataaattttgcaaaagcaataagttaaaaacattacaaaaaagacaaggatatcacatcaagaaaaaatgttttgaaaatatctttgcctttttgtattatatctatattaaataatcaatcacaacacattaactaatttatatatttaatttgttgtttttctataattggataactaattaacttatgactatctaagtcttctttattcatatcaattgcagtaatttgactgtcttcatatgttcgataataatagattcctttgtcaacattgcaacaagaagaataaattgtatattcatattttccatcaccaacatcacacaaacctttttgttgttctactgaacctaagatatggaaaaattgactaatactttctgactctgaatctccagatacagaattcagcttcgtaaaagtcgctttaacaaaacgagatactgaggataaatctccaggcaagcctatccctcccataccgcggctataggcattcaaacttatttgatttgaaaaattatttttaggagtttcactcgataagacacgataattgtttaaattaaataattgatagtcaaatgaaggattattggtaagaacgcccacagggttatcatatatatgaagtccatctttcatactttcaatgacaattgatttttctttatcagctaatagccaatgtaaaggggataaaggaagttcatcactataatttatatttgctaaattgatattttttaacaattttttagcttctcctactgttgagcattgtcctaaaatccaaggaataaattcaaaaggagatacattgtctttcccttcttgtatttctttataatcagcatacccagaaaaatttagcccagccatactcaatcctttttcatttgtcgcatcgtaataaagagggtagtcagctataccagcggcaataccaatcattgcataatgagtatccaaatcatttacctttcgaaaattcaacttataatttcttggagtaacagtgactacttcattgtaagatatttcataatcaaaattccttccaaaataatgatcacttgttacataagtaatagacgtacacatagtttattcctcctaaatattgttctgtccacgttcattttactccaaagttttcctcatttcaaaagaaaatcacagaatacacgaagaagcgtttctatttgtataaactatatcaaagttctatacttaaattatcaaataaaaaggacgtgaagataaatgtcaaatttagaaaacaaagaagaaaaagttgtaaacaaaattgtttctgttgtcaataaactggataaagagttagacgaacttgatacgttatctgaaaatccagaaaaaaaacataacctaaaaaaatggttagttgaacgaaaggctattcatgaaattaaaaaagttcttcatgaagctgataaatatgaaaaatatgatgaaaaagaacttgataaagaatttaaagaaatcaatgacttattactataattgatttatacgattcatttttgagacgtcagactgcaaacaacactctaaatttaggagtttgtctacagtctgaataaattttaaatttattgtccataatgttattatgaatttatagcattaagaaaagagataagactttacatttttttaggaatgtaaagtcttatctcttttcttaattgtacaattagtattatctgcactactttctaattaaataaatttttagttattaacttgattaaaatcagagataatatcaattaattcagtttgaagggttgtaacgattaaatggaaattttcttcatctgttttattatatggggatgttttcgttatatataacaacttttctttttcaattttcattaataactctgtcgaagtctgtactttatcttgataattaaatgcagacatcccactttgtataattgtaattattgctgaagcaattgaaacaatcaatagtaaagacctgtgttcggaagcctgatcaattaatattgggatactagctgataagactatttttataatatttccgataccaattactctattataaaatcgaatttctttttttaatctatcgattgtagaatcaatagattcgataaacgctttttgatccatcattttctctccaatcattttattaaaatcattaacaaaaatattataataggatttaagtaagttctaactaatcacacataaaaataaaaaacatttgtattttatcaaagttttattatacttgtcaatttgtgtacatcctaaaatataagctatttgtttacttctgtagaatatatactttgttgttagataagttgcacatgtttatagaatctaaataataaatttttatgtaccgcccctcaaagaggggggaattttttatcgttgtggaatatttaaataccaacgcttgtcatgaaaatcttgtgctccacccttagtatttccttctggatcgtttgtcgcacgcatcatgacgtatactttcttattagggaaatcacgcatattgaaagatacatgatagccaacatttcctaaagtattataagcttgatttacgtctggtctataaatcccatcagctcttactctagctagttcttttccagtattgtagtccataatgaaaatatactcgtatttataattagcaatgtgccatccagctacatgcaagtttgcgttttcgatttctccgaactgatcaatgtgggcgtaatttgttccatctgtcagcgtagaatttgcagcacctgctcgagttggatcaattactggtttatcctccgaagtagttggattatcatccgtaaaaccatgagccaaatcataggctagtttttctttacttacacccatttcagaaagataaccgtaaggatctgtatgatcgccccaaatattttgtgttacccataaatgcgatttgattcctggttggttataaggagtgtctaatgttaatggaataccatatttcattgctgaatctcttgccaattcaacgtatactttatagttcttttcaaaagtttctttatcatgtgtgtgttgtaactcgatttgcacaggactatttgcattagcatatgaaccagcgccatactgcacataaccaagttgtccaacttggtaaacaattccgccgtctcccacaatgtaagcagtgtaagcactagtccatgaacgttgcatatactgtgcttcattgcgtcctgttgctgtttcgttagctgtttcatgcagtaaaatatactgattattcgctacttgagagctaccttcatttacacctaaattaaattcattgttaatcgtataggcaaacccattaattggcaataaaaaaagagccattattaggctcaatgataaaatgattttcttcttcatttttttcctcctatttttttaagttatatgcagacacaccagtgataacacctaaaaacgtcgctactgcattgatagtcagaactgtcatatctgttccattccatccatatgctttgcctagtgttgcaactaatacagatgtagccggaagtaccgtaagtaccgcccacttaatgatttgataatatttatcaggtaagatcatctttattcatcttctttctatttttatcgagatgtttccctaaataaagttttaatttgttgtgtgtgttctaccaatttttctgcatgtgtatctaatctttcatcgtgtttctttagttcttcatgaatcatcaatcgatctgatttgctcgattctaaatcttttgttaatagttccaagttgtaactcacttgtgatagtgttttcgtaatttttgtaaatgatgcaacaatcggtctaattactaataaaatcaaagaaacgatagcggttattgatcctgctatcgctccccattcccctaaattaatcatattgcaactccttgtatcaaaactaaaagcacatcaattaagatgcactctcttcattgttaataattttttctgcttcttcgtctgtaatgcatagcggaacgaactgtagaacttgatcgtcagtaaaacagccccaatcatacatcattttcacatcgctaaaactaaacatactactcacctccctttgaagctggatttaattgctctttaatttctgcaatatccttgctgttttgaatcgaagcaagcatcatttttgaattgatttgtgctaaactatcagctttttcttttaatgcagtgttttcctgtttaattgctacatcatttaacatgagtttggcattgagctgttttagattgccgttctcgttttccagtgcctcgtacactgcttcaagattatttagcttattgtgatccaatacattcgtcaaaacaatccatcggttttcttgcggatcaaataattgatcattaattgttaaaggctccccatctgaacgaattccttctaatggtgggacatcagtaaacgggacagtcataaccatatcatctaacacttttccgacatattccccaagttgatcatctgtggcacatttgatgatgtgaactagtctcggccttgcatcaagtacgatgtttattttttcttgtcgtgacatgaaaagcactcctttcttagttaactaataatttgtagacaattgaaacaataatagaaagtaatattggcaaaacaatcgtacaaaatttaccttcaagaaaatccttatcgttctttttcatttgatcacctctccatgtgtcactttgttactttgttgattaaaaaaaatagtccaatcaaaggataaaacagtggcaattttcatagctacaaatggactaggacttctcttgccactctcaatcatactataataagaacgctgaattcctgatcttttagctactttttcttgagttagattttgtcgctctcttttttcaattagccatttcctcatcatatacctcctatttaagtgtcatttcgttacaaatacattataagtaacacatagttacttgccaatgcaaaaagtaacaaaaggttacttgtttttagattcatttatacgtaacagcgtgttaccatttatatagaaagtgggtgtcgaaatgtttccagaaaaaatcaaagaattgaggctttcaaagaaaatgacgcaacaagaagttgctgataagttaggaattactcgccctgcttatacagcctatgaaagtggaaagagagagcctgacttttctattcttcaatctttagctaatatttttgatgttactactgattatttattaggaagaaataaaacgccaaaatgggccgatgaaaatgatttaattgaattagataaaatgctcgattccaacgttaacatggcttatggtggtgaaacattaacagatgaagagaaacaacgggtaaaagatgttttgacaggtctattttgggaatttagaaaagaagacaaaagtaaagagaagtgattttctatggagatggacgtaattagtctagttggcaaactgaagcaaaaatataattcagctaatccctttactatttgcgaaaaaatggatattcagattaggtatgttccttttttgaataatccaaagggacaatttcaagaactgttagggcgttcggttattcttctaaatcacgaactaaagtattctgaagaacggttctatatttgtgctcacgaactaggtcacgcaatttttcatcaaggtttatctagttattatgtccctactcgatcctccagaagcaaatcagaaagcggagcgaattgctttgccgccaatcttattatttctctttataaagaagataatgatcaataccctagaaaaattgaagatttaacaaatttgtatggacttcctaaaaattcatatagatttttaatttaattggcgactatcactacctgcctttaagtgggagtaaatatatttttattgttatggaggaagaaatgaaaaaaatagttgggttaggattaattctgttctctagtattgtactaggagcatgtggaaatagtaattcaaattctgatacgcctaaagaaacaaccactgcgagctctacaatggtttctcttgaattcagtagctctgtggaaaaaaagactaatcttctatcaaatgattcagatttcggaaaaatagctgataatgtacctgatggaaaatccatagaagtacaaggtaaacaagattattcaaccaattttaatgataattcttgggcgggtgttaacctaaatatcgatcgggtctcagttgtgaaaactactgatatcaaagactattcagataatcaatacaatggttttgtagccgtgcattacaacatagataatacacaacaagatgtatctatataccctaatcaagccacaattgtaactgactatggtgagcaagttgatgatggcggagtctttaattatgattcatgggatggtgacttcatgaaaggaacaaaaaaagatggttggggtatctatcctttatcaaaacttcctgttgcatcttcaatcaaatctcttcgattgaagattgattctagctatgaaactgataattatgatgatgaaaactcgtatcacacatatgatattaacttaaatttacaataaagactggccttcgggcttttctttttaaacgcaaaagaacataagttcgtataaaaaactctgctaatacgacgattttctaaatattcgttcaaataacatacctcccctaaaatattcttattattaggaatgaaatacgaaaggattgattttaatggcttccattaaaaagtactatttaaaaaaatcaaaagaatatcgttatgaagtctatatatcaaatggaattgatcctggtactaagctacagaaaaagattcataaaaaagggtttaaaagtcatgaagaagcagaaagattcgcaaaaattgtcgaaggcgaaatagcttcggaagaatatacacaaaaaaaccctaaaaatttgactatagaaaagtttatggacgattggattaataactataaaatgaatgttaaagaaggaacaagaattgttcacagagcaaatataaaaatgtacatcaatccatatattggaaaatataaactagataaatatactagagctgatcatcaaagattcatcaatcagttacttactaaaaagggtttggggagaactaaggaaggtctctcagtaacaacagccaaaagtattaacgccactcttagcaatgctttcaaaaaagctattcagttaggatatataaagaataaccctactactagttttgttgagtttccaagaaatccatctgataaaaagaaagttaaatattatacttttgatcaatctgaactatttctcgaatttgccaaaaaagaaaaatcatttatatggtatcccttttttcttattatatttgatcaaggattgcgaaaatcagaagctttagggcttcaatgggctgatattgatttttctcagaatacacttaatattaatcgtgaacgacttggggctgctgaaaaaggacctaacaaaggtttgattattacagatgacacaaaaaccccatctggtacacgatcattgcctatgacaaaacgagtaaagaaagccttattgactttaagaaatcaagtaataaaagaatttggttttttacctgaaacagatgaccacgaagcatttatttttataaatacttacggtaaaaataaaggtattccaataagagatcgaaccgttaacggtgcttctcatagaattgaaaaacgtgccagtctcccccacataactgtgcatgatggtagacatacttttgcagctagaacgagacaagcgggaatacctttagaagatatcaaagattttttaggtcataaagatgtttctactacacaagtctatgcccatatttctcccgaagtgaaaaaaagatcaatgaatcaactagaaaactatatagaagagcaaataaaaaagcactcaaattgagtgctttttttaagttcactatcactaaaactatcactaattttatttagaagcgaacatgtttctatcactgattttttaaatctagcgagaaacccttatcttacaggcgttcgttcaattctttagcaaggtcttcaaagcctggtttgcctagaagtgcgaacatgtttttcttgtaagcttctacacctggttggtcgaatgggttgatgccattcaagtaacctgaaatacctacagcaatttcaaagaagtacattgtgtaacccaatgtgtaagcatccatttctggaattttgactagcaagttaggtacgtcaccgtctgtatgagcaagcaatgttccttcaaatgcttttgtatttacgaagtccacttcttttccttgcaagtagcctagaccgtctaagtcttctgcttgttcaggaatcgtgattgatttacgaggtttttcaactttcacaactgtttcaaaaatgttgcggcgtccttcttggatgaattgtcctaaagagtgcaaatcagttgagaagtttgcgcttgaaggatagatgcctttttggtcttttccttcagattcgccatacaattgcttccaccattctgagaagtattgcattcctggttcataattgatcaataactcagttactttgcctttacggtaaagaatgttgcgcattgctgcgtattggtaagcttcgttttcttctagtttgtcgcttgaataagctttgcttgcatcagcagctccttgcatcaatgcgtcgatatctgctccactaacagcgattggtaacaaaccaacagcagtcaatacagagaaacgtccgccgatgtcatcaggaatcacgaaagtttcccaaccttctgcatctgcttctactttaactgcaccttttgctttatctgttgtagcgtagatacgtttgtttgcttcttcttgtccgtatttcttaacaagaagctctttgaatacacggaaagcaatcgctggttcagtagttgttccagattttgaaataacgtttactgaaaagtcgcgatcaccgattacttcgatcaaatcagcgatatatgttgagctgattgaatttccggcaaagaagatttgtggtgctttgcgtgtgtcgctatctaatagattgaagaatgtgtgattcaagaagtcgatcgctgcacgagcgcctaaataagaaccaccgataccgataacaactaatacttcagaatcagattggatttttttagctgcttctttgatacgtgcaaattcttctttgtcatagttcgttggtaaatcgatccagccgcggaagtcgcttcctgcaccagttccttcccgtaattcgttgtgggctgctgttacttggctttgcatgtaccctaactcatgttcattgacaaacggtgctacttttgaatagtcaaaatgaatgtgtgccatttgttctcctccttataggtttactctacaggtaatactttacgtttttttttattatttttcaagcaaataaacaaaatgctgacgatatttccaagaaaatttcattttttaaactaaaccttctgctgccattgctttggcaactttttcaaatccagcaacatttgctccaagaagcaagttcttttcatcgccatactcagcggctgtttggcgacacgtatggtaaatcttttccatgatttgatccagctgctcatccactttttctctttcccaagtcaatcgctgggcgttctgactcatttctaaagcagatactgccacacctccagcattagcagcttttcctggacaataccacacgtctgcttcatgaagaacagaaacagcttttactgtacatggcatattagcgccttctgctacgattttgatcccattttctactaagatttcagccaagctttcgtctatttcattttgagtagcacatggcaaagcgatatccgccttttctttcaatgtccaaacagattctccagcatgataaacagcagaaggacgttggttcgcgtattccgtcaaacgttgtctattgatttctttgacttctttcaatagtttcacatctattccttctggatcatagatgtacccgttggaatctgaacatgtaaccactttcccgcctagctcttgcactttttcgattgcataaatggctacattcccgcttccggaaacaaaaactgttttttgattaaatgaatctttttcttcgttcaatagatgtttgacataatacactaatccatatccagtcgcttctgtacgtatcttgcttccccagaaatctagaggtttacctgtcaacataccagtatcatattttttcaatcgtttatattcgccgaacaaatagccgatttctctagctcctacaccgatatctcccgcaggaacatcaatcgatggcccgatatgttttgacaattccaacatgaaactttgacaaaaacgcatgatttcattatcagatttccctttaggatcgaaatcactcccaccttttcccccaccgattggcagaccagttaaactattcttgaaaatctgttcaaaagccaaaaattttaagatacttaggttgacactgggatggaagcgtaatccacctttataagggccgatagctgaattgtattggatacgatagcctctatttactcgccagtttcctttatcatcttgccaaggtactcgaaattgaataattctttctggttctgttaaaagttctaaaatattcttttcgatatattcgggatgagtgtccaaaaaagacattactgtgggcataaattcatcgattgcttgtaaaaattcttcttgtccttgatccttttgatgtagcttttcttgaattgcttgaacatattctgttgcgtttgtcatcgttccacgctcctttgcttatcttccctcattttagctcattttctcttttggctcaaaacatttttttctgttttctttcttcaaatatgctacactttccttgaggtgagggaatggaaaaactgtatgatgtgatcgtagtcggcgctggaacaagcgggatgatggcagcgatcagtgcagctgaacaaggcgcacgcgtacttttgattgaaaaaaacaaaaaagcagggaaaaaactactgatgacaggtggtggtcggtgcaacgtcacgaataatcgtcctgttgatgatttaatcgcacatattcctggaaatggaaagtttttatatagtacatttgcgcaatggaataatttcgatatcatgaacttctttgaatcacaaggcgtacatttaaaagaagaggatcatggacggatgtttcctgtgacaaataaatcaaaaacgattatcgaagcattacttaatcgtctgaaagaactagatgtgacgatcctattctctactcgagtagagaaattgatccacaaagaacataaaatttacggtatacgcacggaattcgaagagttccatgctcctgccgttatcttaacgactggtggtcggacttatccctctactggttctactggagatgggtacaagatcgtgaagcgagtaggtcacacggtgacgcctctttatgcgacagagtcccccttgatatcggatgaaccgtatattcaagagaaaacacttcaagggctttctttacaggacatcactttacgtgttctaaataaaaaaggccgtgtattgactgaacatacgatggatttgcttttcacccatttcggtatttctggtccggctgcactgcgttgttcaagttttgtcaataaagaattagagaaaacgggagaaccagtgacgctttctctggattgtttccctacacaaaccaaacaagagcttattcatttattgacagaaaaaagtaaagccaccaaaaagaacttagtaaatgcttggcacggtctattacctgagcgattgttggttttctttcttgagcggcttgaaatggacagcctaacaggacaacaagcctctcaaaaacaaattcaagatttcgttcaattatgcaaagagtttaagctatcaatcaacaagacttttcctattgagaaatcatttgtaactggcggaggggtttctctaaaggaaattcatcctaaaacgttggagagtaaaatcattgatggtctgtattttgccggagaattactggatgtcaatggttatactggcggctttaatatcacagcggctttcgctacaggacatgtagcaggaatgaatgctgggcaaagagcataatgtataaaaaagaaagaaggagactgggcaaacaacatcccggcctccttctttcttttatacgtatgatttattgttttatatctgcaaattgtccgctcgttaatgcacagatatcttgaggagctaattccatctgcagccctcttctgccagctgatacaatgatttgatcatagttttctgcgatttgatctaaataagtaggaaatagttttttcattcctataggcgagcagccaccacgtatgtatccggtcgttgcttccaaatctttcaaatgaagcatttctacttttttattccctgaaacttttgctaatttttttagattcaattcggcttctcctggtatcacagcaacaagaggccccgtcacattgcccacagcaaccagtgttttaaatatacgagattggctctctgggagctgttcggcgacagaggacgcacttaggtggttttcgtcccattcatattcgtgttctgtatagggaatctttttttgttcgaccatacggatcgcattcgtttttactatttttttctttgccaaaaaatatcacctcaaacttgttctacaacggttcatttaataattggataatttgcttcaatgctttgaccggtaattgtcctggagcagaaacagaatcactgtttaaggaaccaaacgtcatgacggagcctgtcgttccgccagccagacgagaaattttccccagatcgcccatagacatcgtaatgataggcatggagacaaaagcatttgcccgtctagtcaactccatcaaccgcaaaacatctcgttcattgttgggagtcactgccaactttccgatatcagcgccaaaatattccatgacattcagtcggtaaagcaagacagggtcagctggtgtttctttaaaatcatgactactgatgatcaaagggatatctaaagatttgatttcctctatcagtcctttccctaaactttcaactttgaacaactcgatatcgaccatatctactaatccagtgtgtatcacatgttcataaagatcgcgatactgacggatcgatatgtcttgttctccgccttcagctaaggtacggaacgtaaataataacggcaatccatcaagcatctcatggataagaaccaatgtttctgcaacttcatcaaaagaaaaaaccttacgataatgatcgactcgccattctactaagtcggcccctgcttcacgtgcaagaactgcttcacgtaatacttcctctcggacggctccgataagaggcgcacaaatctttggtctaccgcttcctatattcaatccctttatccgaaccactctgcatcgctccttctaatggttatttttaatttgataaacaaacactttcagataattgccttctaaaaaggtatccgtcgtctggaaatcttttggcagacgatataaagcaagttgttcaaaagaaacattcttggcatggaattcctcttcgatcattgtttggaattgttcgatcgagacattcgcagcatttgtagacgcaataagtatcccatcttctgctaaaatatccagactatccttgatcagttccccataatcttttgctacgcgaaagacttttttcttgtttctggcaaaacttggtggatccaatacaatcatgtcatataaaaattgttttctttttgcgtatttgaagtactcgaatacgtccataacaatgattttttgctgatcgacatccaggccattcacttcaaactgttcctgtgtttttttcaaactgcgttttgctagatcgacacttgtcgtttcgattgcccctcccattgcggcagcaacagaaaaggcgccggtataactaaacatattcaaaactgttttcccagaagcgaaaccttctgctaatgatccccgtacttctttttggtctagaaagataccagtcattaatccttcattcaaataaacagcaaattttactccgttttcttttacgaccaagggctccggtgcctcttttccgtaaatgaactggctctcaggcagattcactgattcaaaacgaattttctcatatccgccgatgatttccggatagatttcacgaaaagcttgaatcaataattcacgatgtgtatataacgtctcgttataccaagaaaaaacagcataacctgcataataatcaataatcagaccgccgattccgtctccttctccattgaatatacgaaaagcggtagtagaatcatctgaaaaaaagaaagttcttttttcttttgacttcacaaaaagttcttcaaaaaatgattgatcaaatgggatatcctgctggctcaatacccaaccgatccctttattctgctttcctagatatccttttgcgataaattggttttgcggatcaactaattccacccattgcgtggtttctttttggggatgtgcaaggtcttctttttggatcagtgggtatcctttttttaatcgactgcttgctcttttttttacttgtactttcattccttcacctgctttagctttctcttctcaagtataacaaaaaacataggacttgtcttactgctcctttttcatcaagcttaaagaaaaacttaatgaaacagcacaaagttctggtttcaattgacactatattgtcatactagtaaaataaatgagaataagtgagctgtgtaacatggtttcatgacacttctgtgattaagaagtgcagaaaggaagattatcttgaaatatataaaaacacctgcctttttgaataagaggctcggatttttttctttactagtcgttttactttggttgaaaacgatttttgcctatttggtcgatttccatcttggaattgaaagtggcattcaatactttatcttgtttatcaatcctattgcaactacactgttattacttggaattgctctttatatcagacgccccagagttgcttatatcacgatgatggtcatttattttcttttgacattgcttgttttttcgaatgtcacttattatcgagaattcacggacttcattacgatcaacacgattttaggtgctgggaaagtagcaagtggtctgggagaaagtgccattcgactgtttcgcccatatgacgtgatctattggatcgatttcattatcttgactgttctactgatcgccaaaaaaatcaagttggaccctcgtccgattcgagcaagaatggcttttgcgatctctacattagccgttatgattttctcaggaaatctttttatggcggaagctgatcgtcccgaattattgactcgtacattctctcgggattatttggttaaatatcttggcttgaatgctttcatggtttacgacggcgttcaaacttaccagacaaaccaagtgcgggcagaagcaagccccaatgatatgaaagaagtagaaaattatgtaaaagaacattacgcagcaccaaatgatgatttgtttggacttgctaaaggaaaaaatgtgatttatatccatttagaaagcttccaacaattcttgatcgattataaattgacagatgagaatggtgtccaacatgaagttacacctttcatcaatagtctttatcacagcaacagcacgttcagttttgacaactttttccatcaagtaaaagcaggaaaaacaagtgatgcggaaacgctgatggaaaattcattgtttggcttgaatcaaggctccttgttcacacaattaggcggaaaaaatactttccaagctgcacctgatattttaagtcaaacagaaggctacacgagtgccgtgtttcatgggaacgccggcacattctggaatcgaaacgagacctataagaatttaggatatgattatttcttcgattcttcttattatgacgttaatgatgacaattcgttccaatacggtttgcatgataaaccatttttccaacaatctgtacaatacttggaacgtctgcaacaaccattttattcaaaattcattgctgtatctaaccattatccttattcgaaattcaccaatgacgaagctggattcccgttagccaatacaaacgatgagacgattaacggttacttcgcgacagccaattatttagacactgccgtacaagaattcttcaactatttgaaagaaagcggcttgtatgataattcagttatcgttctttacggtgaccattatggtgtctcgaattctagaaataaaaatctagctgaactagttggaaaaacaagttctacttggacaaattatgacaatgcacaaatgcagcgtgtcccttatatgatccatattcctggacaaacacaaggcgggatcaatcacacttatggcggccaagttgatgctttgcctacactgctccatttactaggtgtagatacaaaaaattatattcagttaggacaagatctattctcgaaagatcatgaacagcttgtttctttccgtgatggcgattttgttactccaaaatatacttactacggtggtaccatctacagtaacgaaactggtgaagccattactgaacctactgaggaagtacagaatgaaattgattcactcaaagaaaaagttgataaacagttagctgtttctgatcaaatcaataacggtgatcttcttcgtttctatacgaatagtgggttagacccaattgataccagtgattatgactacaagaatggtttagggaaattaaaagaagctgaaaaatctctaggtgacaaatcaactagtgtctttagtcaacacaacggacaatcaactgtggatctttataaaacacaaacgtatcaagaacttcacggaacgaccacaagttcttccgaatgataaaacaaatctgaaaagagctgcgacaaacatcttgtcgcagctcttttttcacaacctcttgctttttgcaagaggtttcctggttttggttttaattcgtgattttactaaaggaatttcatactttattcatattcattttttatactttttatagaggtgaaaagtatgaaaatgatccgctatgctactgctcgattaatttattacaaaaagcagacaatactctattgtttattttcaagcttttctgcttttttattgatagcatgcctgactctctaccatttgcaatcggctttagcgaatcaagtccaagatcggctttcatttattggtgcttctgcatctacggagcttcttccggctttagaattagctagccgattttatctaaaaggcatattcagtttattttttctatttgccttcttttttatctttttcttttactattcactcaggcaaaaccagcaagaattgatgaattggcgcctgactggtctttctaaagccaaactgttcctttttattttttggcagctgttctttcctctctttctttgttgtatcttggttttattgtggatcgtcagcttccagtcggtttatgaaacactgcttcaaaggatcaattttcttgtcttaaagactgctgagctgccagatatccgtgatatcttgacttcagtaagcggacttacgattccgatggatcagcagactttctttactatcgattttcaaaatgatctgtttttcacagatattcttagaggctttgcccaaacacttgttggacttagcgggtgctgtctgattctcagcctattgccattcactttttttatccatcacttgcaaagcaggaggtctaaacgtaatgaaacctgaatatttgattaacgctgaccatttgaccgttatcttgtgtcccctcgaaaaacaggataagatattggaacatttaaaaaaagaagttctagttgctaatctggaaaatttcgccatcgttcaaaaagattggccaatgtttccttacctaaagctcaaagaccatgtgctgttagatttaccagaaaagggaatcaaacaagatcgtttagcctatcaagaaaaacttgatatctcttcttcgttacttaattgtgcggcgactgagcttacgccttttgagaaagtaaagcttcaattgcttcatgcgttgctttccaaacgaaacaatattgttattgaagatacatttgatgaacttagcatattggagattcaagaactgctccacttgctttcttatttagctcatgaagaaaatcaaggtatcttactctttacgcatgacgctactattgcccagagtccttacattgatcgtttagagcctgcgggttaaatcagtcattttataataaaaaaacaagcgatatagaagatcgattcatgatcttttatatcacttgtttttttattcttctttgatttctacgtcaggcaaacgaacagtgaatttcgttccttttcctagttcgctttctacttctaattttcctttgtgcaggcgaacaagctgctgcacgattggtaaacctaatcctgattcaccatattttgtattttttcttgaaggatctactttataatagcgatcccatatacttttcatttgttgttcagacattccaattcccgtatcttcgatcgtgatgatcgtttcaagatagcctttttccagggtgaccatgatttggccgttttcggtaaattgtatcgcgttttgaataatattgaccatgatttggacaaaacggtcataatccgcgtaaacatcgatatcatcatcggctttcagtgtcaacgtatcccctgctgcctctgctttagcttctaactgggcaacaatattcctcaatgtttctgtaccattgaattttttaatgaccatactgatttgattcgtacggattttttcataatccaaattttcatttactaaacggatcagacgctctgtttcattcttcatcaatttaatcgcgttttctcgctgattctcagggattgcattgtattccaacccttccagaagaccgttgattgtcgtaagaggtgttctcatctcatgggaagcatctgccatgaattgtcttcgacgattttcttgttcttcgatttctgcttgagattctttcagtgaattcgtcattttattgaaatcatctgctaactcatcaaattcatctttatcatgtacgggaagctgtacatcaaaattgccattcgtcacttctttcgtcgcattccttaaacgattgatccgcttgacttggaatgctgcaaaagcataactggcaatgaccgccacaatactggaaaaaatgaaacctttgaacaggttcagtgtaattggacgaacactgttatcgatatttcgcgcaggttgactgactacaagtgctccatagaattcatgattcaaattgaatggtacaagtgcgtaagaggtcgcctgtgcttgccctaaaatgtttttattcgatgtgaatttctcttgacgcccactcctcagatttttccattgatccgttgttaaggtaaagttcagcaatgctgtattggtcggataaatgacacgttcatttttgtcgatgaatataaaattcacattttgttctgtcagtacttgctccgtcagcagcaatgcattttgaaatgcctgatcttgactaaactgcggaagtgtatcggcataggtctgcgttgtcttttcaactgattcagcatatccaaacagttgctgataattgttttcttcaatcgtctgttttgtcagttgcgtaaaagaaactccgacgatcaataagatcaacgcgaccattccgcaaaaagctaagagttgctgatacaaataacgcattaggcaacaccagaatcatcaaatttgtagccgactccccaaacagtttggataacttgtggtccgaccttttcaattttttgacgcaatttcttgatatgggcatctactgtccgttcatcaccaaaatactggtaatcccagactagttcaagcaactgttcccgagaaaatacttgtcgtggtttttttgctaaagtaaacaatagatcgaattctttaggcgtcaagccttcgatgggccgattgtccagatatgcttctcgtgttttcgtattcatcttgaaatgactggtctcaatatcaaaatgatcatctgaaaccgctgcttcttctcttgcttctgccaactcgctacggcgatgtaaagctttcattcgagcaataagcgtcagcggactgaaaggtttcgtcacataatcatctgcccccatctctaagccaatcacctgatcactttcagaatctctagctgtcagcatgataatcggcactgtgcttgaaactttgcggatctctcttcctactagcatgccgtccattgtaggcaaattcaagtccaatgtaatcatgtcccagtgttgggggttttctaaaaaggcgtcgagcccttcttttccatcatatttgaaggttgcttcccaaccttcatttaagaaaaacatctgcatcatttcagaaacagattgattatcttcaatcattaaaatattcattatcgttccctccagtttccaggtcatatctctgtaattttttttctgtcataataaaaatgggcataattggaaataccaataatagcatttcgatcaaaaaataattcgtatgtccagatatctttaaataataaccgatcaatgtcatcagtaagcccataaggaaaaaccagttcccgcttgtcttttgtgctagtcgccaatgagcgtctgtttttgcggcaagaggcgaatggtacccataaaaaggcaggtttccttttgagggcagaatccgaaaaagactgccaattattaagaataagataccaatactgaaaaaaatcattctttccctcctaaattctcttcttatagtatactctatattgttgactgaaccaatatgttcaggaattcttcacgaaaggtttgtcttttgttcattctttgttaagataaacttattccaataaaaaaggagttttatttgtgtcaaattatcgtgcaatcactttctttgatcttgatggaacattactagatgcgaagtcaaaaatcacacccgaagtggcaaaagctatgaacgcattaaaagaaaacaacgttcttcccgtcatcgccacaggacgtacagaagcagaaatccactcgatcatggaagatgcgggcattacttctgcagtcaccatgaacggttctttcattcgagtaaacggtgaagaaatctactctcagacattttcttcagaagaatgtcaaaaaatgtatgatcatgtacagttgaatgggcacgaactttcttactataacgaccagaaaatctggtgtaccggtcatagccaaacaatgatcgaggcttatgactttatccattcagatgtgccggaaatagatcctctaggctttaaagacaatacagtaaatatgttacttatcttatctcaatcgggtgacgaatactatcatgaacattttcctgagctaactttttatcggaatggtccttactcgattgatacagtgaagaaaggaatctcaaaaggcgcaggtgtcaaacgactgaagaaagaacttcaattagaagaagttcctacttttggatttggcgatggtccgaatgattttgccttgttggaagcttgcgacaacaaaatcgctatgggcaatgcctatgatggattaaaagagctttctactttcatcacaaagaaaaatacagaaggcgggattgtccacgcattgaagcattttgatctgatttaaggacattttttcgaaactggaccctttctaaaaaaaatcacttattttttcttaagaaagggacagtttttatataaataatggggtatcatccgcttttttattgaatttatcccaagatgtgctatactgattttgtatgaaaaatacacgtaacccttgttagctaacggggacgttacggattcgacaggcacagtcgagcttgaattgcgtttcgtaggttacgtctacgtaaaaacgttacagttaaatataactgctaaaaacgaaaacaactcttacgctttagctgcctaaaaacagttagcgtagatcctctcggcatcgcccatgtgctcgagtaagggtcctaactttagtgggatacgtttcaactttccgtctgtaagttgaaaaagagaatatcagactagcgatacagaatgcctgtcactcggcaagctgtaaagcgaaacctcaaatgagttgactatgaacgtagatttttaagtggcgatgtgtttggacgcgggttcgactcccgccgtctccatatatgtatggttgagactaatagatactgtaaaaaacgttgataaatcaacgttttttattttggcttaaaaaaaaatttgaattttttgctttttatttaacaattagaatttcgcgtatattgtcacacttagtttttctttgtcaacagtctttccttcaataattttctttatagattaatccattttaactttattagttcctataaaaaaataccaatcaaaaattaccataaataatgagtatctatttagaaaacattagaaataaccagtaaaatgaacggccaattgtacttttactggtcatttatagaatttttttaaggagatagaatattaatacgtgacacttccatttatgtcaaatgttttggcccgctcattactttcaaatcgaagaaaatacgtgccagaagttaatgaacttgtgaaagtaccgttgctagttccagaaaaattcctagaagaaactatagttgagcctatcagattctgccgtgcaatagcaacattcaacacagtagatgctccagcactccgtctagttagattatgcctaacagtatacgaacgtgtagttgaagtagaccactgttgacagatctccatgaccaaataccagtcccactatatgtcatagcggtagcagcgtttacaactgttgcagaaaaaaacttagtattaaaaatgcgagcgatagtttttttcatatatttttcatagtatagctcatttatgtttttttgttataataatagaaacaaatttgaaaggataattctactattaatagcataaaaattaaaataaaattgttatttttaaatgtttcattactatgtttatcgtttttgttttccagatgattttacatgaaatatctttatttttactcactctctatttttcctcctagtggagatgttgatttttggattccatttatccaaataataattattactttttttctctatatttttttactaagtttttttacaaagaaaatttataaggaagtaatcattggattttatattctttattttttagtattaatttatctgctctttttaaaaaacattggaataagaggactagaatccaatcctttatcatttctttctgattttatcaatggggatgcgataatcgtgatgctgaatataatcatgtttataccattaggctggatactatcattaaataaaaaacatctaggcatagtggttttgggtatctggttaattgaaatagcacaatatgtttttcatttaggaatatttgatgtaggggatattattgcaaatgctgctggtttcgttgtgggcactataataatggaatctttattcaataaattttcatttgaaattacgtcttttagtttaaaaaaaataagataaaaatagaaacatatactggaagctagaacaagtacttgaggatatgacaaaaacttttttaatgattatgtttgttatttaaaaataatgtctacaattaaattaagtgaaattagagaagctataatcattatactttatttgttattaaattttggcaactaaaaggactttagagataccttatataatctaaaagaagcgaaggagaatttctgacagtgaagcaaacgaaactagtttttatatactgacctagattcaggttgtatagagaatcaattaaagaaaatttacaattattgtgccacttaaaaagaaaagtgacatataaaaaacaacgccaactaaataaagtgtcttcaaaagcttggactcctcgcttttgaaggcactttatttaaaatctttatgaaactaaagtatgttcatatttattgctgtaattatatagatattctgtcgtttccaactcataaacgtgagtgtattttgccactacttttccgcatttttctaatatttcattgcgatcgacgtcatgatattcgtctacgcagatcacaacacaattttctaatttactgattacttctccaaccactttttgtttcaagccaataggttggcaaatatatttttttcctaaaatgatagtttcgttattcatatttcatccatccttaatgtatttttcattatttaaaatgataataccattaaaatatgattatgaaaaccaataacacttgtgattttataaaaaaataaaaaaaccgaaaaacagatatgtccactgtctttccggctctttttatttttgatttctcttcttttttgtttcaatagtcaattttagttattaataaatgaaaaagcatttatattaaaatttgctaataaaagatctacatatttttctagaaatgcttgatcgatttcatcataccctttcgttactccgcaatcgatatctaaaacaccgattaaatgaccttcttttaccattggtacaacgatttctgattgtgcggctaaatcacaggaaatataattttcatgttttttgacatcgtcaacgatcaatgtcgcttgtttttcagctgactctccacaaactccttttcccatcttgatacgtgtgcaggaaactcgcccttggaacggtcctaaaatcaattcattgccatcaaataaatagtatcctgcaaagacggtctcaggtaatgtttcattcaacaatgcagatgaatttgctaaatttgctaaccagttatcttctgcttctaataatccttgttgctgcaataatagaatttcgtatgcatcttttttctgtttttctgtccacataataaaaaccgctcctttttaatctatggaaaagattatagctcagttttttggtaaacgctaggtttgcttttcaaaaaagcgagatacgttagattggttaccttaaacgcatctcgctgtcttttttattctgcttgttggatttctgctgctaaatcagcataatcaatcgtttcgtgaacaaaagtcggatcatcaactggaaagtgctgtacaagagaagagatgcggctgatttccacgtttccttcagccacttcaaaatctattacatgtccgccaaatgtatgtgtatcatcgataaaatgcagatgaaatcccgctgcagcaactccttggaataattcaggggtaaagaacccgactaatgttccatgaatgttgctttgttggaattctggttgagactctgaaattttcgctagtcttcgataaggtttttcttgtttcggcatgatacggatatgcatgtttttgaataatccagttatcttcactgctaaaaatagattttccccatcttcttttactaagatgtgttttttcaattgttctccatctgcagattctaaaacagaaaaactagtatctggcgtaaaatctgtaattgctgcatagggggtaagttcacttccatctaattggacaactgagccatctgatcttccttgataagctacgccatctaaaaagataacttcaccatcaagtccatgcaatgttcccaatcccagagttcctttttccaatatatgagcaatcgtttctgttccatccatcaaaccggccatcaaagctcctaatgtcccgtgctggtataagattttttcagtcatgtcgacacttccttaatagaattgatctggtaagattgtttctcccaatttctcattatcacggtaatcgattggaatatcaataattacgggtccttctgtcgcaaatccttcttctaaagctttttctaattcctctacacttgtagctcggattcctttagcaccaaaagcttctgcatatttcacaaaatcaactggaccaaagtctacacctgacgcccgttgatatttcattttttcttggaactctaccatattgtagcgtccatcattccaaatcaaatgaacgatattcaattttttacgtacggccgtttctaaatcttgggcagagaataaaaatccgccatctccggaaactgatacgatttgtgtatttggacgtaccagtgcagcagaaattgcccatggtaatgctacaccaagcgtttgcataccattactgaataacagatgtcggggttcataacttctaaagtggcgtgccatccaaatataatgactccctacatctacagtaacggtcatatcatctgttacttttgactgaagtgtgttgatgacttctaaaggatgcaaaatacctgcttctccttttgattggacaatatcccgctccgttagttttgcttgaagagaagctaaatattctttcgcatcttctgacacttgttgaggctctaatgaacctgtcaataaatcaagagtagctgagatatcgccaatcaactctctttcaggctgcataaacggatcgatttcagctggtgcttcatcgatcacaatgatccgcgcatctttttctgcgttccagtttcttgcttcgtattcgattggatcataaccaattgcgatgactaggtcgcttcgtttcaaaagcatatcgcctggttggtttctaaacaatcccacacgaccaaagaaatgcgcttctaattcacgtgagatcactccagctgcttggaatgtctctacaacaggcaatgctgtcttttcaactaattgtcggatagctaatgtttctttttcgcttgatccccgcatacctactaataataccggtagttttgcttccctgatacgttcggctaagtaacggatatcatctgcagaagcagaacctaatttaggatcactcaatggcttgatgatattaccttgaactggcgcatccactacgtcttgaggaatactgataaaactcgctcctttttttgagctcttagccatacgataagcattggcaatcacttctgaaattgtttccggatcttggatttctgcactgtattttgtgattggctggaacagcgctgcattatccatgctttgatgggtcaacttcaatagatcgcttcgttttacttgcccggcgattgctaaaactgggtctccttctgctgtcgctgttaccaaacctgtagctaagttactagcacctggaccacttgttgcgataacaacccctggttctcctgtgatacgtccgattgcttgtgccataaatgcagcattttgttcgtgacgagttacgattaattcaggaccttgatcctctaattcattaaatacaccatcgatttttgcgcctggtataccaaatacataatcaacgtgatggttaatcaaactttctactacagatttcgaaccttgtttcattttttcagccattgaacatcgtcctttttatgctttatttttaattattagttagaaataatcacaaataagtgatacagtttctaaacctgtttcattcagaagtatagcacgttttatttcatttgtttagccatatgtttcaaaaaatgaaaaagaatgacagtttttacataaaaaactgtcattcttggttgaaagtttcaaccaatttcacaagatgacaaaaaaattcaagtatgcgacattggttctacgccgcatacttgaatttttttcaattagtatacatcaaaacttctaattttcatttcccatcaactgatacgctcgaccatccgaacttcttttgaaaaaaccgaatgtgattagataacgcctttgttcgacataatcaccactagaaaatatgtccatcaatatcgaattgacttctgtttctgtatagattactccatgttcgaatcgtttcaagacttctttcagcaggatgtatttcttttttgttgcgcttggtacttgttttacttttccctccttcataaatgtctccaaaactttcattttctcttgctccgtataagtataaatcatcttctttctccttttgattctaagaatactctatttatgttagaatattctgtatttttttaaagcggttactctcaagaaagatattatcatatggctcttttttttactaatatttgtcgatagactcatcctaataagttattcgcccattcgagtaattaaaaaaatactgaatcaagagtaacgcattacatgatgagaacaaaaaaagaacccttgaactccaagggttctttctctgtctgataacgatgattaacgacggatttctttgatacgagcagcttttccgtgtaatgcacgtaggtagtacaattttgcacgacgtactttaccgtagcgaactacttcgatttttgcaacacgtggtgtgtgcaatgggaatgtacgctcaacgcccactccgttagaaactttacgtactgtataagtttcgctgattccagcaccgcggcgtttgataacaacaccttcaaataactggatacgttcacgagtaccttcgacaacttttgcgtgaacacgcacagtgtcaccagggcggaacgctgggatgtcagaacgtaattggtcttttgttaattcttcgattaatggattcatggttttcttctccttattccaaatattcttatgagcttttctcacagcggaatatcgtaatagttaagtgcttgtacactcaccataaaatactaacatactatcaatctactgtaaagaagattttagaaaaatttacttggttacatctgctgttttttcttgttcttctttcttgatctcttctaaaaatttcgtcatttgaggtgtccattcaagtgtttccaagagatcaggtcggcgttgataggttcttcttagcgactcttttaattgccattcttcaatcaatttatgatttccatttgtcaatacttctggtactttcatccctttatattctgctggacgagtatattggggatgttctaatagaccagttgaataagaatcggtttgggcagaagtctgattgcctaacacatctggcaacagccgaactgttgcatcgatcatgaccatcgcacctaattctcccccagtaaggacataatcccctaaggaaacttcatctgtcactaatgtgcggatacgttcatcatatccctcataatgaccacaaatgaataccagatgttcttcctgtgaaaattcttctgccattttttgatcgaatcgtttaccagctgggtcaagaagaattactcttttttggacatccggtgcagcttgttcgattgcttggatgttatcatagatgggctggactttgagcagcatacctgctcctccgccatatggataatcatctactgtctgatgtttgttatctgaataatcacggaagttagagatattgatgtctaataatcctttatctacagccttgccgatgatggattctcccatagggccttcaaacattcttggaaataaagtcaatacatcaatcttcatcgtcaatcagtccttctgggatttctacacggaccactccagcttctaaatcgacttctttgacgacagaagcgatatatggaagcaagatatcagcttttttcggacgttgaacgacccaaacatcattggcacctggtgacaagatttcttttactttacctagttccgttccatcttcttccaccacacgcagaccgatgatctcgtggtaatagaattcattttcagctagatctacagagttgtcttttgacactttcaatatgccatcccgatatttttccacatcattgatagaaggatgtccttcaaaactcaataagtcaaaatttttatgtttgcgatgacttttgactgttaattccacaggtgcttttccatcttggaataatgtcagcaccgtcccttttttgtaacgttcttctgggaaatccgttgttgagatcacacggacttcacctttgataccttgtgtgtttacgatttttcctacattcaagtattcagtcaacttatatccccatttcttttttgtctgttttattttagcatgtgcggagaggcaattctagttttcttttagggtattaagccaaatttatgcaaaactgtggcttgctgtttttgatgacttcttatttcttggagctgagcacttctgtcatggcttcttcatagaaactgccatcttcaatgcagctatagggtcttgacgagtgatcgtatagacatttttcggttcttgccaacttacttctacggctcgattcgtcgtatctcccatatcaatagttatcttaccaaattgttcaggtactggcagcctgttttcttccaaataggctacgatttctttagctaacggcaagggttcttgaccatctgtattattcccacggatccgaatacgccaatttccttcttgccattcaaggtagcttgaacctgctgctccttgctgataccccgtgatttgatgacctaaatccatttgctgcccatttgtatcgatctcaaatggctgcaagacttggatcgtttcttgactagaagcaaatccatattgatagagataagttgcaataggcgtttcttgattcaattcgtcagcattcaacctgaggggacgatctgatccgtaatataaaatagaatagccttgctttgtttgtgccgctgcgacattgagatagccagaagaaatcggtacatctaaaggcatgggcacgtttggttgttgttctttcaattggtttaaagcaggcttttcctcattatttgaggtagtccttgtttgttcagtagatgaagccgttttagtattacttttttctgtacttgcaacagtttcagatgtactgcttgatggttgcgtattgtctgatctttcagtaatcaaactgcaggcgcttaacaataagacaaacggaataaataacatagtatttctcattatctgttcactccctcctattataaggatacgctttcttacttcttttgccaaataatcatttcttcaattaataaaaaaacaaaaaagctgtactcggaaattcgagtacagcacgtttatttacttttccttatcatcgatgatattcaaacgcactttttttggtgcattgatccgaacaccgtaaacgatcgtgcggattgctttggccacacgcccttgttttccgatgatacggccaatatcttcaggtgccactgttaggttgtactcgtaaaaatctttcgactctacgacctctaacttgacttgatcaggataagtgactagcggacgaacgattgttaagactaagtcgcttaaatctttcatatccggtcaccttatttctttgagaatttagcttcgtggtgtttttgcataacgccttcttttgaaaggatgttacgtacagtgtcagaaggttgtgcaccttttgataaccagtcaagaactaagtcttcttttaaaactacttctgcagggtctttcaaaggattgtaagtacctacagtttcgatgaaacgtccatcacgaggagaacgtgaatcagctacgacgatacggtaaaaaggactctttttagaacccatacgttttaaacggattttaactgccattatttatttccacctccattgttttattcacaagatgtagtgtaacagtttttttttaccctgtaaagctttttttctttacagcttgattaaattcgattttttttaggaaatagcagattttagacttcttttttgttaaaaacaagccacccagctacgatggatatgacgatagaacaacatgtcactgctaatgaccgagtataatctgcaaggtggatttctttcgcaagaaaatttgaggaagaaatcaaataagtcggtacatattctgctactttagagaacaacctagcaccataactcagaatgaccgttcccccactagccaacagaaccgcataattggaagaaagaaaagctgaataaaataaaatcaatgaataaagccaacaaccaaaaaaataataagtaaaactgataaataaaggatgggtgataatcgactggtcccaataataaatcgtgtatgctagcgtaatactataacagcaccaatagctgacactccaaaatagtatacccatgatccatttcgacagaaatatcttccagcgcttcatcccttttgtcagcaagttgatgattgttccgttttggtattcgcttgtcaatatcccactgaataaaagaaggaaaaaaatcagcaacatcggaatatttttataaaattgtgtccatgaagtcgttgcatcaactgtaatcttctgaacagaaatccctgactctgccagagttgttgacatagcttgcactaaataaggagtcaatttagctagcaatggattcattataccgaaaatcactgtgagcgcacttagcgtgatgatttttccagtacgccagttttcctttagctcctttttggcgaaggcaatgagttgtctcatgattgaacgacctccaaaaagagtttttctagcgtaggttcttccatctggaccgattggactggcaattggtatttggctagcaaatccatagcaaaaagcatttcttctttacttttttgtggataagctatacgcagttcacttcggatcatccctccaggtaaaagctcttcaaattgttcgcgctcttttttggaaaaaaatacgatctcaaatccactagcatttgtttgctttttcaattcgtccactgatccagacaacacgatttttccattatccaaaaaagcaactttgtcacagatacgcaccacatcagataaaatatgagttgaaaataaaatcgtcgtttgctctttcacagaggataagatatctaatatttcttttcgacccacaggatcaagagcagaagttggttcatcgcaaatgagtaacttgggctcgttcaacaatgcttgagcaatccctaaacgttgtcgcatccctctggaaaattttttgatccgcttcttttcattcgacagaccgacaagtgacaacagttcactgattttttcctttacccgctgtttaggcattcctgtgagttcaccgcaaaagatcaaatactcagaagcggtcatataatcataaaaaaccggtacatcagctaaatagccgatttcttgattggtcgttgtttgtccgtactctacttcttttccgttcactcggatcgttccgctgtcttttttgataagacctaagattagtttcatagttgtcgtttttccagcaccgtttttaccgatgaaaccaaaaatcgtctgttcttctacagaaaaagataaatcatccagcaatttgtttgtaccaaaagactttgagactttttcaagtgtcaagatagccactacgcatcctccttgccaaaaatcaaataaaggacaggaccgatgaactgcataccaacaataacaataatcacccatatcattcgatttccatgtttatatgcagaatgtgtaaagatatgatgaagtacataaataagtaatccaaactgtacaatgattaaaggaattaaaaacggaagaaattctttgatgcccatattactcgcctgccaatcgcttttttagtttttcaatttttgatctttcaatttgttgaaaaaacggattttctaatgcactcaatgccccttccctgatgaatttcgtgtctcttatttgctgtaccccaagatctgctccttcaaatatctcagttatctcatcaaaatacctatcaccatgaaggatcctgccttcctcgcttaacagtataagtgtcaaatccacaaactgttttaagcactttattacttgttcttctttttcatgtttcgcataagcacaggctgcagcataagaaaattgagcacaactgttgggatggaccgccgtcaggttgaatgcttggatcacagcatctattctattgacagtttcttctataaccggtaattgaatgatttgaatcaatagataatgagtggctgaagatacgagattgattaaatgagaaaacatgctgaattgagtatagcttaccgctttttttgtttgaccagcggctcggtacgcttggataagtaaggtgtcgctttgctgggcaaaacgataaggatccgctttttcttcgatttcagataaagcttcttctggtttgcctaactggagcatgaccgctacttttaacaaagaagcattattgcatagagataattctgctgattcttctacgattttcgtacataacgcttctgcttcagacagaattgcttgttgttcctccagatcctttgttagcataaaatgattcaaccacaaaacggctacttgtaaaagaaaaggataacatgagtaatatagtttgaccgcttttctacagtcctccatcacatattcaaagggctcttcagaaaaagcggtagtccactgctgataaaagtgtctgatttgctctttcgtcaattgaggatgatagccgagcagttcatcaacagacacatcaaaaaaactggctaatttaggcaatatgagtacatcaggcatactttggcctgtctcccatttggaaacagaagcttttgtcacacctatgaattcagctagaatttcttgggtcacgcctttttcctttcgtaaatttgctacatttttcgataatgataattcttccatcttatccctcctttttcttcattatatagactttccaagagggttggcaatggagactaacgatacttcgcgatcatttgtcaactgaaacgaaacttttgccagtaagtgtttttatttgctccagttacttattttttgtaagattattatagatagtttgaaggaggaaaaatcgtatgacaaaaaaaattggattttttattggtagtttaagaaaagattcttacaacaaaaaagtagcagaagcttttgcaaaattgcttcctgaagggtacgaaagtgtatttgtaaaattcgatgatctgccattttacaatgaggatcttgaaaccccagaaaaagcgcctgctgaatggactcgttttcgtgaggaagtgagtggattagacggtgtcgttttcgttactcctgaatacaaccgctctgtgccagcagtattgaaaaatgctttagatgtaggctcaagaccttatggacacagtgtttgggatcataaaccaggtttagtcgttactgcatcaccaggtgggatcggcggttttggcgcaaaccaccatctacgccaatcacttgtctttttgaatgtgccaaccttgcaacaaccggaagcatatatcggaaacgttacgaatctaattgatgaaaacggcaatatcgttgaaggaacattaagtttcttccaaacgattttagatgcatatctagatttttctaacaaattagcagaataaaattagaacagtaataaaaaggcaactatgtacaggacacttctgcatatagttgtcttttttgttttttttgtttctactttcgtatataatgcaattcgataaattcaccgaatcgtgtcgtatctagcaattcaaaacgtgcttcataggttcctttttggaataaagggattccgtcccctaataatacaggggcaatctggatataccattcatcaatcatttgatgttctactaacggtttgatcaatcgacctccacccacaacccagatatcttttccttctgtcatttgtagattttttagaaaagcaacaggctcttcgtgtacgacctcagcatctggcaattgtaattgtgcattggttgaaaaaacgaaattctttttctctggataaattgcttcggtttccaaatatttttttgcttcctgataagttttcctgcccatgatggtcgtatcgattgtttcataaaaagcttcataagtggtttgctcacctgtcggagtgtcaaaaagccattgaagatcatccgttttcgttgccaaataaccatctaaacttacagcgccataaaatatgatttttcgcatgctttattcgtcctttctttattttttgccgatacgtacgacctcttctttgcggaaacaactgtcaaggtgatcattgatgatcccgactgcttctaaaaaagcatagattgttgtacttccgataaacttaaatcctcttttctttagatcctttgctaattcatctgaaagaggacttgttgtcgggacttcttcttgtgaatgataagaagaatcaacgatttttccattagaaaacgaccaaagatactcagaaaaactgccgaattcttcttgaatcttcaagactgctttagcgttttggacagcagcttcgatttttctgcggttccgaataattcctttgttttccattagttcgctcatttttgtttctccataatttgcgactttttggatatcgaattgatcatatgctttatcgaatgcttcacttttatttaaaatcgtctgccaactcaatcctgcctgattgatgtcgagcatcaattttcggaacagcttttggtcatcatattcaggaacaccccagacagtatcatgatatcgctgcatattttctgtctgttcactccacggacatctcatttgtgccacctctttgtttagagtaattgtatcagtaaagaataaaaattgctgatagaaaagctccggcaatagacattttcagtctgtaccgaagctgttttttttatcttatttccgttttttctttttcttcttatttttcttgatcattcgattcatcgccattttgcctagtttccctttgacgcctgatccaaacatttggtccatacctgggatgttcatatcccctttggacatttgttgcatcatttttcttgattccttgaattgcttgatcattcggtttacttcaaccacactgtttccagaaccagcagcaattcggcgacgacggcttggattcaacagatcaggatttgctctttctgctggtgtcatagaataaaccatcgcttttttgcgttcaacatcttttggatctaccttgacgttttcgattccagggacttgattcattcctgggatcattttgattagatcttccagtgggcccatccccatcacttgatcgagttgttcaataaagtcattgaaatcaaatgagttttcccgcatcttctgtgcaagttcttccgcttttttctcatcatagtcttgctgcgctttttcaatcagtgtcagcatgtcccccataccaaggatacggctagccatacgatctgggtggaatacttctaagtcagtcaatttttcaccagaaccgatgaatttgattggtgcgcctgtcactgagcggatcgataatgctgccccgcctcgagtatccccatcaagtttagtgatgactactccagtaatccctaattgctgattgaagctgtcagctacattgacggcatcttggccagtcatggcatcgacaaccagcaagatctcatttggttgagttaattctttgatttgtttcaactcatccatcaatgtttcatcgatgtgtagacgtcctgccgtatcgatcaatacatagtcgtttttcttttctcttgctagctccatcccttgacgaacgatttctactgggctgacttctgttcccatatcaaatacaggaacatctagctgttgacctaatactttcaattggtcgatcgctgctggccgatatacgtcccctgcgattaggagcggacgagcattttcatttttctttaaataattcgctaatttaccggtaaaagttgttttacctgccccttgtagaccagccatcatgataacagttggtatttttggtgatttatttaactctgctgtttcagaaccaagtgtgattgttaattcttcatcaacgatttttacgatttgttgtgctggtgataaactttccagcacttctgcccctaccgcacgttcgcgtacgcgtttagtaaagtctttgactacttgcaagttaacatcggcttctagtaaggcaaggcggatttcccgcatcatttcttttacgtcagcttctgatacttttcctttttttcttagttttcccatcgcctgctggagacgttcagttaagctttcaaatgccatattttcttcattccttttatttattcttcgattgcttgaatttgctgtacatattcaagcagttttttatcttccggatacttatcagtaatatacgcggtcatcttttccaatatctgttctcggacaatataatcagagaagagatggagttttttttcataatcctccaagatcttgcttgtccgcttgatattatcatatactgcttgacgacttacttcgtattcttccgcgatctcgcctaatgaaaaatcatctgcataatataactccatgtagttcatttgtttttctgtcaataaggtcgaataaaattcaaagagcgcgttcattcgattggtcttttcgatttccattctgctcacctctagttttcagccattcttcatcagagagcacagtcattttttgctgaataaaataagcagtggccactccggcgccattttttgttattccggaaaagcttccatcataaatcgaatgggtcccgcatgaagggcttttttccttcacgatgactagatcaatgtgcttttcctgcaatttttgataggctttgatcgcgccgtttttgtacgcttccgttacatcttcgccgcttgtcgtccatacttttgcttgatctttccacacatcgaacccatttccaccaatgatttcagcaggatctctaggaattgacaatccgccgattacttctggacagaccatgacggcttcgccagtttcaactagttccatcaattctggtacttcttttttctgtccatcatagcgacaggccagaccgcctaaacatgcactgattccaatcattgactgctcttcctttctattcagcaaagtgccttcctattataccatttatttcttctgtaaaatagccccttgtactgattctatgctaaaatataaacagaatgaaacctatttaaaggagatttgaatgaaaaaaatactagttgttgatgatgaaccttctattgtgacgctcttgacgttcaatttggaaaaagaaggctataaggtaaccagtgccgcagatggaggcgaaggattagaattagcattagaacaatcatttgatttcatcattttagatgtgatgcttccaacgatggatggcatggagatcactcagcggctgcgtcaagaaaaaaatgaaacaccgattttgatgctgacggctaaagatgatcaggtggatcgaatcattggtctggagataggtgctgatgactatttgaccaaaccatttagtccacgtgaagtattagcccgtatgaaagccatattcagacggatcgaacctcgtaagcaatcaaaagatgaagctgagcctgaatatctatcgattggacaaatcactgctgatttgaccaattatcaagtcaccgtagacgatcatctgattgaactcacaccgaaagaatttgaattactcgtttatttcatgaaacgaaaagaccgtgtgatcgatcgcgacacattgctagaccgcatttggaattttgacttcgcaggacaaagccgtatcgtagatgtacacgttagtcatttgcgagaaaaaatcgagcgagatccaaaacatccaaagtacttggtgactgttagaggatttggctataagtttcaggaaccaaaacgatgaaatggaaaaaaatttatgagcgtctcttctttcttattcttttaattagtttgttttttggtggttggcaattgatctcccattatttccaacaacagatcgtcgaacagcaagaaagctacctgacaaaaaaagcacaactactgatccggcaattagatgtcgaaaacctccaagcagcgcaaaacaaaactgctttggaagaattcgtccatcagtcgaacgaacggatcactttaatggatgctactggaaaaatcttatttgacacaaacaatgaaacattgaatgaacggcgaagttctcgtccagaaataaaagctgtattgaatggtgggaacctaggtagcgctttgcgcaaaagtactactttgaatgaggatcttttatacgtcgcattaccagtcaaaaaaggaggccagttagaagccattttacgtatcgcagaaccgacaagcggatttttaccgagaacggaaagttttcgccgttgggtctttttcttctttctgtctttcttccttgttcttgcaggaatgatttattacctgatctaccaaaaaaatcagcctttgaaaactgtcctgcctgttcttagaaaaatggtacaaaatccaaaccaagcagaagtaatcatgcagacacctgaccaatgggaggaattgtatcaaacaatcaatgagctgagcgaacaaatgagtaagatgtatcgagcgtatactacaacagaagaacaattgtacacattattaaatgaactgatgataggcgtattcctgattgatgatgctgattctcgtttactactgcttaatccaaagatgcagttgcatttaaacgtgacaagctatgaacctgaacaacgatacacagaagtcatccaagagccaaaactcattcagctgattcaccaagtgactcctgagcatccgctgatccatcaggagatcaccatcgctgaaggacgacagacattagacttgagtttgcgctactttactaattcagaaggtaccggacagattctaggggtggcgtatgacttaacgaaagtgcgacgtttagaaaagctacaaaaggatttcgtgggcaacgtctcccacgaattaaaaactcctgtgacttcactgattggttttaccgagactttactggatggtgcaaaagatgacccacaaactctgacttcttttcttgagatcatgcaaaaagatgcgattcggttagataaattgattcgggaaatcatccagctgtcaaaagacggtgaaaattcttacgagatccagacgatttatacagaaccttatttccagcaaatcgttcaaaattatcagccaatcatcgaaaagaaacggttgacgattcgattgattggaaagaacgaaccatttactactaaaacagatatcctttatccaatcctcaaaaatctgattgaaaatgctgtccaatactcaaaaaacgacagcgagatcattatccgttaccaggcaacagatgaattatcgttttctgtccaagattttggtataggtatcgacattgaggatcaggaacggatctttgagcgtttttaccgcgtagacaaggcacgaagccgacattcaggcgggaccggactagggttagcgattgtaaaagactacgtgcaactccttcatggtacaattactgtagacagtcatcttggaacaggttcgactttcaccgttaccattccgaaaagcaattaaataaggcctgcttgcagcaatgtttagatgtctaacgatcatctactacgctgaaaagcaggctttttattagctaaaaacgctgagccacatgttatagatctttgtcatgatgtgtagctgtcttttttgacatctttacaatcagctcctggttcattttctgataagcatctatagcataatcagcaaaactttgtgttttttgattcaaataatccgttaatttttcgggatgatttactattaattctcttgcttgttggtctgtacttgctaactctttcgatagatggtctcgaactttttggcgagttggtaaagtaatatttttcttaaaatcactatagtatggcttcgtcaagatgttcgtcaaccgatgtgtccagtaagcggaaatatcatctggcatatctgttcctttttgataagcttcgggtgtctcgcttatattgctataaaatggtatataattgcttgtatcaggaatccccaacgctaaccaatggataccactgatttcttctggtacattgtttcttatctgtagaatatgagattccatcgtattcggcacagagattggacgatacttatctggctttgtcccttcgatggtatcatattcagtaccattaaagtgtaatgtcatgatataagctgtttctgcaattgaaataggtttatctggtttgacaaacatctcaaatgaacgatctgttattttttgtttctttgaaggtgtcagttttctctgtgcatcccatatcctaggaagattgtatttttcatcctttgacttatctgcaaatatgtctcttaaagaaatatcccgtttcgtatttatcagttgattcttttctaaaaaagattctaaatctgctgaacaaagataagaatctttgtccttcaaatcaaatgaatcaattgacaacatattaggaataactgcataacagtcatctggaactttgacagctgcccactgatgaccactaagtatctccatataccagatttcatttttatcagagaaaatcacaccatttgtctccgcagctccttgcttagcaacgatttttcctaatcgttctacccctgctcttgctgaatcaatataaggaagggtcacggtcaacatagagtcttctgcgataccatgcgcggtatatggatcttttttcaatatctattcctttgtcgtagctgattcagtagcgctcattgcaacgttcttgctattgataccatcttcttcaaataatccttctgacgtatcccattctggggtcgctgtgtacttcagctgttctttcggaagatcaagggtaaatccattcccttttgatacaaaatgtgaaggattcgtattttcttttctgacaacaaagtgttttgaccaagccgtgttcagatcttcatttctagcaatcatcgttgatccatctactgaagcattttttcctactaaaaccgtcgtacaagcatcaatagaaactgataagaaaatcccatacagtacacctaaaaataaactaaattgaagcaatcttctatttttcatttgaagcatccctcccacttttgtaaaaacgctttcaaaaatgattataggacacctgaagtaaagatttaattggttttctataagttctagataaaaatttgctttgttttttatacagaaagaagcttagaaaatacaattttttagttaatgtatttttaagcttcttttatcttattagtcatttatttcttttgaatactcgaaggaaccgaggcaatttatttattatctccggctctttttcatttttacgttcaaacaaatattctaccaatgtagtcaaatgcctaaaaatcgaatctgccgagaaaaataaaatactcaacaacaaaagcgatacagctgagataccggtgattgaaaacagtttatgcaaaaaaacgaccgaaaaaaagataccgctagcacagaaaagaatgatctgacttctgaatttattcagcggtgaacagattttatagagaacaagaaatcctactgcaatcaaaagcatagtagatgctgtagaaacatctgttttatttagatccaaagtcaccccgcagatcaccaacgcaccgactacgatcatatctgtcagtccacctggcacagccttttccatcacattcatgatgaacttccctctgattcgctttttgttttcttctagagcaagcaagaaagatggaagtccaatcgtaaacaaactaatcaatgtgatctgtgatggttctaaaggataggtcaaagcaaagatgactgaaaacagcgaaagcaaaaaggagaaaatattcttcactaaaaacaagctggctgatcgctcaatattgttcacgacgcgccgtccttctgcaacaacttccggcatgcgtgaaaagtcagaatcaagcaagaccacttgtgaggcctgcatggcggcttcattgccagaagccatcgctatactgcagtctgcttctttcatggctagaatgtcattcacgccatcacctgtcatagctactgtattgttacgctttagcaattgaacgaagattttcttttgttctggcttgacgcgtccaaaaactgtatatttttcgacagctgcttcatattcttcttctgataatttagacgcatcaacgtactgatcagcatgtgaaatccctgcttggacagctacattagatacggtgagcggattatctccagaaatcactttgatggctacttgctgttttttgaagtaattgaatgtggcttttgcttcttttctgataggattagcgatcaggatataccctaatggtgtgactgcctccgttaatactggttcttcaagaatcccatcgtacacaccaaagaccaacacgcgatagcctttttcagcgaaagaaacaaactcttccgcatattccggcaactgatctcgcaaaaccatttcgggtgctcctaaaacatataccttgtctcccaacgctacactgctgaatttttggacagaagaaaaaggaatgacttggtgataggattgatcagtggtttttgtaaagtattctttgacggcttccattgttgcattgtctcctgccatcgcttttgcatagtcagcaatgcgctcttccagttgatctgattggctgattattttttgttttttagagacaatcactttttggacagacattttgttttctgtgatcgttcctgttttatctacacaaaggacatttactcttgccaatgtctcaatgcttttcatattgtgtaaaagaactctttgctttgctagtttagtcgcacttaatgctaatgcaatcgtcgttaacaagtacagtccttcaggtatcataccaatcaatgctgcttccattgcgacgacactttctttcatcgtgtttccattaaaaaagtaactttgagaaaaaagcagaataccgataggaataatgatgatcccaatccatttgatcaattgattaagagaagcaatcatctccgactgttctccttctcccattgtcttggctttgactgtcaattgggaaatatacgaatctgctccgactttgtctaatcgggcgtaagcttttccggaaacaacgaaactgccggacatcaatggatcacctatttctttggttatctcatctgcttcacctgttaataaagcctcgttgacttgcagttttccttccacgacctctgcatctgctggaatctgatgtccagtctctagaataacaatgtcatctaatacaaggttttctatatctactgtttgctctatcccctctcttatgacattgacttttgctgtattcaatacattcaattcatccaagacttttttggatcgaatttcctgaaagatagcgattcctgtattggctatgataactggtaaaaaggtcaagtttttataagattctactaggcaaagcaaaatggctaagataagaaagatcaaattgaaatacgtaaaaatattttccaatataatttgttggtttgttttgaatgtgggatcgactgaatcgtttgctgcacctttttctattcgttccttgacttgttctgctgtcaatccttctttgtacgagggaaaaagacggataactttgtcagatgatttttgtgttattttcttttttttacttcgatttgtccatttattcttcatgtggctacctcgatcaatttcgttttctggatatttacaaacttctcctatccagtatagaacagatatgaaaagtgttcctcctattaagcttgcatacacctttcattcctgtcatatagcaaaaaaagagcgacgacagttctatgtcgtcgctctttttctcaattaaaggaaaaatctatatgcggggaaagatagttgatttttccttgattgtcactataactgtagcatacttatctgctagttatttgatatttccttcgtggtcacgttctacttccatcattgtgattggtaaatagcccaattctttaacaggtccttcttggatttcttctgtcatcatgtagtctaagaatttttggacttcaggggaaggttttccgttcgtgtacatatgttcataggaccagattttccagctgttatctgctacattctcttcttttggttctacaccgtcgatacttagtgcttgtgtggaatcatcgagatatgagaaggccaaatagctgattgctcctggtgtttgacttaccaactgccgaacagttcctgatgagtcttgttcttgggactgtataggtgtggcaccatctaatccccatttttcaaatgtcgcacgggtaccgctgccgtttgcacggttcacaacgttgatcttttgatctttcccgccaacttcattccaattagtgatttttcctgtaaagatatcaatcaattcctgttttgtgatatctttgacacctgtatctttgttgacgattggtgccatcccaactactgctactttatgatccactaatttagaggcatcgatcccgtctctttcttctgcaaatacatcagagtttccgatagtaactgctccagcttcgacttggctcaaaccagttccacttcctcctccttgtacagagatttgataattcggattttcttgtacaaaactttcttgtgctgcatcgaccaaaggctgtaatgctgtcgaacctaccgcaacgatttttacctgttcatttgagtcacttgaattattttgtgtggcagagccatctgtatttcctgatcctgagccgcatccggctaaaagaactccaatcatgcctagagtaaacaatacttttttcattttattgctcctttcttatttacaactaaagtttatcagtcgactgtaaatccctcgtatggttgctgtaaaaatatagttaagttatgtaaaaatcatgtaaacgtttttcagattctttacacgataataaaaaagcatatgagaaacaggcgttttccgccgctcatatgcttgttaccgatgatccaccatcaacggttattttttatagatacagatcgttcactttttatccggatctctgtccagaagtaaaagaatgtcgcaagaataaatgagacaatgactaaatagaaacacggtttaatggtcaagaaatacatggagggatatgctgaatccttcagtccgctctcgctcaaaccattaggaccgatgatcatgcgaggcaacaaggaaaacatagatgtgaatatgagtaaacaagaaaaataaagcagctgccaattataatgattgatcagagattttggcagtaatagacctacacttatcactaagtaaaaaatagtcaaagctggaaaatttctagaaaccacaaatccacttccttggatcagccctaatatctcggcaccttgcacaacagcatttacccatgtaaaaggtagcaaaacgataggaaaaaaccaaaaaaataaataaagccgatcgattactgcttttcttctcatcaatgttcccccaaaccaatttttctttcatcatactatacaattttctatctaaaaaaattagggggaaaaactttttttttagagataatggcatgagagtttattcatttaatctagaaataatgaaaaagtaattgattattatatgattcaatttacaataaaattaacaaaataataacacttgttaggtggtgacaaaatatgataaaaacgtgttggaagaatcttccattgcttttatcttttgttccttatgtgcatttcgctttactgcttgatttctattatcattccgtaagcggattcatcacgttgatatttttatctctttttgctgggtattatttccaaaaaagcaggcgtattttatctttatttatcgccaacattatatctactgtcacttcctatttattttgcgtcaattttgctgaatggcggtacttttatcatcctttaaaaccgacccaactgattttgattctagctggcatttacttagttccacaaatccttggatcgttatgggcggtagccttatcttataaaaaagcacggcatccctaaaaaaataaaccctatatgtacaaagagaagctgtttttttctttttgtacatatagggttttcttataattcatgtagaaaaatttttttgataataatcttatccatcaattgggattgactgttttgctcccctatgatttcagcgatgatggtccgattttgcggttttcttcttagctggtaattgattttcccggttttcatcaattcgctgagcatatccacgaccccgccaaatccggtttttttcgtaataaaaccaagtgcgaccattcgttcatctagattttttgctgtaatcgtcacaccagtaataagcgagtgctgtaatgtttgtgccaactcttccatcccttcagcattggatacgacggaagctgttttattgacagattcttcatgtatttctttttcctttggttctttcagttcctctttcactgtttgacgaaggacatctagttcttgcaagagcgtttcgtattgttcttgggtcaacatcacaccagctactttttcccgattaaatatatatacgccagttcccgcgtctcgcgcttgagcaaatacatccatcggcgatcgtttcacttctgtgatcgaagatgtgggaacttctaatttctttaattccaatggatttcctcctttactaatcgctttttattatagcatagactgacttgttttgatctgttttccaaaggttttatcggtttttccctaaccagtaattgatatccgtaagtagtcttgcaataccaaatgaaggatggtacagatacgttttttgatcttcattatggtctaatggaaaaaaatgatccgtaatcactagatctgcataacgaggtggcttatttcgagtgcaaacatggatcgaaatccgttttcgatgtcttagggttttgttcagtaccccggcaagtcttcttgcttcctgatgttcataacgaaaaaaaaagacgattttcacttcaggaggatggacatctaaatacccccgttcttggagtgtcttaagtaaaagcattccccactcaactgcggggtgtgcaagtgcttgttggattgctagacgaaattgatacagtttatctttggaattgggaaacttttctaatgtttcctgataataacgaacttcttcttccaccaatcgatcatggataccaatcacataacgaagccattcttggtaaagtacttttgtcagctttgatttatttccactttcaaactcactattcagccaaaacagcgaatcaagcttttcagttacgatcgtcaatttccgatagtcttgtgtctcttctatccgttcccaccgtttttcagtaatctggttacagctcaagcgcaaaatcgctagataatttttttcttttattggcaaaatctgctcttctctaaaaagtaattctggaaaaaactcaaagaaaagggttcgactgtctcctaaaatctcgatttctgccggatcctttcgttgcttcaataattggatgaatgtctctgaaaaggattgctctccatcgtctgcaaaaaaatgggggaaatctttcaagaaacaaaatagcaggtaccgtatttttctttctgaaccaaagatctgcgcttttttataagaaaacgaaaggtgatactcaccaaaccattttctcaaccgctcttgtgtcgaacgatcatactcctgctcataaggttcattcaacagcagatttttcagtagacaaaaaggtggtgattgaatcagaaaaacaaaaaggaggtagggttcgctatatccttgatcataaactaactgaacggttttcttatgaagaatcagctggattggacagtcgctttctgccaaacgttttagatgccgatcaactgttttgacatcgattttcagttcttcagctagatccgtttttcgccagatcagatctttcattaggttgattagtgaaaataaattctgtgcattttttgataatagtttttgccatctcattgatcatctctcacctagtttctaaacatattgtttgatcagaaagggctcttttctaaaaagataaaaagtccctttctatttacttaattacgcaaatttctctcattattttttattttacttaatttaattgtattctcattttaaaacgaatgtatttaaaaaaaacataataaaatcactttgcttgtaggatgtatccccttccattacaattaaattaaatagtgatttcatgagaaggtgatgtgaaaatggaagctaaaatcgaagaatccaaacaaaaaatcgatcagttgatacaagaattagaaaaagcggtcatcggtaaacgttccactatccaattgatgattgttgccctgctagcaggtggtcatgtcttgttcgaagatattcccggtgtaggtaaaacattactagtcaaagcactagcaaaggctgtgcaaggaacctttagcagagtccaatgcacacctgatcttcttcctagtgatattttgggcttttccgtctataactcacaaacaaaagagtttgaatttcgtccggggccaatctttacaacgatcttgttagcagatgaaatcaatcgtacgactccccgtactcagtcagcacttttagaagcaatggcagagaatcatgcaacgatcgacaacaatacataccccctagacaatcatttttttgtcttagctacacaaaatccaatcgagtatgaaggaacatatcctttgccggaagcacagctcgatcgttttttattccgactacaaattggttatccttcttttgacgacgaacttctgctacttttggataaattcgaaaaagtgttggataatttgaaggtcgtcttgaacagtcatgaaatagaagaaataaaaacaagtgtggcgaatgtctttgtcagcccagaagtggcatcttatgccttgcagttagtatccgcaacaagaacccactctgctatccagcttggtatcagtccacgaggaagccttgcctttattcaagcagcaaaagcctatgcattaatccatgggagaaattacgtcacgcccaaagatttgcaggagttagttcctttcgttttttctcaccgcttgattttttacgatcgttcattgaaggaagacgaaaagacacaaatgatccatgcccttgttgcacaaatcccaattcccgtgaggtagataatggaaaaagccaaagattatttcattatttttgtgttatttctgatatatttcgtcattgtcttttttgctcttgtattcaacaattctttagggtggttcttattggctttttttactctttatgtatcatggagtgtgttttcattaagcacctttctaaagaaactttctgttacttgcacagtccagccagtcgtttatcgtaaaaaaagtatacaggttattttttctatagccaaaaaaggagctttttctttccctctccctcgtttacagatcgtctttccagagatctttgcagaaaaaaaacaagaaatattgatccttacaaataaaccgcaagaagtccaagtactttggcaaccaaaagagagagggttccatgaagcattaaccgtcatttttacagcctatgatagtctaggactttttagaaaaaggacaagaagagagctttcttttcctgtgactgttcttcctgcttttcataaaactcaagcagaaacattgcaaagagttctggaaaaaaaacaacagctgaacgcgtatcaaaaaggtcttgattttcgagaacatcgctcttatcgccccggcgattcttttaaccgaatcgattggaaattgtctgctcatagtcaagagtggttataccgcgaatacgagtatcaagaagaatattctccgcttctttgcttttggggttcacctagcttgaaatttgaccatctgctagatttgtatttttctttatggcatctgagaaaagaaaagcagccggaacttctgatattaggcgaccgtacctttcatggcaaagatccaggatatacctattttgcttctttgaacgctggcgatgagaaaacttttttggcacacttgaaaaaacaggcaaaaaaacaaatcgtcctctttattcctgagcattctcctgaagtctcagaagctgtcgaaacattgtcgaaagatcgaacggtctatcttgtttatttcgcagaaaaacaaatcatgatacaagaaaaagacaaggtatgttcactgtcaggaggtgaatggattgacgattaaatgggaaaaatacctgcgtggcgtttattcctttatgatgctaagtgtaggtgctccgatatttgtagcagctaatcaattgcaaaatagctatcctcttatcctgactattggtatcctatgtcttattgtatgctgtattcctaaaaaatgggtacgattgctactttctttgccagtaatgattggctgtttgtttacctattttccttcaaagacaatttctttattatgggtcgtacagtttttttcgtcagttacagaggaattcttccatctatcccaaggtaaacttcattatttaccagaaaagacagctttttttctcatattgttgttgatctatttatttattactttgaccgtggattacgactattggtatgcaccctttcttgcattgatgggttacttcatgatgcttaccgtttttcgggaaaaagaactattgtacgaaatgattgcggtagtagctgttttatgcgtatatttggcagcaaggcaatttttctccctccgattgttgtcgggaaacgctcgattccagtcgttaactacgatcctgcttatttgtttgttcactttcagcgccatcttgcctttatatctcccaaaagtacaccaatctcttgaggaaacgagtgaaccgatccgagaatatcttaatgataaagggctttatgacagactccatgagtatcaattaaccggaagtgccagaacgggtttcagtgaaaatgatgaacaacttggtggtccattgtatgataatggcgaagttgtttttacagcgaaccagaaagtaaacggctattggaaaatagaaaataagaatcattacaccggttctggatgggtagaagatccggatgcacccatccaaccaatccaagaatttcctgttgatatcacaagctaccaaacagttatggaagaaaaagaaaacattacattgacgctaaaaaaccaagctttcttaccttatccttatggaaatactaccttgactgatttttcattagccagtggacaaacactttactatttgcctgaaagccaacgattcatccctgtcccgaatgaatcgacgcgattggcgtccttacaaacagaaagattagcttttacgagagaagaattaaaaagcagtcagttagaggccgatgatttagaaaaacaacagacaaatcttcagttgccgaaagggttgcctcaacgtattgaggacttagcgatcgaattgaccaaaaatgaagcaactttaattcgtaaagttgaagctgtcgaacagtatttgaaaacaagcgggaattttcgctattccaaaacggataccggacatacgcctaaagaacgcgattatgtagattatttcctcttcgattcaaaagtcggctactgtgacaacttttcaacttctatggtcgtccttcttcgcacactaggcatcccagctcggtggacaaaagggtttacggatgggattagaacaggaacagatgagcaaggaaatgaggaatacagcattctcaatagtcatgctcattcttggccagaggtgtactttcctgggtttggctggcttccatttgaaccaaccctttcatttgccaatccaactgtttcacaaccagccgctgaaacaacagaaaccgtccaatctgctgaagaacagccaaaagaaagcgaaaatatagtagaaactatttccagtgagaaacctgagactatttcgtcagataacacgacactcacaccgtcttataaaatcgtcttattcagccttggggtgtgtttatccgtcttgttgttctttctattgttatttagaaaatctctgcgctggacaagttatcttatctatcttcatttttttgcttctactaatgcggttgcgtatcaaaaacttctccaccatttggaaacactggtaccgcgcatccccgcagaatctttgcaggcatacagccaacgaatagaacaaacattcaatctagatcaacgtttcattcgattaactgctcaatatgaagcagaaatatatgggagacaagcagatccggtaaaattcgataaaaaaacctatttagaactaacgcatataataagaaaaacggtatccaaaaaggttatgacaaaagggagcagcttcaaaaaataagataaaattcctagagaatctacttctggaatgccgataaccagctgattgagcatcgattattcgtaaaaaaaggttgtgacacgttttttgtcacaaccttttttcattattatttgattttcaatgtcaaagcattcagcgctacgactaccgtacttaacgacatcaagacagcaccaactgctggacttaataggataccaattggtgcaagtattccggccgctagtgggattgcgagaatattataccctgctccccaccagaggttctggatcattttctttcgcgtttgcttagctaaatcaaggaaatgcaaaatatcttttggatcgctgtttgtcaagacgacatccgcagaatcgattgcgatatctgttcctgcacctattgccatcccaatagaagcacgggctaaacttggcgcatcattaatcccatcacccaccatgattacttttttcccttggtcaagatatttctggacaacagcttctttatcatctggtaataaaccgccgtaatattcttcgattcctaaataatctgctactgcttgagcagcatttttattgtcgccagtaagcatgactggagtgatttttctttccttcaatgttcggataaactcttttgcttctgtttttactacatcacctaaagcaacgattgcagctagatgattttctaaaatcaggaagctaatggtatttccttgttcttggtaaggtttcaataatgcttgttctacatttaatccgagacgctcaacttctttttcattaactattttcacttgttggtttttgactgttgcctctagcccaactcctgaaagattttttagattttcggcttgataaggcttgatttcatgttctttcaaataattcataatgccaatagccaatggatgattggcattcgcttccaatgctcctaaatattgaaggatttcatttttattgaacgcatcatcaagaacttcgacacccgttaccgtaaattttccttctgtcagtgtcccggttttgtccagcatgatcacatctagatcattggcttgctctagtgcgttacggtttttcaaaagcaatccgtttttagcggcgatcgatgtggaacgagcaacaactaatgggatagctaaacctagagcatggggacaggcgatgataaagacagtgaccatacgttccaatgcattaggaagatctgtcaagaacaaccatgcgataaatgccaagataccgacaattaaggcaatataaaacagccattttgccactttatctgataatgactctagcttggatttttctccttgtgcttttcgcaccatttccataaccttcgctagatacccattttcaccagttccagttacttcgatttcgatcgttccatccccattgatagaaccgccgatcactttatcattggctcgctttttgattccttttgattcgccagtcacagctgattcatcaacgatagtttcacctttcaagataacaccatctgttggcattttgtcaccggaacggacgatcaaatgatcgccttcggttacttcttttagtgagactgtctcttcttttccttctttcgtcaagcgtttcactgattctggcagtaattctgctagtttttgtaaagcattgctggcattcgaaacagcgttcatttcgatccagtgacctagcaacataatgacgatcaatgtagctaattcccagaagaaatccatgacgtgcgtatgaggattgatcagattcgcgataaacgaatagacactataaatatatgcaactgtaatccccatcgcgatcagcgtcatcatagcaggacttttttgtttcaattccatttttgccccgcttaaaaatggctgtccgccatagataaacagtatagttgctaagatcagtacgagccaatccgaaccaggaaatgttatctggaagggaaattccattcccatcattggtgaaaaaagaatgattgggatagctaggataagcgatagccaaaatttttgtttgaaattccccatgtgcatggaatgatccataccgccatgatcgtgatccatgtgcatcgaatggtccatttgtttgctgtccgctatatctccatggttatgttccatatgcatcgaatggtccatctggctatgatcatgcttcatctgtttttcgtttgaatgagcactttctttgtttcctgcttcttttttatgctcctgttttttctccatatcgttcccgttcatttttactccatcccttctcttactttttcatgtgccgatttaagctcagggagttcaacaatacactgacggaactaaacgccatcgctcctcctgcaatgattggattcaaaaagcctaatgcagcaaaaggaatgccaatcgtattatagacaaaagcccagaaaagattttgtttgatttttctcaatgtcattctagacaactcgattgtttgagcaatggacgccaaactactattcatcagcgttacatctgctgtttccatcgcgatgtccgttccacttcccattgccataccaacatcagctaatgcgagagctggcgcatcattgattccatcgcctgccataccgacttttttgccatctttctgcagtttttccacataggctgctttatcctctggaagtacttcggcaaagatgtgcattggatcaatccccacttgtttaccgatcgtttcggctgccagtttgttgtctcctgtcagcataaagacatctaatcctttatcctgtaactgcttgattgcttgtttggcttcttgtttgatttgatctgccacggcaatcagcccgatcacttgcttttcatcagctaaaaacatgactgtttttccctgctgttctaattctaacgcgtgttcttggtattcatcaaatgataggttcaattcaattaatcgtttacgtgtacccgcaaaacagcgtactccgttaatcgtaccgctgattccagcacctgggtgagctgtaaaatcaatcatatcgtatgttgctgcttcttgcagttttccgtattccacgattgctttacctagtggatgttcagaagcttgttctaaagtataaaaaatagataggacttctttagaaccgactagatctgtaactttgggctttccttctgtaatcgttccagttttatccaaaacaatgctgtctaagtgagcagctgcttctaatgcttctccgcctttaattaagattccgtttcgtgcgccaacacccgttcctaccatgatagctgttggagtcgctaaacctaatgcacatggacacgcaatgactaatacagagacgctatggatcaatgcaagttgccaatcacccgagatcaaacctgtcgccactagtgtgatgaatgcaatgactaaaacgatcggaacaaaaatccctgagattcgatccgcgattttttgaattggtgctttgcttccttgagcgtcttccaccatttggatgatttgagctaaaactgtctgcttaccaacttgtgtgactgccatgtgaagcagaccattcgtattgattgttccgccaaagagtgtgtcatctggattcttttctacaggaagactttcgccagtaagcatactttcatcgatcgcactacttcctgaaatgattcgaccatctgctgggatctgctcaccaggacggatgactagctgatcgccaacgacgacttcttcaatcgctaacttttcttctttaccgtttcttattacttgagctgtttttgtttgaagagacatcaattgtttgattgcattacctgttttcgtttttgctgtatgttccaaatatttgccgagcaaaatcaacgtgatgatcatactgctgctttcaaaataaagatcttggggatgtccacggaaaaatccgttgtaaatgctcaatgcaaaagcagctgatgttccgattgctactagtacatccatatttggtgctttcgtcttgattgcatgatacgcccctttataaaaacgagcaccaacataaaattggacaggtgtagacagaactaactgaacgattggcagatgaaaaaagtgaacaattgccgcatggctccccaacatcatggcaatcattgacagcatcaatggcaaagtcaaaatcgtactcaatacaagatcgaatagcatttttttcaaatatacttgcttttcttccgcaattttttgtttatgggcttcatcgtacaaaatcgcaccatagccgatattctctacgctttggattaatttttcagtggtcgtcccttcatatttgacacttgctttttcagtggccaagttgactgtggcattgacaacaccaggttgtccgttcagctctttttcgatcctagcagaacaatttgcacaagtcatacctgtaatgacgaatgtgtccattttggtttctgctgctgccatcaaatcacctctgctttatatcccaatccattgattgcttgacagatcttttcggattggacttttgtttcatcaaacttgactgtaccgtttgcttttttcaagttcacttttactttctgtacgccgtcaagtgcgcttaccgcttcttcgactcctgcaacacaatgattgcagctcataccttcgattgaaaattgttgtttcattttttcttcctcctattgatgttgtttacattcacattgacctgggatacagttgcattcgattgtttcgactggttgcttttgttctaattgtttcaagatttcattgatatcttcttgagtcaaagtagcttcttctactagatccgcaatcgtctctccaatcctttttgcacagatatgggaaaaaagattttccgtcgcactacgaactgtttccatctctgagacagctggatgataaatgaatttttttccttcttgttctgtccagatcacttctttttttaccaaacgtcccaacaaagttttgatcgttgctgatttccaatccatcgaatcagctaagatctgcgtgatttcttgagcagtcgtctgtccaagtgtccaaataacccgcatgatctcccattctgaatcgctgatttttaccggcgttttgactttctccacttatttcacacctttcgtttacaaatgtaatcaataacttatgaatacagattacacttgtaaacaaaaactgtcaattatttttgctctctattttcaatttagttaaaaattcttgtttttcccctcttgttttaaggatgatcagtttgtttcgtgcatggttttcttggatcagctgctgtattttcggttcattgttttcttcaaaatgccagataaaagataaaaattctacgtattccctatttagtttctctgtaaatgcttcaggcatatctggccgtgattttttgtttatctttctttttagagaacgcccaactactcggtagatggcgacataacgcggcactttaagccaaatgattttatctgcttctttgattctctcttctaacgtagaagtataatttccttcaacgatccatgacggattagataccataaacgtttgttgttcttgcaaaaaccactgttttgcctgaatactgtaatctgttgtatgccataaaaggtctagcggcagtagcggaaagcccgtgatttctttgatcttccttgcgagggtcgattttcccgacccactttgtccaatcacgatgatcttcattttcctccctcacttttctttgcaatttggttcgatcataccatttataacgccacaaaaaaacaagagttggctctacacgccaactcttgcaagaagtaattttattttaaggctgaaccacagtttctggctcagtgatttctttatttttgtctcgacgagcgatggccggcaagatcatgcctaataagatcaagacgattggtgtgatgatattcgtgaatagctggaaccaccatgctttaggatccgcagtgtaatctacttttggcaccattcctaagatacaggcgaacgcagtgaaggcaaagcaccaagcaccgaagataaacccgatttttggatttttgacaaatttatattcagaattgaatttcttataagctttattcaacatcatatacgccaagaatacccataggtaacgcattggcataacaactgagttcaagttcgtcaaccatttaactaattcattcatatctttgataccgaagattggcagcaaaataatgattcctactaggatacctgtcaaaagatagccgtttactaatgtacctttatgactacgtttacgtagccagtttggtacgaattctggatctgcatctgctaacaagatttttaacggtgcatcgattgaaaaggctaatgcggagatttgtccgatcatatttgtcaatgcgtaaataatcatcaatgagttaccgataccatagtaattacctaaaatttgaaaagcactgtatgccccatttgccatcaagtctttaggaatattatcgctagcaaacagcatgcccattgcgactgaacctaatacagcacaaatccctaccattgctgctaagaaaatcatccctttaggaaattcttttgcagggtttcttgtagagttgacataaggggatattttttccgctcctccaactgcaaatactaacatagagacggttgtgaaataactgaagtcaaaggttggaatatatgttttcacttgattcatatgcggtgtggcaaattccatcgttgggttgatgaacggcgccgttactgctaaaagaataaataagatcgacatgacgaacatcgctgttccggctaatccgccgatcactttcaacgtagaaagtccttttgttgataaatataaaaaggcaagaaatataataagtgaaataactgctaccatttggactgacatcgtatttacgatatttccgtttccttggaccgcccaaccccctgcaatcaggatggcttgaggtttttgtgccaaataaggaatatgcacgacccagtaagtccaagcagcataatatgccagccgtttattggatgtcgtattttcgacccatgaactgacgcctcctttactatccttgaaggctgagcctaattgtccaacgatcaatgcgtatggaatgaaataaatggctagaatcaatagccaagaggtgacaactgatactccttgctgggcatagttattaactacattccccatgccccaaaccatgttgaatgcaattaacgcaacagtgaaccagcgtaattgtttattgttcattcgttctctcctttataataaaaatttgttaaccaaatgtaatcatattcaatttttaacaaacttacaagacagcgttattttatgtgtgtattcttttatttaatacacatcattttttcatattttttccatcaaaaaaaggagttgttttcttcgatttcattgattttattttatttaaagcaattttgaattttctgcaaaattaaaaacatcagttattttataatcttagccattttctttgtattcttttattaagaaaaaggtataaaaaaagaggacgttcattcgtcctctctactggtcaatatttattttttacatgtaagcttcgcatggcattcaaaacagctaggactgttaccccgacatctgcaaatactgcatctcccattgttgcaaaaccaaaagcacctaaggcaagtaccaatatttttatcccaatagcaaaaacaatgttctgcttgacgatcttcaatgttttctttgctaaccggatcgcatctgcaatcttcgatggttgatcgttcatgatgactacatctgctgcttcaattgcagcatcgcttcctaacccacccattgcaatccctacatctgctcttgctagcactggtgcatcgttgattccatctccgacaaaggcggtctttttattgcttctttgtaagatttcctctaaccgctgtactttatcttctgggagtaattcactgtatatcttgtccacgccaacttgcttcccgatatgatcagcgatttttttcgaatcacctgtcaacatgactgtgtgcttgacaccagcctgttttagttgaaccaatgcgtctacggcatcttctttcaaggtatccgcaatgacaagataaccactataactttggtcgattgctatataaagcaatgtaccgatttcttgacttgaaggaaaagagatttcaaacctttccatcaatttgtgattacctactaatatttgtttgctgtcaacttcagctaagatcccttcacctgcaaattcttggatatttgttgccggtaaaagcggaccttcgtagccttctaaaacggattgcgcaatcggatgtgtagaaaactgttctgcacttgcaacatattgcataaatttctttggatcaattcctgttgaatcgatcgtctggatcgaaaagtcgcctttcgttaatgtgccagttttatcgaataccactgtctcagtttgtgcaagcaattccaaataatttgaaccttttattaatacaccaattttacttgctccgccgatcccaccaaagaaactaaggggtacggaaatcactaatgcacatggacatgagatcactaaaaacgtcaacgcccggtagatccattcagaaaacgccgctccagaaactattggaggtaaaacagccaataagacggccagccctacaacgactggtgtataatatcgcgcgaatttggtaatgaaattttcagcaggtgcttttttgctgctggcattttctactaattctaataatttactgatggtagaattttcataggatttttctacttgaactaaaaatggtttatttttattgataaatccacttaatactgtttcgccaacatatacagatttaggaacggattcacctgtaagtgcggatgtatcgactaatgattctccttcgatgatcgttccatctaacggtacacgttcaccaggcttaacaagtacatactgaccaatccgtacgtcttcaggattcacggtcatcaatccttctgctgtctgtatgtgcgctgtttctggacggatagccatcagttcacgaatcgattttcttgaatgattgactgccaatccttggaaatattcgccgatttgataaaatagcatcactgctacggcttctggatattcaccgatcaacatagcgccgattgtagcaacagacatgaggaaattttcatcaaagatttgtcctttgacgatattcatcaccgcttttttcactacatcatatcctatcagcagataaatcaataaataccctatcaaacgaactggttcattaaaatcaaataatagcaagacagcgatacctgcaagtgaaaataaaatccggatcagcgtgtttctctctttttcatttccatgttcagatactttttccttgtctatttctgttaccttgacatctggttctaattccctcactacttttttcgtttcctgttcaacctcagctaatcgatcttcctctacgtcaatcgttagttttccagaagtgaaatttaccgttgcttccttgactccatcgatttgctggactcctttttcgattttcatcgcacagttcgcacagtctaaaccttctaatctgtaacttttcattttaatgacctcctcgccttaacatatgaatatctcttcataactaattataaatgaatgtacattcatatgtcaaggtatccgaaagaaaaaatgagttttcaaaacataaaaagaaccagatcaaacacgtgatagttgtgtttcatccagttctctcgttcataaaacatgtttaggacactcttttagaacatcctgacttatataatctctgcaccaaatggcatcaacgccaatcgagcaagtttgaaagattgctttgcaaatggtatccctataatcgtgatacatagaaggatgccgctgacgacatgtccaagagcaattgggagacctgaaacgatcagccagatgatgttgacaatcaatgacatgccggactggtggtaaattacttctttgccaaaaggcgcaaaagaaagggaggcgattttaaaacactgcataccgatagggataccaatgatcgtgatacaccaaagtacccctgctgctaaccagctaagacccccaattagtccgccaaatatgaaccagatgacatttcctaaacaactcattgtatttctccttttattactgtttttaattagaactagaactggacaaaaaacgatttgatttttcgttttttagcttccagcatcaagtattccgcaaatcttttttggatttcttccgttttttcttttgttactaatgtgtgttggattagttttcctgctggtcgctgatccacccgttcttctgattgctgttcatctgcttgcgcaaaaccgatgatccggttttcttttgttacagcaacgatcaatagtttattcctatcatgtagttcagctgccgtttttacttttacgaatgattctggatgatcagtaatcagctgattgatttgagggagatcttcttttactgcccttcgtatttccatcatttctcccttttctttcgttcatttttatttccactaaaaaaatcaactgcggaaatcgcatctatccaactttgtgcaataatctcgtgtccgccaatcgttggatgcacgccatcttcttttgtatatttcgaaaaaccataagcgattcctaaagcattgaatatcccatctaaaggaatcagcaatgtgccatattcttttgcgagtttacgaacggtttggatcttagggtctaagtctttgcgccacccataacgatcatttgtcacaggaagtacaaaaggctccattaagacgatattgcagattccagctgcttgaagttcatttagtaactctcgataaacggattcaaattgctgcacagatttctcagtgccgaatatagcttgatctccagtattatgccacgtatcattgattccaatcaaaatcgatacataatcaggttgcagagctaaacaatctttttgccagcgtgcttgcagatctgcaattttgtctcctcctatcccacggtttatacattcaaattccatcgttggatattgtgagattagtttcccggcaatcaaaagcggataccctttacctagatccgttgcttctgaacggtctcttcctgcatctgtaatgctgtcaccaataaataacacacgtgttttcatttgtcaaaaactcctttttgaataaaacgacgattttcttctttatattatcccataagctctaccaagacgaaagcgaaaatagatgtataaaaaaagacacccgcctagtttcctcaaacgattggatgaatactcagcaagtgcctagttttttatgcttttttcttaacgtgccggatttttcttgattccttcgttgtttgattcagtgaaatcgatcagacctaagtttccgtcaatcagcccactgtcgcccgtcaaactcaaaatatgacgagaagcatcaaaacgtatattcatatgctcatctaagtctgccaacgaatatccctttactaatatctctcctagattgcttgggatagattggtcataactttctgtcgacatatctgatccgatgattccaagggtgaattgaacttgcatgtggatcattgcatgctgagaatacggacctactccatcttcgaatgttaatattagtttgtttccaggtgctagatgctgctttatttcagcagcagaagcatcatcaaatcgaatttccatttgaatcgccttctttgtatatgtttgattgatcgcgatttcattatagaaccttgtgaatcaaatagcaatttcttttgctctcttctcttgtctgttggaaacttcctttatcccgtattttaaaaaagaactgcgagagctcgcagttcttttttagaataaacggtgttcaatcagctgaccctcgatattagctcaaaaaacggtaaaatatgagaagctatttttccgttttgtttctctaatactcaggtcaaagcactgatttcacaacctcttccttaaacggtgttcaaaagccagtttctcggtattaagccaaatttatgcaaaaatgtggaaagccattttcacaaaatttttcttaatactcgaaactaaacagctttttcatcacttcttatggataaattcggttcaacaaacgtgggaatggaatagcttcacgcacatggtcgataccagcaatccaagtgactgttcgttcaagacctagaccaaagccagagtgcggaacagaaccgtatttacgtaaatcaaggtaccatgaatattctttttcatccaaaccgtgattacggatttgttctaacaagaaatcatagtccgttgcccgttcgcttccgccaatgatttcaccgtagccttctggtgcgatcatatctgcacagatcaccacgtcttctcttgttggatgtggtttcatgtagaatggcttgatggcttttggatagtttagaataaagacaggttgttcgaatgaatttgcaatgaacgtttcatgaggtgaaccaaaatcttcgccccattcgatgtcatcaaatccatttttcttcagtaattcgattgcatcatcgtaagtaatacgagggaatggcaattttgtataagtttttaagacttctttgtctcgtcctagtacatccaatgcgtattcgcaatgatctaaaacattttgtactaagaaggctacatattgctcctgtacttctaaactttcttcttggtgagtgaaggccatttctggttcgatcatccagaattcaatcaagtgacggcgtgtctttgatttttcagcacggaaagtcggaccgaatgaaaagacttttccgaaagccatagcagcagcttccatatataattggccactttgagataaataggctttttgatcaaagtagtttgtttcgaatagatccgttgtgccttctggtgctgaaccagtcaagattggcggatcgattttgacaaaatgatgttgattaaagaattcatacgttgcacgaatgatttcatttctgatttgcatgatcgcatgttgtcttgaagaacgtagccataaatgacgatgatccatcaagaaatctgttccgtgttcttttggtgtgatcggataatcgtggctctcgcttactacttccacatttgtaatcccgatttcataaccgaattttgaacggctgtcttcacggatttctccagttactagcacggatgtttcttggtgcagatttttagctgtttggaaaacttcttctggcacttcgctttttaccactaccccttggaagaaggctgttccgtcccttaattgtaaaaaggcaatttttccgcttgatcgtttatttgcgacccaagcgccgattgttactgtttctcccacatggtttttcgaatcgatgatttgaatttgttccacgtatgactctccttttatattccttgaatttcttcaggattaattttgacttttactctcaataaattgcttgattctgcgtaccgcttcttctaacgtagcacgatcagtcgcataactcatgcggacattttctggtgccccaaagccttcgccagtcacaagtgctacccctgtttcttctaaaagatcttctacccattgtgtgacattctcatacttacacatgcgtagcgtttcttttacattaggaaaaagataaaaagctccttgcggcttttcaagagaaacacctggcagttctgccacaagcggatataacgtattcaggcgttcttcaaaggcgttccgcatttcttccactgtatcttgctcgcctttcaatgcttcaacagctgcatattgactgactgctgtcggattgctagttgattgggaagcaacagcgatcattccattgataatttcaggattcccaaccgcataaccgatgcgccagcctgtcatcgcataggtcttagacacgccattgatgatgatggtctgatttttgattgcttctgaaatcgttgcaattggagtaaactcattgccattataaactaaacgaccataaatatcatcagcaactatcaaaatatcattttttactgcccattcaccaattgcctgcagttcattcttgctataaatcattccagtcggattcgatggcgaattgatgatcacggcttttgtttttcctgaacgtgcttgttctaactgttcaacagtaactttccagttattagattctttccctttcacaaagacaggaagaccttctgccagtttcacttgctcgccgtaactgacccaataaggcacaggaatgatgacttcatcttgcgggtccaagattgtttgaaaaagtgtatacaaagcaaatttcgcgccatctgttacgaccgtttgtgaagattcatagacaagtccatcatttttcttcagataatcaacgatcgcctgccgaagttctgggattcctgctgttggtgtataatagctagcttttccgttgcggattgcttcgattgctgcttcttggatgttttctggtgtcgcaaaatccggttctcccacagtcaaactcagcacatctcttccttttgcttttaacgccttggcttttgccgcagctgccaaagtaacagatggttctaatcgtttcgttctttttgataactccatcccattcattcctttatctattaaattcccttgattgtcttgacttcatctcctgattcaaaatcaatcaggtaataattcaattttccatttgtttcttttcctactacttcccatacaggctgatcatcgtacattcctaaagctgctttttcgatttggatttcaggatgagctgcagcaattgtttgtttcgcttcgttttcagtcaatcccttcgtttgatccaatacttttactttttcaccagatttaggaatgataacggcgatttcttttcctttatcattcgtacccgtcaatgaaaagtacgttttctttcgagtaaaccagtaaaaatgatcggcttcctcgagatttgcatatttctttgcgatttctactgcttcttttttcgcctggaccgccggacgactggaacgcaagtaaaaaatcgagctgatcacgatgaccgctaataaaaatacgatcaagccaagcaatacgcgattaatcgttttttcctttgtctgttttttcttcaagggtcgtcgctcctttatcttcattccttttcattatagcagattttaatgatgaaaaaagacggcacctttaacttccttcttcatttttctttaagaattcatggatatcctgatagatttcatccatagctagctcttttatcggtacttttttcggtaatgcatggatgattcgtgcaccatattttgcagtgactaatctccgatccaaaataagtaatacgccacgatctttctccgtccttatcaaacgacctaatgcttgacgtaacttcaaagctgctttaggcacggattcctgataaaaaggattgatcccctctgattccagataagcattcctagctttgaccatcggacgtaacgggttgtcgaagggtaaacgtgtgaccacaacaatctgtaaagcatctccaggtaaatctacaccttcccaaaagctgtcagcaccaaataagacgcttttttctgacaaaatgaagcgtttcaaaagtttttcccgacttccgccaaatccttgagcaagaatttcacgtcctttttctagcatagacaaatgcattttctgatataccttttgcaaaacatcatgagaagtgaataaaacaaggatcggccgatcttcttgttcaatcaatcctgtgagtgctgcttctaaataatcgatatatgcttgattgctgacttgatggactgcaggtgcttctttcggcacatagattcttgcctgtttctcgtaatcataaggagaagcaatcactttaagaggtgctgcttcaatgccaagtcgtttagagagatactgtcgattaggtccgatcttcagtgttcctccaatataaagaatatggtcatatcgaggataccacacagttgacggcaacatagctgcttgaaaatcatggagatgaaaaatcatctgctgtgctgtattcccgggaacgaaccaatggatcaaatgatctcgccagtcttctagccattggtccatcagcaagtattgcttgtctaattgatcaaataagctatataaacttgctaaatcgatccgcatctggttggtccaactttcttggataatctcaaaagtcaagcgcatctgtgattgtagttgttggatctcttgataaaaaagttgcagatgatccattgctgttccagattccagtggcagctgatccaacatttcttttgtcatcatgacttcttctggatattgtccgttaggctgcttgctgcttactaagttcattaatccctctgccacacaaatctgcgcttcgcatagtgcagagagttcttctcgataaatcgacaaccagcgcaaggcttcatgttccttcggcaaataactttgtatgcggtcaaataactgattcggctcttccagttgttggatttgtttatggaagtagttaatacttagtcgtttgtcatttactttttcagcaatttccggcaaatgatgcacttcatcaatcaacaaataaggactagctggaagcaatggttcttttcgctgtgtttcttgtactaaaaatgcatggttgacaatcaaaaaattgctttgtttgattttcttttgcaagaagcgcacaaagtcttgtttgtaaaacgactgattccttgctaaaaacccagtgcctctgtgcgcgacatctgcaaagaatgcatggttcagattggttaaatgtaattcatccaaatcaccggtcttcgtttgtgttagccaaactaagacagccatttggtacaaagcatattgtttttgtcccggcggttccacaagtgtacctttaaaacgctgtaaatcaatatagtggcgatagcttttgataatcacaggttgtatcggctgatctagcaattgattcagtaatggaatgtctttttccatgatctgctgctgcaaaacaagcgaaacggtgctgatgacagctggtttttcaggtgtagccaaataactcaaaggcaacagataaccaatcgttttgcccattcctgtagctgcttcgatcatcaaatcttttgattcatcttttgtgaaatggtcgtagacagcattcatcagcctgttctgttcttttcgatacatcagtgttttaccaaacattttttcttttgcttgtttttttcttggatatgtccgctcgccataatggacggatgtgaatagctccacttcttttttctgcaaagctagcccatcgacaatttctaatgagagatcaaggggctccgggttttctttcatttcttcaagcacgtggtaaatgaaacgactcgtatccattcctgtatggctacttaatcgtgcaatctgctctaatgtgatgatcggcaatttcctcattcgttcttcgatcagtaaaagaagctgacctgtcacttcggcatcactatccgcctgatgaggattctcatgaataaagccaaggctttctgacaaatcagctaagcgaaaacttggttccgtcggcaagaaaatttgtgcaagttctacggtatcgatgcccggcatcttcaaactaggaagtccgcatcgcatgagttcatggttcaaaaaattataatcaaaataaatattatgcgcgacaaatatggtgtctgccaaaagattgtaaatcgtttgggcgacatcttcaaaataaggcgctttttggacgcgttgattcgtgatccctgttaaatgctggatttgttttgaaatcttccgccctggatgaatatcgatcgaaaaacgtgaagtgatccgaccagcttcaatcatgacgcagccaaattggatgatccgatcttcttttggattcgtcccagtcgtctcgatatcaacgactgcataagttcttggtttcaaaatatcttcctcttctcctacctctaatgttcttttgaaattatactacaaagtgcagaaaaatactctcatcgctttttaaggaaaaaaagacaaaaaagcccagacacataaatgtctggacttttatttttaatataggtaaattaagctttagtaacgtttgttgcttgaggtccgcgttgaccttcttcaacgtcgaaagttactgcttggccttcttctaaagttttgaatccgtcgccttggatagctgagaaatgaacgaatacatcgtttccgttttctgcagtgatgaatccaaatcctttttctgagttaaaccattttactgtacctgtttccataataaaaatcctccttgtgtttcaacacatattttgcaattacttgaatggtgtatatctggaagatgtttatttgaaacaagctaccacagattaccgaacaaaaactactcctacagtatatcataccgtttacaaaagcgctagagtttttcgatatttttttataaaaaaatgttttctcagcgattacatcaagtgaaaaaccgaactttcttaatgacaaatgttttattgttcagatacccctctttcgatcctttgcacctctttaaactaaaaaaattattctgtctgactatttattgtttctgtttcaacggttgaggatggggaagactctttagtaggtctgatgttctcatggtatttctgatagcctatgacagtgaccagaagaacaaggcaaaccaatacgatcaacgagattaatttttcttttttgttcatacctatacctcataaatgacaggatgatgcccatcatatttctgagcatgggtaacagcaaaagctgcagctgttgaatggaagaaatgccaacaactttcgtaatcacatgacggacaataccaaaaataaccaaaccttggctgcaaagcccgttcttctgtttcagggaacgcagaatcaaacgctgatgtctgcgcataaatatttttgtacatacgtgcgcctgtgcttagagaacgctgtgtttcttctgcaaaaactggttgacttgttaaacttagggatagagacagcaaacaccataacagtctttttttcataaagacctccttatcgataagtttttcccaattaaaatcatatctcaagaacgaccgttatttgcatttcattcataaatggtgttttttgtatcataatcgtcaaaaaagaggtcgtgacgatgtcacgacctcttgataaacgatgttccagaagtaacttcttcggaaataagccgaaatttcacaaaaatttgagaaataattttcgtaaatctcttcttatttcttgatgcagaacagctttttctctctaatactcaggtcaaaacactgatttcacaacctcttttaataacgaagaatcgctgtcagactcttttcatctggcgcatctttttgatccaaaataaacactttcccaccattaataatcacatcgtttgccaaagcattcagcacttgacgccgatcatattctgtttcaggatcttctccgaaaccatcagctaagtttgacgtagcgataaacaaatgggatacttttccttctttcgcagctggaacgatatcaactaactgatcaatgaatttcttatctaaaagtttattgtactcttttgattcttgggctgctagttcacttgacagcttcttcgctccttcttcgatatctctaaaggatagttgtgctggagaagcagaaatcgcaacgtctgcacaatagtaaggatttttggcgatttttttgaacatcgtctgattttctggtagagcgaataaataaatcggccattgttcaggattttcgaaagaatccttcaagtacgtatcaactgcttggtaatagttgacccaatcgatctccacttcttcatcttttggattcacgccatggaaagtcacgccatctcgggcaccgccccctccattagaagagaagttcaaaccgccacctgtcagttcagatcccaatgcagtaacgacatcaaccggtgccccttctggtagagatacttcttttacttgtttgttgctgacttcatacaatttcatggagtcgcggttcaatcccaacagataataggaatagttgaactgtccatttttgataatggccagtaaataaggaagatcacttacataatattgatcgtctaccgggatactcaaacgatggatataggtttgatcagcagttataatgaccgctacactcgtagttgcactacgccagaacgaaggatctcctaacaaattttcaattttttcttggaacggggaccagtcatgctcggaatattttttttcaaaacgtttctttgcttcttttgcaaaatttttgaatttgatttgatctttttccacatcttgatgtgcgacatgcgtattcagcatgatcgtgacgaacggtcctttagcgccttctgaagtcaattgtgacaatagttctttatccttttttgccataaacgtacccctcctaaaaaaatcattcctttgtgtctatctaaagtctaccacaacactatttttccatacaataaaacgtatctaaaaaaataaaacggtttctttagttgggtattttgcaatttttttaagttatcttcataatttcctcaattatttaggcacagtcttcaactattcttcatgaaaggctgttagactaagaaaaagaataaaagaggtggaccttatgcatttgattatgatttttagtttattaagtatcatcagcttatttgctttcagcgcttctcgcttattagaggcggaaacacagcctgttcctgtaaaagtacggaaaaatgaccgctaaccttttcataacgcgcgttcttatcctaaagtttttttcagaaacattgaaactctcttccctctctgataaaattttaatttgtagcgaaacaaattaaatacaaggagatcggatatgtccataaaaaaaacacgtctagtcctattattggctagtctcattctttgccttgcttcttttctaccagctgttgctgtgcaagctgaagatactttcaaagtaaatgcaaaagcagcctttgctgtagatgcgcaaagcggtaagattctttatgatcaagatggagaaaaaaccatggggatcgcttcaatcacaaaaatcatcggtctttacatcgtccttgatcaagtaaaagaagggaaactatcatgggatgataaagtttcaatttcagattatgcagaaaatttgagtatcaccccagatttatcaaatgttcctttgcataaagaaaacacctacaccgttaaagaattattcgactctgcaatcatccagtcagccaacgcttcaatggttgccttggcagaaaaaatctctggcagcgaagcgaaattcactgaacgaatgaaagaacaattgaaagattggggaatcaaagatgcaacgatcgttaatgcatcaggactgaataactcttatcttggcgaaaaccgaccagaaggtactggagaaaacgacgaaaatcaaatgtctgctcaagatgtggctatcgtggcccgtcatttgatcttggattttccagaaatactggacgtatctagcactacgacacaaatgtttggcgaaaacacgcaatcacccgtggaaatggtcaactggaactggatgctcccaggattcgtgaattataaagaaggtgtagacggattaaaaactggtacgactgagcttgcaggtgcctgtttcgtcggtacgatcactaaaaacgatcaacggatcatcactgtcgtattgaatgcagacggccatgcggaaaacccaagtgcccgcttcaatgaaacagcccgcttgatggactactgctacgacaattggtcagaaaaagagcttggaaaagccaacgcaagtatccctagtctaaaaaccattgatgtaaaagacggaaaagaatcaacagtgcccgttgtgcttaaaagtcctgtaaaagtatgggtacggaacgatatggatactggaaaattaacaatcacaccaactcttgacaaaaagcaagtcactgacaatgagatccaagcacctatggataaaggaacaaaaatcggtaccgcaacgatcaccttggcagaggataaattaggttatctagaagacaacaacgcgccatccacagaaatcatcacggataaaaccgtagaaaaagcaaatattttcgttattggctggcgacgtgtcgcagaatttttcggcaacttgttttaattgaacaaaaagaaaaaagcatctttccgtatggaagatgtttttttgctttttctagtttaaataacagcttttttcatctattttcgttatactgtataagaaaaaggagttgaatttatgaatctaaccagagatctgatttttttggttctctatcttattggggtattctccatcgtttattggcgaaaacagaaaaaggatccttccttgttcttttacagcagtacatggacatttgcggtaatcttgacttattttgtcgtgttggaaattttttattcgaccttttattttttgattcccttagtgtttttcagtatctttgccttttcctatttttcagaaaagcgaaggctgctgaatggtcttttattcaatgttttcctcattagtttcggtatctacttgtttgtcttgctatacgaaacacaaaatatttttcttggcggactgattgccttgatcacgatcccgttactgcttgtctttctattcggcatttatggattgatcgtttttcttttttggaacggtgtcacagttttacgtagagagtcacattcattagctaatcttttaacgttgatactagccatttttcttacattgtttcttatttttgactttttcttgttaaaatatttgccgcaatggataaatgctttgtttttctgcattccattgatcttgatctatctatttatcgtattctacaactttttgactgtctcattcttgtatcagttcaaccgccctcgatacaatcaagacttcatcgttgtgttaggcgctgggttgatcaatggagaaacagtttctcctcttcttgccaagcgaatcaataaggcgattgctttttattgggcacaaagccgtgcaacattaaatccgcctatcttattaatgtcgggtggacagggagcagacgaaaaagtaccagaagcaattgcgatgaaacaatatgccatggaacaaggaattcctgaaagagatattcttgtcgaaaccaattcgacaaccactttggagaatatgcgctattcaaaggaaatcatggatcagcaaatgaaaggtccttatcgcgcgatcttcagttccaacaattaccacattttcagagctggtctctatgcacgacaagcgaaactgaaggcaaatggtattggggcaaaaacagctttctattacttgcctaacgcgtttttaagagaatacatcgccatcttgatgatgaacaaaaaaagacatatgatcatttgcggattgcttttcgcaggttccgcattcttatcactgatcactttacttttctaaaaaacaaggtgtgacaaaatatatgtcacaccttgtttttttcttttattctcttgacgattggcaagaatagtattccttttttgacggctacttgctgtgcagaataaataccgctgttccctgaacacataaagctgatcaagcagatcataaagaagtaaacagcagcttgtgaaccaaataattcgattcccatcacaaaacaggcaatcggtgtatttgtcgcaccagaaaataccccgataaaacccaatccagcaagaaaaggaacagaaacttggagcaaaggtgctagtgctgcgccaagcgttgcaccaatctcaaacagtggtgtcacttctcccccttggtaccccgcacctaaagacaagactgtgaagaataatttcccaataaaatcataagcatgtgcctgtccattaaatgattcctgcagtaacggaagactcaacccaaggtaacgttgtgtttgcaaaatcaacgctgcggctacaactactgctccacctatcgtatttcgccaaacaggatgaggaatccattgcgcataccgcgcttttaaaaagacgatcgaacggctgaatacccaaccaatcaaaccaaaagcaatcccagcaacaaaaactttgaagaacagcaacatactccattcaggaatcacacccatttggtaatgtagatgagaaacaccatagctttccgtcatgaaatttgcaaaaagcgcagcaaagaagctagggaagattgcttctgttcggactttcccgattgccaacacttctaatccaaacaatgttccggctaaaggtgtgccaaatacagaactgaaaccggcactgatcccgctgataatcaaaatctcccgttctgctttatccaatcggaataaacgcgctatattatcagctaacgctccccccatttggactgctgttccttcacggccaacagatcccccaaataaatgggtagtgatggtcccaaacaaggtcaatggaatgagccgcaaagggatcttttcttctcctccattcccttgatcgatcactaagttattcccacgactagaaagaccgccatgatacgcataaagataagcaaaaagcgcgccgctgactggcaatagataaagtagccaaggatgtgctagtcggatatctgtcacgaacgtcaggctatttaagaaaaaagcagacaagctccccatgaatactccgagaatcgctgtgatcatcagccacttcagcatgtacatcaaaatacgcactggactcggtaattgtttttccataaaaaattcctcctcaataaaaaaacgcctactaaagaaaggggctgtccccagactttagtaggcgtcattagctatcttacgttagcatttaaaggcgaacaccatcacctattcacttccattaaaagatagcatatttttctgtaaaaaacaataaaattatcgttctttctttacacgttcagcaaattcatagaaaggagccaatttcgtcaactgttgattacattggtcactatcatgacaaatataattcccctttttcgtatacgtgccatcagaacctgctttcgttgtagaaagaaaaagcgaaacattcgatgttttctgacagattgcacagattcccttatttatcgttggtgataaagtaccgctgatcccttttaatttttcatcttcgtaatagaccatgaattttttttgcgtccctggatcattccaaccgatgtacgtatgtgcttgcaagtcgatttcattccaagctggttgtttgagttttttcacttttcggaataatttatcgatttgtggtttgctcggctgcataaacggctggacgatttgcttcagctcctccaatgctcgttctgcttgcgtttttgtcagttttacatctaaaactgtcgttaaaaacgtatcgatttctggtggttcgtaacctaatacatcgcgaatcttttcagctgctagagcctgaaccgtttgtaccgtttttgggtcattgacagatgagtacgcatttaataactgatcaacttctctttttataaaaaaatattgatatggtttcattgtttgttccatgattttaaagtcctttcttctaaccaaagagcatactttgtagaaaaaagtgatcttctgcaaagtatgtgttacctgaagatcccggactcttttaaataagatacgttttgcatcttatcatcaccccctttaatgtttattcttctatgtacatgattcattcgataaataaaagtaaaccgtatcttgaccagatagtcaactgcaaacagaaaaaaccgagaaaatcggctagattttctcggaatatgggctattattggttttactttttaaatcgaggattcttttccaaagtaacgttgccatctcttacgcatacttgctgacataggctgagcggcttctttgactgcgcagtatttgtctacgaatgttacgatatatccttctttgtacttaggcggtgcaatcgttgcgccccacatgtgcttcaaaatgatatctcgctcaagatccgacaattcggtgatcttttctgcattctttacagcgattcttggatggatatacgcatgtgtaccttcatcgaatttcgtcgtacgccaatcatagtagaacagatcatgcaaaagtccagcacgcgctgttgctttagcattgccaccccatttttttgcgagcagataactatagtaagaaacactgatggaatgctccaaacgagtggaatgaacatgctgtgtgtaattcgctaattttttcactgcttctgtttctaaaagatcttctacataagacatatattcttcgtcttcacgccatttttctgtcataattatcgatctgccacctttttgaatttcattttcttctgaaattgatctaagtataccaccagtgttcggattattctagtcgccttggataaaatagccaaagcttaatagttccttaatcataaagaaaaatgataaagaacaatccctgccgcaaccccaacattcaacgattccgcatttcctttcatcgggatatatacgttctggtcagtcagagacaagatttcctgacttaccccctgaccttcattccccatgattattgcgaagttatctgatttttctactttgtctaatgcgtgtgcttcttcatttaattctgtgccatacactgtgaaccctttgtctttcattaaagggatcacttctgtcaaatcttgttgcaacacaggcaaatgataattgcttccctgcatgctccgcagcacctttgtactataaatatctgccgttcctttacctaataaaacaccagccataccaaacgcatctgccgtacggatcatcgttcccacatttccaggatcctgtacattatctagtaaaagccagcctcctgaaaaatctggcgtatcttcagatgttaacgtcatcactgctaagatcccttgcggtgtaggtagatctgacatagcggtcatgacctcatctgaaactagaaaagtagaaatctctttgtttacagccagccagtctccccattctttcatacctctctgtgtcacaaaaagttcttttatttctgcatcagacgacgcagcttcttcgatcagatggaacccttccaaaagatattctttcttttcttcccgatatttttttttatgtagtttttttaattctttgattcttggattttttgctgattggatctctttcacattcctcacctccccatgattatatcacggaataggtgcttgagcttgtttcatcctaaaaaaatcggtatcattaatttataaaataggaaagaaaggtgacgaacatgcgcaaagttaaaatgaacgtccaaggacgcgtccaaggcgtaggatttcgctacatgaccaagatggtcgctgatcaactaggcgtgactggaacggtaaaaaacgaagacgacggctcagtcacgatcgaagcaatcggcaatgacgacatcatccagaaatttattgaagaagtcaagaaatcaccgagcccaagtggacgagtgcagtatgtggatgtccaggaagacccgatgattgaggaacgaaagaaatttgatgtggtgggataaggttgtgaaaaagctggtctgcatcaagcattaaggacaggttgtgaaaaatagctctccatatttttcaacaggctggacttaatgccgtagatgaaagcttttgaacaccgtcaataaggttgtttttgaggcgctttgcctcgagtattaaggagaaacattttcaaaatagcttctcatattttgaaatgtaatgacttaataccgagaggcagctgataaaacaccgtcgataaggttgtttttgaggcgctttgcctcgagtattaaggacagcagtgaaaaagctgatctatcacttgcagtgagttcatttgtctccgcttttcgggcagaataaaaaagtttttagtttattagaataagaaagaaacacttggaatcattctactttttcctagtatttctttcttgattttttgtctttttttcaaaattttccgctacgtaaaagaacgaatatttatatgaaatttctatgaagttgattgaattccatgcgcttttttagtatagttaagtttgtgtaaaaattatagaagaggaagtattctatgaataaatggaaaaactggttattgggatccggacttgtcagtatcctgctctttttatctggctgtgtgcggatggattcaaacggaaaccctgacacttcaggaatcgtttatcgagtactcgtccatcctatgggccaagcgattacatatctagttgagaatttcaattggtcttacggctgggcagttattgcaatgactgtgatcgttcgtatcatcatcttgccactaggtatcagtcaatcgaaaaaaacaatgatccaatctgaaaaaatgcaagcgttaaaaccacaagttgaagcagcccaacaaaaattgaaagctgcaacaacacgtgaagaacaaatggcagcacaagcagaaatgcagcaagtataccgcgaaaacggattgagtatgaccggcggaatcggctgtctgcctctattgatccaaatgccgatcttctctgccttgtactttacggcacgctacacagaaggtattcgggaatcatctttctacggcatcgatctaggctcaccaagtatggtgcttgttgccattgcaggggtcgcttatctgcttcaaggatatatctcaacgatcggtattcctgaagaacagaaaaagacgatgcgtacgatgctgatcgtctctcctgctatgatcgtcttcatgtcgatcagtgcgccagccggtgttacactttactgggtagtcggtggtgtgttcagctgtctgcaaacattcatcacaaacgttatgatgaaaccacgtttgaaagcacaagtggcagaagagttgaaacaaaacccgccaaaacaagtcgtcactccaagaaaagatgtgacagaatcagctaaaccagctgacagcaaacaagcaaccaaacaaatcaagcaacccaaaaacagtacaaacaacaaaggccgcaatgcaggaaagcagcagaagcggaagtaggcgggaagcaaatggagaaagaaacctcgcaccactatcaattgatagtggtgcgaggtttctttctcagtccctactaaatatgtctctcgtataaactttttcttttacttcagctaaagctggctccatacgatttgatacaatcacatctgacatattcttgaattcttcgaaatctttgattacccgtgaatgataaaatgcttcttcatctagtgttggttcataaactacgacttcgatcccttttgctttgatacgtttcattacgccttggatagatgaataccgaaagttgtcagaatttgccttcattgttaaccgatagattcctacagttttaggttttttcgctaaaatttgttctgcaataaaatcttttcttgtcgtatttgcgtctacaattgcactaatgatattgcttggaacattttcatagtttgctcttagctgctttgtatctttaggtaaacaatatcctccgtaaccaaatgagggattattgtagtgagagccaattcgaggatctaaccctacaccctcaatgatttgttttgtgttcaatcctcgagattcggcataagtatctaactcattaaaatatgctacgcgtaaagcaagataagtgtttgaaaacaatttgattgcttcagcttcagtaggatgtgtcaaaagaactggcacatctttatctaaagcgttccgttcaaacatatccgctatttcttgccctctatcagaacactctcctacaacaattcgagaaggatgcaagttatcatacaatgccttcccttctcttaaaaactctggagaaaaaataatattctctgttttaaattttgcttttaattctaatgtatatcccacaggaacagttgacttaataataaaggttgcatctggtcgaatgatcagggctttttcaataacgtcttcaactgtggaagtattaaagtaatttttcttttcatcgtaatctgtcggtgtagcgatgatcaagtaatcaccaaaaagtacagcttcctcgaaatctttagtaaattccacatttaaatcatcccgctcgagaaactcgtgaacttctttatcctctaaaggtgattgtctgtttcttagcatatcgatcttttcttcaacgatatcatatgctttaacattttcatgctggctaagtaataaagcgttggctaggccaacgtatcctaagccgaaaactgatatttccataatcaagttcctaccttttttttaaatttatcactgactgccataaagggattccttcataaactatcaaactaaaacatagtaaaacatttaatactatattatctataaaaaaaatgaaaactacttgcaaaatcaacccacttatagaaatacataggcgtttaagttgaatatttattttaaaaaatttatttatatctctaactcgtagtatccagattaataaaaaactaatcaaagtagatagtccagcaccaattattccaaaatacctaattaggataaagtttaaaattaagctgaccataccaccaattacagaagtatacataacgcctgtagtttttttttctgcaatataaaaggttccaaaaaaactggaaaagctcgagaatattaaaccaattaacaaaaatggaactggtttccatgacaatgaataattaccggacatagtaatattaattattggcttcaaaaataaaattaatattgaagtacaaataatcataattgttgataaccaataaaaaattgatgaatagaattcccgcttgttatcagaatcatattcctcaatagcagataattgccaagcctgaaaaaaaactgtttgaaccattgataatatacttggtattttagatgctactgcaaataatccatttgcagtagcatctaagtaaaataaaataaaatatctgctagatgcattcattagccaccacataaatgcgttgggtataagtggaacactgtaaactaacattcttttaaacaatttccaatctactttagattttacaatcaaaataaaatcaaactttaaaactattatcataaaaaaaagtgatacgagattagacataatgatagacaataaatacccatcaactccaaaacttaaaaactttaaaaaaattatgtttgaaatcgcaagaactagtgacattattattccatttatagcatagattttgattttattaattgcgcgaacatactgggctagtatattttgaaatccctgtaatacaataattattattataaattcagaatacggtatttttatttttaaattaattatggtaattgctaaaatgaacacaatagatgctaaaaaaagtaataaaaaactattttttaaagttaaatattgtctattttcatcttcacctattgtaaatcttaaggttgcttcataaatacttaaggtcacaataggtaaaagcatattaatcgtcgtggtaactaaatcagcagttccatactcacttgtagtaagttggaatgtataaaaaggcactaacaatagcaataaaatcttactaccaaaatttcccactgcaaagattagagaattcgatattagtcttttatatttattcattatttagttcctcagcgactttatttaataggcggaaatcaatttgcgttttttcttcaattatttcctgcgcaaatccaaaattacttttttcaactattgctaattgcttatttaaaattgcaattatctcgtctgtcttctctccaaatgttttgatatcaaaaactgaattttcattatcaattattttaaatatctctgagactttaggttgccaagatatccctataactggtatatcttgagatatagctacaatcattgaatgcattctagttccaataataatatctaaatctttataaagatctattaattgtttcttactccctacaaacatatattctatattaagcttacaatcagacaaaattttttttaaaataggcacagcatcgaaatctctaatttccgaattaaaaacaattatctggctttcaggatgtgctactttgatttttagtattaacttttttgtgtcttgtaggtatttgtaatagtcacttttagttgccttattcaaagtgtagtctattatgcaaataccaatacatggaataagattttttttatcattacagaactgtttcttcaaagaaaatactgggtcgatgccaagttctacattttttaaatcactaattaagttataggaaccttgatctcgaaccgttatataatctgctaatttcaaaacttctcgtgttttaataacttgttttttagtagcaaatggtccaatacctacatccataaatattatttttttattatatttttttgcagcatttatgattacttcaaactttccagcagaatcaccaaatctagtcaagtcaaaaatcacattacctcctccgaaaataagtatatctgatttttttaaatcctcaataaaagagctatttgcaattcttgattcaagctgttttacgatccgcttgctattaattttatcaacaatagagaatttttgtaatttattttttagattactttttaaagaattaagccagcttttttcaatataacttgtaaattcaataggggaaaagttttttctaaagttgtaactgtatgttataactttaccatatttttttaatcttttttctaattgttctactataaattgatcgccaaaattagtgctatcagtaaagcttaaaagtattattttcaaaattaactttctcctcaacttatttttttgttctaaatgtgtaattaattagactacatactcccaaaataaaaataacatcttgtaaaaaatatgtgcccactaaagatcttaaaagaaaagaaattaataaagctattccaaaataaatttgataagattgaatattttttaataaataaaatataatcataaacagtaaagctataattaatatagaacctagaatagtcccaaaagttagtaacatctcgagaaaaaaattatgggaatgataaaacatgttatgcgttaaaatcctagcaacaccgacgccctctggtaatccgttggccatttttaaatgttctataataacaggatagattccatctctaccgcttaaatagatatctgtattttgtgcacttaattgttggataaacaaagatagatttctggaatttatcccaaatctgatcatcaagttttgaattgaatatagtatatcaatcagattagcatatatatatattcccattcctgagacaatagagattataaaataaaacgaaaaatttctttttcttttaaagagtaaatatacgaaaaatgttaaaataacactggaaacaaaaaccgacctagatccaaaaaaaagacatatcaagatattagcaattaaacagataatattagtctttttattagactgagatatagaaaatgccaaggaaattgtatttatatgagttactaatccaacttcataatatcctattttttttaaaaaatataaatttatgaaaataggaagtaataaagtgaaaataatactaaatttatgccaataagcaaatatttttttgtaatccagttcaacattgatcaagtaaactacaggtataaaaatgacaataaaattgaataaaatcgcaagtacataagttggatattcagaaaaaagtgcattaacaagaaataaagttattgttatcaatattaaaaatatacttttaaacgtaaactttaacttattaaaactcaatatcagaataaaaaataaaataaacaatatcttttctgaatagaaaagatatgactttggtataattacagccgtcacataagatatcggaagtaagtataacaatatgaccacagatagttctttattagaaaatatattttttcttattttcagatttgatttcattctatcccattcctatagattattttcgaatgattttttgccttgtaacatcaatataattattttatatatagataatccagaaaataatgattttcttctcaaggcaaactgtaatataagaaaaaaacaaaattttttgctgatagctctaaatagagctcctcggtgaattaagtaattttcattatatccattaaaccagcttgaatcatcattatatacatctgcaatcacttctttattactataaacttttaatttattttttaaaacatcagttataaaaaggctatcttctccagattgaaattcagctccaccaccaaaaagaagtgaaaaatatatattattgtttaataagatatcccttttaaaagtaaacgtcactgttccgtatctaaaagaattaaaaaacttaactcttccgtctctttttactctatgttttatttcatcaccattatgaactctcacatcgaaaacaatcatatctgcctctggatatttcgaataagcatcattaatgattttttcataaccatctacaaaaacttcatcttcgtcagccattataacgatatcgtcagaagccctcaacaaagcattattacgactgcgtcctacacctttttcagacatagaatagaatttccaagttttgtcatcgaatatttgttgtttatatgaaaagtttcctggtatatctggagtttgattaatgataattgcatttgtttgaatattcatttttttgaataaagacatatctttattcatacttgacactagaacttccatatgattaatctacctcgtactttctgctttttcccaaaatggtttagattttcctgtactctctctgtaagcaccaattagttgagctaatattgtcattacatagtaagaaataaattttaaatatttattatttaaatttcgagcaactaatgctagtagatatatcattaactgtacaataaacaaaaaaacatatattgagttagaatcggtaaacactaaaatcaagtttgttataaagacaattatatgcattagatatagattatttctaagtgttctatgtgagaaataaaaaagagtaaataacccatgcttaaaaaaattatatttactaaaatcaacaaaattaatcattattattttacgagacattcgaatttttctcttaaattcatcattatccgtttctcctgctttttcaaatgctattgctttttcattgtaaatagcttttttccctaaattaacaaattttggtggatatatactgtcatgactataaattggattaatttttatataatcatttttcctaacagcatatatactcccattaccagctgttatagaagccaaatctgattctattttacgcattctaagatcaatatcccaataggtggactctgactcacttgtcgaatttattttgttattagtataaactaattttcctgctacataacctatttctaaatttgataatgataaaacaagttcttttactgattttttttctaacatagaattagcatcggtaaaaactatgatttcaccacaggctacttctactgcttcgtcctgtgcatttgtttttccttttcgttctttaacaacatgtagtttaactattttcgggaattcagctacatatcgtttgactatttcattcgtttcatctgtgctattatcagaagcgataataatttctaatttattcttctcatagtctaaactcatcaaattcaatatttttttttcaataatagaatcttcattatgtgctggaactattacagacacacttggatagtaactctcatcaaatttgatttgctttttatgaataagtttattcaagagttcaagtaatataggatagcccaccattgtataaataattaatattaaaaatagataaaataaaactctcatagtttcctcactttattcttcattaccagtaaacttttcatttgttacactggaattagatgttattccatcgtgcttcaataccttttttatagtatgccaaattatgttgatgtcttttgtaaaagaataatcttctatatataaataatcgtattcaaacttttcttcccaactaatcgcatttcttccattgacctgagcgagtccagttaatcctggtcttacgttgtgtcttttccgttgcttctcactatatagtggcaaatactccactaataacggacgaggtcctacaatcgacatatcacccttcaaaatattccaaagttctggtagctcatctagacttgttgctctaagcatttttccaaatttagttagtcgaatttcatcaggtaaatattctccattgtgatctctttcgtcagtcattgtgcgaaatttatacatggaaaaaattttttcactttttcctggtcgttcttgtttgaagataattggagaaccaagtttaattcttactaaaatacctacaattaagattatcggtgataaaacaatgagagcgatgcctgacaataggatatctaaaattctttttccaaaaagctgatagaaagtttttttacgcatcattgatcactcttttaatcgtggatactacatattttaaatcttcatctgtcatctttgtatctgatggtaaacatactcctaagtcaaataaagtttctgctacatcatcgccaatataatcataatttttgaaaacaggttgtaaatgcattggtttccatactgggcgggcttctatattatttttatctaactcatcaataagatgattcatatttattccctttattgttatgacacttaaccaataatttggttcattccaattattttctggcatgaattgtatatttgccaatttagacaattcttttttataaaaactatgaatatatcgttttttctcaattctttcatttaaaactttcaattgtcctcgaccgatacctgcaacgatattgctcattcgataattatagccaatttcattgtgttgataatggcgtgccttctcacgagattgtgtagcccaaaatctcactttttccaccttttctttgtcattagatacaagcattccgccacctgaagttgtgattatcttatttccattaaaagaataaattccatagtccccaaatgtaccagtatattttcctttatatgttgttcctaatgattctgcagcatcttcaattagagtaacatcgtattctttgcatattttagtaatttcgtctaagttagctgataaaccgtacaaatgtactactaatacagcctttgtgttaggatatttttctagcgctgttcgcaaatgttcaggtttcatattccaagtttcgtaatcactatcaacaaatacaggtatagctccttgatagagaattggattagcagtagctgagaacgtcaaggactgacaaatcactatgtcatctttaccgaccccagccgctttcaaggctaaatgtatagctgctgttccagaagataatgcggcagcatgactagctcccacgtattctgctaattctttctcaaatccattcacattcgcacctaaaggagcaacccaatttgtatcaaatgcttcttttacatactcttgttcatatccttcttcactcatatgaggagatgctaataatattcgtttattttccaacttaatcccatctttctattactttggtaggtacgccaacatttttagtattgttattaatattttttattactacacttcctgcacctataatattcgtatttccaattcttagattttgtattattttagtacctactccaatttcatttttatctcctaatataacatgtcctgaaatatttacacttggaaaaattgaattataattaccgatttgagcatcatgtccgatagtagagccgatattgatcatattgaaatttcctaaaactacatcagcagtgtaagtcgtatagggcatcaaaatattgccaatccctaactgaacatttatgcccactagtgcacttggtgcaactaaattagggaaaatcagtttattatttttatttatcttttgatatattttctccttgatatctggcgaagcaattcccagaaaaatagcagtctcttcttctaattctattaatgagtctattgttcctaatacaggttttcccaataattcttgattttgcatttttaacgaatcatcgacaaaaccaattaatttatatctagagacactttgtaatagaaaagcaatctctttgccaaatccaccagctcctacaataattgctttcactttactccccctacttatttgaagcatttgcaaaagtgacaatgtctttagccaattgttcgtcgtcttgcggcagactgttgacaaattccatcactgtttgcatggagtaacctttgatgtttcccacaaagatcttctcgtaaactgcttcatcgtttctttccttatccaacaatagttcttcatatagtttttcccctggacggatacctgtttcaatgatttcgatttcgtcttcgctatatccgctcaatcggatcatatttttggctagatccacgattttcactggttcgctcatatctaaaataaagatttcgccgccttttgctaacgccccagattgaataactaaacgactcgcttcaggaatcgtcatgaaatatcgggtcatacgaaagtctgttacagtgactggtccgccttgagcaatttgttctctgaatactgggatcacactaccacgagaaccaaggacattcccaaatctgacagctgagaatttcgtacagccttcttcattcaacccagtcacgatcatttcagcgattcgttttgttgaacccatgacgtttggcggattgttggctttatctgtcgagaccatgacgaagttttttactttcgctgctttggctgcttctgctacattttttgtaccgaaaatattgtttttgactgcttcttttgggttatattccatcaatggtacatgcttatgagcggctgcatggtagacgatatctgggtggtattgttccatgatctcattgattttcttgcgatcttggatatccgcaatgatcggcacgatttctgtaggacacttttgatgatgcgtgcgtaattcacggtcaatcaagtaaatcgagttctccccatgacctaaaagtaatagttttgcaggattgaattgaatgatttgccgacagatttctgaaccgatcgatcctcctgcgccggtgacaagaatgactttgtctgtgatctgatctttgatggattcaatatccagctttacctcatctcttcccagtaaatccactacgtcaattgtttttaattttgatacgctaattttccctgaagcaagttcttctatagaaggcattgtgttgactttcacacgagcggattcgactaactcgaagattcgtcgtaatttttttcttgataaggaagggatagcgatcgttaccatttgaatgtcatatttttcaatcaattccggaatatcttttaatgcacctaatactttttttcctgatagatacgtatttcttttattcgggtcatcatctacaaacccgacaacgtggatatcttgagccgttttggatccaagaaagctgttgtataaaatacgcccgccttcgccagcaccaacgatcaaggtatttttagcagaatctgctgatacgtatctcatattttttgtttcgatatagatacgccagatcaatcggctaccaatgatcaataagagcgaaagcagataagcaaagataactaaccgtaaactgtatcgccgattaatgaacagcagtatgaggatacttgaggcagcacttgcagatagtgaactaaaaattgcaatgatctctcttaaatttgtatagcgattgatccgagtgaaaactttgaataaactaccataaaataaataaaaaccaatcgacaaaccgatagagattaaaataaggtccattggtatagctacaaacggcttcatgaatttagctgctgcaatatttgcagcgatcaataacaaactgtccacaacaaccaatgtggcaatttttcttcttcttgttaaaacaaacaccctacattcccccctaaaataaaccaaacttcttcttttttacctcttcatagactggataactgatctcatccccgttgatcaggtcctttgcgacttgtttcatctgtgctactttttccttaccaaagtccttggcgatttgctcataacattcttttaagtaaaaggtgcgtttagagaccccatgggcatcagaggcagccatttgcacgaggttatgtttgaccatcattttggctgttttctggatgtctttgccaaatacaccgacataacttggtgcggtgagttgggccaagcatcccatatctaggaatggcagcaaatgattcgtgtctttacgaaaatgcgcgttgcgttctggatggacgatcactggtgtctttcctagttgtaacaactcaaaaaagagccgttctgcatataacggcacttccagtgtcggaaattcgattagaagatatgtatcatctaaatctgtaaataaaatttcatctcggtggatgtcttcaatcagtgttccggtaatacgtacttcttgtccttccaataacgtcaaaggcaattgtcttttctctaattctgcttgtaacgaagcgactagagaaatgacttgtgatttttcattgctgtattttccattattgtgatggggtgtgcataaaatatgtgtgatcccttgttgaatcgctttttcagccatggcgatactggcatctatgttttctgctccgtcatcgattcctggcaggatatggcaatgtagatcgatcatttctcttgtctcctctctttttatttcttaattcccgtagtaatagccagcatctctgctgtgttctgctccattgtatacaacaccaaggactcgcgcttgtaccatatctaacaattcttttgctttagtcaatgattcttttcgtgacgtattttcccgtacgaccaataaggtgccatccgtttttgaagacatgatctgtgcatctgttacggcaacgactggtggcatgtcgaaaatcactacatcaaatagttgtcttgcttctgctaaaatctgatccattcttggcgaacttagtagttctgatggatttggtggtttaggtccacttggcagaatcgacaaattgtcgactggtgttcgttggatctcatctgctacactccctgatgaactaaggacagtacttaatccgcttgcgttgttcaacttgaacgttttatagatgacgggcttacgtaagtctgcatcgactagcagcacccgttgaccagatttggcaaaaacaacggcaatgtttgctgcagtggtcgatttcccttctccaggtcctgatgaagtcacaacaatcgttttgatttgctgaccagctgcggaggcaaactggatattcgtccgaatcgtacgatattgttcagcgattggtgaagagggatttgtgagtgtgaccaaactgactgcatgagtttgggttgctttttgtttctgtgttcgtgccatttttctttcctcctagactcttgagcggcttctgcgtgatggcgctgttttatcgtttgtagcttttggttgtgtcggagctggtccttttttacggataccagcattcaattctttcgctgacatttctggtacagtccctaagattgggaagcctaatgtatccgtcacatatttttcatcttttactgtccggtcaagtaattcaaataagaaagctagacctacacctaccatcattcctaacactaagccaatcactagattcaatttattatttggcgaaacaggtgtcgtattggcaactgcacctgagatgatcgagattttatcgacattcatcacgtctttggcgttctcttggaatacttgtgacgttgtattagcaatctgttgagccgtcactgcattcgtgcttgttgcttggatcgagaacatttgtgaattttgtgactgattgacggagatggcatctttgatttgtccagcagtcatttttacattgtcttctgtttctaaacgatctttgacttcatttaatactagatcactgacaatcatatctttatacgtattgatcatttgtaggttcgtattgacatcattgacatttgcagtgtctgattgtggcagtgtcacgatcaattgggcttgtgaactgtattttggtgtcaagatgaaaaacgtcacgattcctgagatggccaagccagcaaacattgagatgatgattgttgccaagtgtttgcgtaatgtttcaaaaatttctttcaagctgattgtctcttccattttttctccactttcctatttattctctagattcatttgatcttttaattcttttttcacacggtcaagttcttgatcgctgactttttggtatgagatattgtcttgcatgaagccttctccttgcagctgatcttgcttgatcgtaccaaatgcctcccgataatctaaagcgatttttttcatttcatcaaagctcatgtctgttttcatattcgactctagagcattcaaaacggattgatagttgctgacaccgtttagactcaatacttttttcgctacaccttctacgatctttctttgacgctcttgtctaccatagtcaccgtttggatcttcataacgcatacgagaataagataatgcctgatccccgttcaatgtaattttaccgatcgtaaaatcatagccatcttgtgagaaagtgaggtcattattgacttcgataccaccaactgcatcaacaagttcttttagccctttcatattgatagagacatagtgatcgattgggatgtctacatatttttgtacggtatccatcgccatggcagctccgccgaatgcgtaagcgtggttgatcttgtcttttgtgtcacgacctacgatgtcgacatacgtatctcgaggaatgctgacgatcgttgtctgtttatcttcaggactgactgtggcaaccatcatcgtatctgatcttccttgatcgacccgacctaaatctccagtatcaatccccatcaatagaacagagaaagattcttgtttgtccagatcaactggtttcgttcgttctccttgggttcgttccactgattcgtaagttttctcaatagaatgtgagagatccagatataattttgctcctactcctacaattgctaatactaatacgataagaactgctaaaataatcaaaaatatttttttccctcttgattttcttcttcgtcttgccatagtttcctccgtttgctaaccttgcttgaatcaacgttttaactgtcaatagcttatattgctatagcccatttgctgagcaacagtttgtgcttttgttgcgtatgctgcgcttattttttcattccggatctgctctatttgactgagcgccgtcaaatattgatcgtaagtagcggtagctgttacttgaccgtctttcagcatcgtatcgaatagctgatctagttgcgtgacttgtgcaatttgggtatcagcgaatcctagatattgcataacgactgttttccaagcactatccttaaaaaagctcatattttcacgtacatgggcgacatctgcacttgccaacttttctttgatgatgacatcatccacagcttgctgccagtttgatacgtttttagtaaataatttattgacagccgtctggatcttcagttttgattctgcatcctctaactgcgttaagactgctttcttttcttcttggatcgcagcagcttctttaggtaattctgattccttgatgtcataatcatctgccgaaagtttgatagaagatagtttatgtgacaaatttgaaactgtttcttctgttatttcaggatttaggaaaattttttcttttgtactgtacagcttatctacttcttttgataaagaggtcacggtgtctttttgattggtgatggcagattctgcgtaattgatccgttgatgatattgccgctgattattgagatggtatccaaacaagcaaatcacaatagcgcctgtgcctaccgccacagtagccaataacttgacgaacggcttttccatagattcactcctaaatattgatgatagataaataaagatgtgattcattcacatcagaatgagcgctttttattttaaaagcataattaaactaatatattcatagaaatatttataaacaggttttccctattttggctgccgtagcaacttttatatcatatcagagtggcaagtgattgtcaactcttttttaaaagtttttttcgatttcgttttttgaaatctttcagcaactcatttatcataacttgtcgtttgttatttgtcaagaacttttttgaagtttttttcaatagaatcaaccttcgcaagctgttcttttttaacgactcagttatcttatcatgtcactatcaacatgtcaataacttattttttattattttaagttattggtgttcttttgaacaaataataatatatcaacatcacatacgaaagtcaataagaaaatgcttatttatcaacatttccagcttatatgatcgttagttagttctgctccttttttgttcgtctttataaccttaaaaaacgaaaaatccttttattttcagtttaacgttcatgtttttgtcctatttatgaggaccaaatctctcaccttctaaaattttccttaacaaagtgctgcttttatctatttctgcttttttttgctagaataatagtaacaatatgactctggaggatttatttatgaaaattttgattgctgacgacgataaagaaatcgttgaattattaagtatctatgttcacaatgaaggctatgaagcagtaaaagcttatgatgggaaagaagcattatctaaaatcagaacaatccctgatattgaattacttattttagatatcatgatgccagagatggacgggatgcaagtagtgaaagagctacgaaaagaatctcaaatcccaatcattatgctgacagcaaaaactactgatatggataagatcaaaggactggtggctggtgcagatgattatgtaaccaaaccgtttaatccattagaagtaatggctagagtaaagtctctattacgacgtacaaaaatgcagatcgccccagatcagcctgatgtattagaagtaaatgcattaatcatcaacaaagactctcatgaagttaaaacaattgatgggaaagaaatccagttaacagctttggaattcggtatcctctacttacttgctagtcatcctaatcgagtatttagcgcagatgaaatttttgagcgtgtttggaaacaagaaagtattgtctctgctaaaactgtcatggttcatgttagccatttaagagataagatcgaagaagcaactggtggtgaaaaagtcattcaaaccgtttggggagtgggctataaaattgacgcaagatagtaaacgagcaactgaaaaacgccgtcggatcaacttgacttcaaaagaaatcagcgaattgttagcggaaggaatcatcacgatcatccttttacttctattaaatgtttctattttggttgttatcagttcggtaattaatagttcaccttctttaacgaatgctatttgggattcaaagaatatttttgcggaacgattgaacactgatttattttggaacggtcgaaactttattattccctttttctttctattagatatcggtgttttgtattggcgtttgattcgaagatatcgccaaatgcaattacgacatatcatcagtgaacttcattacatcgcaaatggaaattatgatcatcgtatcccttttgaacttagtggtgacttaagccgagttgtaacaagtatcaatggattggtagatagcacagtagcagcgattgaagacgaacgtaaaatcgagaaatcaaaagatgaattgatcacaaatgttagtcacgatatccgtaccccacttacttctatcattggatatctaggattgatagaagatggtcagtatcactcagaagaagatcttttaaagtatacacataccgcttatattaaagcaaagcagatgaaatctttagtggacgacttatttgaatacactaaggtacgccagcctgctgtcccagtaaatttttctgcctttgatatgatccagttgatcgaacagttagcagctgattttgagttggaagcttctaaaaaaaatatccaaatacttgtgcagtcaaaagtagattcccttatcatggatggcgatacagaaaaacttgtacgtgtcttcaataatcttttgacgaatgcgttgaaatatggaaaaggagcaacgaaaatcgtgatcgaagtagaacgtgtcggttcagaagttgttgcaacggtcaaaaataatggagcaatgatcccacaacaggcaatcgataatctattcgatcgcttttatcgtgtagaagaatctcggtcacaagcaactggaggaactgggcttggtttagcaatcgctcaaagtattgtggctttacatggtggctacatttatgcaaaatcagataagcaatggacttctttcatcatgcaccttccaatcaagaaaaatgaaaaattacctattgatgcacaggaagttattgacgaaagctgaaatattcgctattcttattacaattattagaataaatgaaaaacacagaacccagtacactttattctttttcagagagctgatggcaggtgcaaatcagcaaagggtaatttggaagttccagttcgtttacgtgccctttcgaaataagaaaggtcggttcaacagccgttatgtgttcaacaagtgcagcttatgctgaacttgggtggtaccgcgaatttcagactgattcgtcccaagaataaggggatggatcagtctttttttattttcaaaaaggaggaaatcatatgttagatgtaaaaatgatgcgacaaaatatcgaagaagtacaagaaaaattgatgactcggggcgttaaaaaagaaacattagctgaattcatggaactagatgaaaaccgccgcaaattactagtcaaaagtgaagaattgaaaaaatatcgaaatgacgtttctgctgagatcgctcaattgaagcgtgcaaaagaagatgcttctgctaaaatcgctgaaatgaaagaagttggtggcaacatcaaagcattggatactgaaattgctgaagtagatgaaaaattgaaacaaattgccactactttgccaaaccttccccatgattctgtgccagttggatcagacgaagaggacaatgtagaaatccgtcgttggagcgaaccacgtacatttgcttttgagccaaaaccacactgggaaattgcagaaaatctggatattttagactttgaacgtggcgcaaaagtagccggtagccgttttgtttattataaagggttgggcgctcgattagaacgtgcagtctacaacttcatgcttgatcagcatatttacgaacacggctatactgaaatgatcactccttatatcgtcaacagtaaagcgatgtttggtacaggacaatttccaaaattcaaagaagatgttttccaattggagaatactgatttaacattgattccgacagctgaagtcccattgactaactattataatgatgaaattttagatggtgcggatttacctgtttatttcactgcactaagtcctgcttttcgttctgaagctggaagtgccggtcgggatactcgaggactgatccgtcttcaccaattcaataaagtagaaatggtcaaattctcggatgcagaacattcttacgaagaattggaaaaaatgacagctgatgcagaagatatattgaaaaaactgcatttgccttatcgtgtaatggccttatcaactggagacatgggcttttctgcagctaaaacttatgatttagaagtatggattcctgcacaagatacttatcgtgaaatcagttcttgttctaactgtgaagatttccaagcacgccgcgccatgattcgttatcgcgataatgatggaaaaatccactacgctcatactttgaatggttcaggacttgcggttggccgtacagtagctgccattttggagaactaccaaaatgaagatggttctgtcacagttccagaagcgctcgttccttatatgggtaatctgaaagttattaaataaagaggttgtgaaaaagctgtcctgcatcaagtaataagaactgccaaacaaaaatagctcctcatattttgccgttttttgagctaataccgagggccagctgattgaacaccgtttaaaaaagaagtcgtgagcctgccgtttcactccaaaccacaaggagtaatttcaaaaaacagctcttcatattttatgaatgttctacttgtgattcggagttgacaaaggaacattgtttacttaaaaaaagagtggtgacacaacatgtgtcaccactcttttttagtatttttaagattcaactgaatagtttggtgcttctttcgtgatttgtacatcatgagggtgtgattcttttaatccactgccgctcatttggatgaattgcgcttcatcacgtaattgctgtaaattggctgccccaacataacccattcctgaacgcaacccgccgatcatttggaaaataatgtctgcaacacttcctttgtaagcaactcgaccttcgattccttctggtactaatttatttgcttcattgacactaccttggaagtaacggtcttttgaacctttttccatcgcgcctaatgaccccatacctcggtatgttttgaatcgtcgtccttggaagatttcgaattcacctggtgattcatctgtccccgccaacatgctgcctaacataactgcatgtccgccggcagctaatgctttgacgatgtcaccagagtacttgattcctccgtctgcaataatcgctttgccatattgacgagcaactgatgctgcatcatagatagctgtgagctgaggtacacctacaccggctaccacacgtgtcgtacaaatcgatcctggtccgataccgacttttacgacatccacccctgcatcatataaagcttttgtcgcttcagccgtcgcaacgttcccagcaatcaatgttgcatctgcaaaagttgaacggatttcttggatttttcggattacacctgcactatgtccatgagctgtatcgatgatgattgcatctacccctgcttctaataaagcattcgcacgctcgaatgtatcgcttgttacaccaacggctgctgctacaagtaatcgaccatgttcatcttttgctgcatttggaaattcgatcactttctcgatatctttgattgtgatcaatccgcttaaacgaccttcgttatcaacgattggtaatttttcgattttatgtttttgcaaaatcttttctgcatcttttagagaggtacctactggggcagtcactaagttgtcttttgtcatcacatcagcaatgggcatgtggtaatctgttacaaaacgcatgtcgcggtttgtaatgatccctaccaattttctgttttcaagtgtttcaacgattggcacaccgctgatacggtatttgctcatcaattcttctgcatctgctacaagatgctgtggtgttaagaagaacggatcaatgatgacaccactttcagaacgtttgacttttcttacttcatccgcttgctggctgatcgtcatgtttttatggatcacacctaatccgccttgtcttgccatagcgatggccatcttgctgtcggtaacggtatccatacttgcactgatgattggaatattcaacttaatatttttagctaattgtacgctcatatccacttcgtttggtaacacgtgactttctgctggtatcaataagacatcatcaaaagtaaatccttttttcgtgaactttgtttcccagttggacatttttagtaccactcctctaatttagtttatctattaaaataattgattttttcatttaagtcaatgatctacatggaatcaaattagctttctcatagaataccaatataaaccgcttacatatgtgtgtatgctaaatgaggttgtgaaaaagtcacttagtttcgagtattaataaaaattttgtgaaaatgactttccatatttttgcatagatttggcttaataccgataaactggcttttgaagaccgtttatttacaaatagggactgtgacaagaattttgtcacagtcccttgctgttatttaactatggataaacggaataaggtcctttactacctcttaatatttagtaaagctactgctctgctttctggtttatcttcttggaacggataaacttccaatgatcccatactttttcttcaagtagtaacggacggctaaagctgctgctccgatgatgataactactatcggatctaatactgggttgataactggtggcaatagcgttgtcgcagaaaacagcacgacccaaagaagtgtcgttccacctaggataagcaatgttttacccattcctggtttcttgcttcgatctgctcctgggtattcatactgatagatgtacttgtacatcatataaaagacccagccaccgattgcagaacctagaacgagtgtagagaatccataagctggcgttgttccacgtgaaaacaatccggtaatcgcgatcatgatacttaatagaccaagcagtaataacgtattatccaaccacatcaataaaggggtcgatgtattttgtacttctgctggtttattgatgattgcttccgttctttcagagactgtcccgaacaattggcgagctgtttttccgcctttttgttctgcaactaaagtaggcagaatgtcatgaagggcttttactttttcttcttcagacaaattcgctgcttctaaagattttttcaaatcaaaaatgtactgttgatttcttttggttaattttgtttctaaactattgttttcttttacgatttctcgtaattgttctggttccattatctaatagtcctccttagccgttccttttctcaacggtcgtcacaaaagacattctaccatattctacagctagtttgatagcccttttacacattaaagcggaataacattacatcgccgtcttgtacgacataatcttttccttctaatcgaacacgtccagcttcttttgctgcatgcatgtttccataatgatccaagtcttcaaaagagacagtttccgcacgaataaatccacgttcgaaatctgaatggatgattcctgctgcttgtggcgctttgattccttttttgaatgtccaagcacgtacttcttgttccccagcagtaaagtaagtagctaagcctaacaaatcgtaagcggcacggatcaactgatccaaacctgattcttcgattcctaaagcttctagaaattccgctttgtcttcttcatctaattctgcgatttcttcttctgcacgagcgctgaccacgattacttctgcattttcttctgcagcaaagttgcgcacttcttgtacataatgattcgcgtctgcatctgccacatcatcttctgacacatttgctacgtaaagaatcggttttgtcgtcaataagaatagtgatttaacgattttttgttcttcttctgtgaattcgatcgttcgagcagattttccttcttccagtacaggtttgattttgtccaatacagctagctctgccactgcatctttatctttggttttagcaacttttgctacacgagtatagcgtttgttgatagattccaagtctgctaacactagttccaagttgattgtatcaatatcttctagtggatcgacgcgtccttctacgtgagtgatattatcatcatcaaaacagcgtacaacgtgacaaatagcatctacttggcggatatggcttaagaattgattccccaaaccttctcctttacttgcgccttttacgatcccagcaatatctgtaaattcaaaagtcgtcggaacagtttttttcggatgtacaagttctgttaagcgttgcagacgccagtcaggtacttctaccatccctacgttagggtcgatcgtcgcaaagggatagtttgctgcttctgctcctgcttttgtgatcgcattaaacaaagttgattttcctacgttgggcaacccaacaattccagcagtcaatgccataaatttattcactctttctctgcatttttttcaattactttttttaatttcttttcaaaatctcgacgggtcatcatgacgatatgtccgcaattcatacatctgattttgatatctgcgcccattcgaatgacttcccagcggttcgtctggcaagcgtgaggttttttcatttcaacgatatcgtgcaagtcgtacataaaaatagcctcctttttgtttattcttcatcaaattgaatattcaagatatcaagaattcgtgtcaaatctttttgagaaaggtattcgatctcgatcttacctttcccgtttttttcttggatagctacgctcgtaccgaatttatccatcaaacgatcttcgctttctcggatataatatggtttttcctttgctagccttgggatttttttcttttcttttccatcgttttgatttaactcagaaacaatctgttccagttggcggacagttaaattttcagttactgcacgattggctaatttcaagatcaatgatttgtttttcaagcctaacagcgtacgagcttgtcccatagataaacgttgatcttgcaccatttccttaacaagatctggtaaagaaagcaagcgcaaataattggcgatataaggtctgctctttcctaaacgactagccacttctgcttgtgtcagtttcagatttttcatcagcatttcatacgcttctgcttcttctaatggattcagatcttcccgttgcaagttttccaacacggctacttgcatcattgcttcttcgtcaaagtctctgacgatagcagggatcgtttctttttcagctagtttggacgctcgaaaacgtctttcgcctgcgatgatctcatatccttttactgcagaacggcgtacgatgattggttggaagacgcctgattgttcaatagaattagctagttcttgcaaagatacttcttcaaatgtcttacgcggctgatacggatttggacgcagctcattcaatggcaactggaccacagtatcatcttttacatccaccgtctctaagttttctaaatcttggaacaatgcatcgattcctcggcctaatcctttacttttcttcacgacttaccacttcctttgccaatgcttggtagacttcagctccccgagaacgtgggtcgtagtcgatgatcggttttccatgactaggtgcttctgataaacgaatatttcttgggatgattgtttcatagactttttcgcggaagtatttgcgtacttcttctacgacttcatttcccagatttgttcgtgcatcatacatggtcagcaagacaccttctatttctaattctggattgaagtgcttttgaactaaacgaaccgtattcagtaattggcttaatccttccaatgcgtaatattcacactgaacaggtatcaaaatcgaatcacttgctgtaaatgaattgattgtcaaatggccaagagaaggcggacagtcgatcaagatataatcatactggctgctgacttctgctaaagatccttttaatcttgattctcttgccatcattgatgtcaattcgatctctgctcctgctaattggagagtcgcaggcacaatactcaaattttcgtgttcagtgatcaaagtcgcctcatcaattggcaattcattgactagaacgtcatagatgtcttttgtcacatcgggttttctgatcccgacaccactggtagcatttccttgggcatccatatccactagcaatacttttttgccaaggctggcaagacaagcacctagatttaccgtcgtcgttgttttgccgacgccacctttttggttcgcaacagatattatttgtgccatctcttctcctcctatttgattggctgcttattaggcagaccgggctttcttgggtatttctttggggttattttctttttttgaataacgataatatgccgttggtcagagacattcggcaaggtaactgcctcttctttgaggaatttaccacctaataaagcaatcgcttgttttgcttctgtcagttcctcttcactttttgctgctttcaatgcataaaaatagccttcttgtttagccaagggcaaacataattctgctaacacattcaaacgagcaactgcacgagcagtgacaaggtcaaatgatgcacgaaattgaggattttgtccaaatgtttctgcccggtcatgatataaggaagcatcgattcctaataatcgagttagttcagacaagaaggttattcgtttattcagagaatcaacaatcgttatctgcaattcaggaaaggcaatttttaaaggtatgctaggaaaccctgctcctgaaccgacatcgcataaagataaaggttgcgtaaagtctacttcaaatgctaatgtaagcgaatcgtaaaaatgcttcaggtatacgtctttttcatccgtaatagctgtaagattcattttttcgttccattcgactaatgtccgataatagatagcaaattgatccatttgatgatcggtaagctctatccctttttctgccaaagattggcgaaattcttctggtatcataattattcctttcattgtgaaacagcaattgtttcacagattctctccctactttaacgcaaaatcccaagacatgcaatccttccatatggattcttaaaaatttgaaaagtaagaaaagtcgatagattttttctttctattatggcacttataaaatacacatagaagagagaactagctttgagcaatttctgcaaaaactggttctctcttctatttattattacgtattacgctggttcactgactttcgcaatcttcccttgttcaatgtagaccattaagatgcttagatctgcaggatttaccccgctgatccggctagcttgggcaatcgtttctggttggattttctgcaatttttgttttgcttctgttgctaatccgttgattgctgcgtagtcgatgttttctggaatctttttcgcttccatgcgttttaatttttctactttttccatggcttttttgatgtagccttcatatttgatttggatttctacttgttcgatttcttttcgtgtcaattcttcattctctgggataaaccgtagaagatctgcataagtaatctcagggcgtcttaaaaagtcgcttgctagtacgccatcttttagaggtgccgcattaatcgtcgctaaaaaggcttgaacttcttctgttggtttgatccgtacattcatcaaacgtttgatttcttgttcaactgcttcttttttcttcaaataagccttgtattggtcttcttttactaagcccacacggtggcccatttctgtcaatcgcaaatctgcattatcatgacgtaaaagcagacggtattcagcacgtgaagtcagcaaacggtaaggttcgttcgttccttttgtcaccaaatcatcgatcatgacaccgatgtaaccgtcacttcgtttgattactaaaggttcttttccttgaactttcaaagctgcattgataccagcaatcagcccttgtccagccgcttcttcatacccgcttgtaccatttgtttgtccagctgtataaagattttcaacgactttagtttctaatgtcggacggagctggtgtggttctactacgtcatattcgatagcatatcctgtacgcatcatttctactttttccaaaccggcgatggaatgaagcatgtcgacttggacatcttctggtaaagaagtagataacccttgaacatagacttcttctgtgttcaagccttctggttctaaaaatagttggtgacgttgtttgtctgcaaaacgcacgatcttatcttcgatggatggacaatagcgagcacctaccccttcaacgatccctgtaaacattggggcacgatgtaagttgtctcgaatgatttggtgagtcgtctcacctgtataggttagccagcaagattcctgatctagtttataggcactatctggtgtgctgaaactaaaatgattcggctctttgtcaccaggttgttcttctgtaacagaataatcgatcgtacttgattttactcgaggcggcgttcctgttttgaaccgttcgatagcaaagccaagttcttttagatgattcgctagtccaatagaaggttgagagttattcggacctgatgaatatttcaattcaccgataatgatttctccgcgaagtgctgttccggctgtaataacaactgcttttgcccggtagctcgctcctgtggaagtcactacaccatgacaaataccatcttcgacgatcagttcttcgacgattccttgtcttagcgtcaaatttggttctttttcgatcgtatgtttcatttgtgttgaataagcatgtttgtctgcttgtgctcgcaatgctcggacagctgggccttttcctgtgttcaacatacgcatttggatataggttttatcgatattcttacccatttctccacctagcgcatcgatttctcgaacaacaacgcctttagctggtccgcctacagaaggattacatggcatgaatgctaccatatccaaatttattgtcagtaataacgttttcgagcccatacgtgcagcagcaagtgcagcttctgaaccagcatgtcctgcgccgacaacgatcacgtcatacgcatctgcttcataatgtttcaatcgtttgttcctccttttattttcctaaacaaaattgactgaataattgagtgatcaattcatcttgtacactgtcgccaactacttctcctagataatcccaacaacgcgtcatatcgatttgaacgagatccacaggcattcctgcatcaatacctgcaatgacttcttcaagtgacagagaagctttttctaacaatgcgatatggcgggtattggaaacataggtagcgtctctttctcctgtttctccgctgaagaataaatcagaaatagctgattccaaatgatctagtccgtcgtttttagctacggaaattgaaaaaactggttcattttcgatcaatttgttcaatttttcttgttccaactgtgctggcaaatctgttttatttagaagaatgatccgtttcaatccctttgtcgcttccagtaattgttcatcttctgctgtcagtggttcgctttggtttagaacaagtaagatcaagtctgcttctgctaatgctttacggcttctttcgaccccaatacgttccaccacatcttctgtttcccgaattccagctgtatcgattaacttgagcggtaccccccgaacattgacatactcttcgattacatctctagtcgttcctgcaatgtccgtaacgattgctttttcttctcttaacaaatggttcaacaaacttgatttaccgacatttggccggccgataatcgccgtacttaacccttcccgcagaacctttccttgcttggatgtagcaagtagtgcttggattctttgttggatcatctgtgctttttcaagcaataacttcgtagtcaattcttcgacgtcgtcatattccggataatcaatatttacttctacttgggctaatgtctctaaaatctcttgtctcaatgaacggatcaaggcagacagattgccgtctaactgattgagggctaaccccattgctttatctgtttttgctcgaatcaaatccatcacagcttctgcctgtgaaaggtcaacacgaccattcaagaatgctcgttttgtgaattcgcctggctcagctaatcttgccccttctcttaacagtaactgcaaaatttgattgactacgacgatcccgccgtgacaattgatttctaccacatcttcccgcgtaaatgtctttggtgctctcatcacggagaccatgacttcatcgactagctgatcgctcttaggatcaacgatatgtccataatggatcgtatggcttggtacttctgatagtcgtttattcccagaatgataaactttatctgctagttgcacagcttgatcgccacttaaacgaacgatactgattgctccttctccaggcggggtagaaattgccgcaatcgtatcaaattctaaagtaatttcagccattttttcacttcctttttcattttgcgcacaaaaaaagtgcccactccaccctttatgcataataaatggtgaacttcgcactttgactgcttgttcttgattaaattctggtcataggttatcacacttgtcataaggaatcaagtgtttaaaacaagttatatgaagttgtacctcacttgattccattaccttacatttaattgcctttggctgtctctttgtgttctttgattcttttttgaattggaatcaataatgattttacgcagtgtttctacttttttctgatcaaattgatcacacctatttcttatcgctttgatttccgctcctgttatgtgacgggattcaggaactacttctttccgaggaacaaatgggattgtccaaattgcattgttatatttatcaccccaaaatactttatggatttttttattctccagtggaagctgttctcgctctttttttctatccaaataatgatcataggcttttgaaataaaatttctcacttcttctttaccatatcccgatttttccaagtgcatgatcattagttcattcattacatagttgaatttttctgtcgataatgttttgtatttcgtttgccaaaagtttctgtcgtggatagtgacttgttttctggttcccaaaatatattttaaagaagcattcatattatttatttcacagtttccttgaacatactgagtagtagcaatatgattcgcaacatattctttttctgtgcagttacttagcttgtttaaaatgtgataagttcttttagctgtagcaaatggattgattctttcttcaaaggtaagatgctgccttcctatccgaagcacttcttccaatcctttcttctctactccttcatagacataaactggggtgatttttagggtctcttgatcgaaccacagcttttcttgaatcttttttttcaatgctcttttatcagggcagtgcattctcatttgtgctttatcataaacttctacgttcagacgatcttgctctttttttatgatgaaagtgacgccatgaccatttttgaaccatgaataccacttttctttataaaacatcgaaactggtacaactaaaaaactatctttatgattattctctagctcattgatgtaatttttaaataattttgtatggattgaaccataaatacttttttgaatggattctttgattttgttgatgtcccgaccttcgaattcatctggataaacattgaggatttgttggtaaacggtcataaattcaagcgtcgggcttgtactgggtttcgtcttaaaaaaaatatcatttccaatcatgttccaattttgtaaaagaacactgcacatttctggcacatatttttcgctatttacgtacttttctctttttttatccgctgattgaatcagcatttctacttgtgctgcatctaaaagatccatctttaaacgctcctttcttctctctctaacaaatgaataatactgtatgagcaaggatttatctttcttcaaaaaagggagactaaataaataggataacgctatcttaacgtttcttttaaaaagaaaaatgacctatttatcaaacttctcttataacaccttgttcttgttgtcttcttcgtcgttcaaccatcgtactaaacgaaggaactgatattcttcggataatattgtgtagttgttgttgcctagattccgtacactttattttgacagagagaatttcaataggcgttaaatgataacaacttttctgtttattttcgctagaaggcagtccataagaaaaacaaagcgtatggtcgatggattttctaatttcagtcgggataatccaatgattatttttgttgattcctccccattctgatttatgtgctattttgtcaatcatatcaagagctgatcgctgacttttggcttctttatagacttcataagcatttctaatgaaattttctgtcgcttgtccatagcctatttttttcaaatgcgtgaacatcagctcatttattgtgtgatttaattgttccgtagataacgttttgtatttcgtttgaaagaatttcttgccatcaataataatttctgactttgttcctagtatgtattttaatgctgcattcatgtttttgatttcgctgttatctcttacatattgaattgtccctacatgagaggaatatccttctattgttgcgtacttacttaatttattgtaaatataataactcttcttatatttgggaaaaggaactgctttttcatgccaattgtaatgatttcttcctatgcgtaaaacgtcaaccagtgattgaacatcgctcagttcatatgtgtatataggagttagttttgctatttcttcctttgtccatgaatttttatgaacattttttttcttcgcatattcatctggacgaactgctctgatttgaactttgtcataaatctggacatttatctgattattttgtttttggataatcactgcaacatcagatctttttgtgaaatcagcagatctataacttagataataaaatgaaacaggtactactaaaaagctgtcttgatcattgtttttcaattcattgatatagttactgaacaactcggtatggatcgaaccataaatacttttttgaatcgattctttgatttttttgatgtcacgtccttcgaattcctcaggatgaatatcgagaagctgctgataaattgccataaattcaatcgtgggagttgtactaggcttttcgattagaaaagtatcattgtcgcgcatattccaattttgtagaagaagactgcacatatcccgcgcatagatatcactttttaaataacgatttcgctttcgatttgctgatttgatcaaatctgttacttgtttttcagtcaatatattcattctatatgcctttccttccttcattgagtaaaacaacttttaagactacgaaatacccaattaattataacatctgtggtttctgtatattttctagctttttcaaaataaagaaataattgtttctcttctattcatgctttttctttcttcataaaaacggtaaactagaatgggagcgctatctaaaatatttgtttttgaaaggagaaaaggaatgagccagttcaactctgatgcattgaaagaagaaagtgatcctcggatcaatgatgttgttttatctacaggaaatatcaatcaaaaatatatcgtccgcgatatcgtttttgttgtggaatgcttagaagctgatttgtttgacccagcttttcccaatgaggatcttttcttgacaacgaagaggaaattaaaaatgaaggttcttgaatatggtgcgaatgcggtgatcaactgtcattttgagtatcagcaaagaaatcgggatggaaagtattttctggaactttttgcttatggaacagtgatccaatttatccaaacgacgattggttaaatgaaatagacaaaaaaaagcggagcaaaactgaaaacagtttcgttccgcttttttctatcaaagttagtgactacttcatcgtatactctgataagaatgatttctagtaaaatatacttggtttgaaaaactttgtcaacgtgatttattcaaaaagtaatggaatcaataatattttttagcaggttcaactactaagtaacgataaggttcctcaccttccgaatgtgtttttacatgttcatctttgcttaatgccgcatggatttgtttacgttcaaaggcaggcattggttctaagaaaacaggctgtcctgtccgttttactttttcagccgtgcgatcagctaaacgctgaataatctcttggcgcttttcgcggtaattgcctacattgaccactacagatagcttatttcttgctaaacgatggataaagacttgtgccagatattgcagtgcattcaacgtttttccatgtttcccaatcagtaacccttgtttttgtgtttctaaatgaaaaacgaccatattatttgattctctttccattttaacaagtgctggagcatcaagttgttttgaaatttcagtaagatagactgccaattccgttaaagctgcttcatcacctagctcacttacttcttctgttttttcttcaagaatcgtttcgttgactacctcgatctcagctgttggttcttcttctaaaatctcttctaccgtctgttctactgtttcagaaattttttcgctgatacttggctggatcgaaagccgtgcattctttcggcccattcctaggaaacctttttttccttcttccaatatttcgatttcaacttggtctttggtcaaacccaaatcagctagacctagttgaacagcttcatctattgttgcagcttcataaatcggcattagcattccctcccctattatttccgttttttcttaggattcattgctttcttcaacgcacgttctctttcgcggattttccgtgcttcttcttcccgttcttttcgaattttgaaaggattgttgatcagcaatgtttgtacaacttggaaggcattggaaaccacccagtataatgaaagaccgctggctaaattgacacccatcactaaaatcattacaggcatcacgaaattcatgatcttcattgatgcattcgattcaatttgactcatactagataaatacgtacttgcaaaagtaaagattgctgctagaatcggcaagataaatgttggatccgcgttccctaagttcaaccataagaaatgaccttgtttcaactcaggtacacgggaaatagattgccataacgccatcaagattggcatttgtaccaataaaggaagacaaccagcatatggattgactccattttccgcatataaacgctgttgctcttctcttaatttactttgtgtttctgggtctcttgaactatattgttgctgcagtgcttttaatttcggttgtaattcttgtgtcttacgcatgctctttgtttggaaatgcatcagcggcaacaagattacacggatgatcaatgtaaataaaatgatccctattcctgcattaccaaatgacaacgccttgatcgcctcagcaaagtaataaacaatataacgatcccaaattcctgtactttgtgcgctgacttccccagttccgcaaccggataagacgatgaccaaactaacgataccggccatcaaaagtaaacgtttgtatttcttcacttactcttttcctctctgtcgattatttttgcaagttttaagacgtggactaaattggagcgaacctcatcataagtcagccccttcacacttggtctagcaatcacaataaaatccaactccggatcaatctcttcttttatagaataaactgctgctcggatttttcgtttgacttcattgcggcttaccgcgttgccgaccttttttcctacagataaaccaactcgaaaatgaggctgtcccggttttttcaaacggtaaacgacgaatttgcggttagcaaaagaatctcccgtatgaaacacggcttgaaactctcgttctttttttactcgatacgcttttctcattagttttctttccttttctatctctcacttacgctcataatcataccataattacgattgtcctttcatcatttccctaaaaaagagtataaaaaaaaccactgaaaccccagtggcctaagctgaaagaacttttcttcctttacgacgacggctagctaacacacgacgtccatttttagtactcatacgtttacggaatccgtgaactttttgacgtttacgtttatttggttggtatgttcttttcatatattccacctccaaaatgttcttatctattttataaacacagacatactttgatagtataacgacaaagtagtgattttgtcaatataaaatagaagatcgattgtcaaaacttatccacaagattatttttttctatgggaatctcatgtggaaaaagttatacacaggaattacccacaaataataacgaggcacttttacacagaaaacacacgtgtaaaaaaagtaatccacaaccagacgttttcctgtgcatttcgtccctaaactattgataaatatacatttgttatccacaggtacaggaggaaacctagtgatttttacaagttgtccacctgtgcattagtggtgtggaaaactttttttgacagctgtgtttttctcttttttttatttgtcgattgtgtggataattgtaattaaaaaatttttttcttcggtttctgtggaaaactattaaaaaaaatgctaaattagtactagttattcactttttaatgaaggaggaggccttatatggtatccctcgatgctttatggaatgaattaaaagcaacataccaaaaggatttatcgcctgctagctataatacatggattgaaacagcgaaccctcgaactcttgatcaaaaccagctcgttgttgaggttcctagcaagattcataaagaatattgggaaaaaaacctggcaacaaaaatcgttgaagtcggttatatgttatcaggaaatgagattatccctcgctttattactggcgaagaagcagagcaagaagaagttgtagaagaaaaaaatccaaaagttgcggcacctagcccgctaaaaaaagccatgctgaatcctaaatatacctttgatacgtttgtcattggtaaaggaaaccagatggctcatgcagcagcgctcgttgtagcagaagatccaggttctatttataacccgctcttcttttatggaggcgtaggacttggtaagactcacttgatgcatgccatcggtcatcaaatgctgcaaagtcagcctaatgccaaagtaaaatatgtaagcagtgaaacttttgctaatgatttcatcaattcgatccaaaacaaaacagcagaagaattccgtcaagaatatcgaaatgttgatttactattagtagatgatattcaatttttcgcagaaaaagaagctacgcaagaggagtttttccatactttcaatgccttgtacaatgagggtaaacaaatcgttctaaccagtgatcggttgccaaacgagattccaaaactacaagaacgccttgtttctcgctttgcatgggggctgtctgttgatattacgccaccggatcttgaaacaagaacagcgattttgcgtaaaaaagcggcagctgaacgtctagagatcccagatgacacgctgagctatatcgcaggacaaattgattctaatattcgtgaattagaaggggcacttgttcgagtacaggcttttgctgcaatgaatagtgaagatatttcgactagtctagctgcagatgcgctgaaaacgttaaagtcaggaaaaggacatcctcaattgtcgattttgcagatccaagaagaagtggcaaagtattatcacatccaattgaaagatctcaaaggaaagaaacgcgtcaaatctattgttgtacctagacaaatcgctatgtacttggcacgtgagctcacagataattctttaccgaaaattggtgctgaattcggtggcaaggaccatacaacggttatccatgcccatgagaaaatccagcagctgatggattctagtgtcagcatgcaaaatgaagtatcagaaatcaaaaactttttactaaattaatttgtcgattctaccaactgaaaatagcatgtggataaaagaaaaaaacaagcaaaagttatacacactttttccacagctgttttttcgtttctctcttgcgttttttgagttttccacagaatcaacatgccctattacttttattattctttttaactaataataaataaacaaacattcaaaggagatacatcatgaaagttactttaaaccgagctagctttatgcaggaattgcaaactgttcaacgagctatttcaagcaaaaccactatccctattttgacaggtgtaaaaatcacactgacacaagaaggtttgactttgacagggagcaacgctgatatatcaattgaaacttttttgtctgttgaaaacgaaaaagcaaatatgcaaatcgaatctaccggatcaattgttttacaagctcgtttctttagcgaaatcattcgaagacttcctgaagaaacatttactttagaagtattagaaaataaacaagtagcgatcacttctggaaaagcgaattttatcgtgaatggattagatgcagataattatcctcatcttcctgttgtcgaaagtcataaccagatgaaattaccagtacacgtattgactaaactaatcaacgaaacagtttttgctgtttcgcagcatgagagccgtccaatcttgacgggtgtgcattttattttatctgatcattctttattggctgtagctaccgactctcaccgtctaagtcaacgggtgatcccagtagaacaaacggctgatcattttgatattgttattcccgggaaaagtttgatcgaattgtctcgctcattgacaaatgaagaagaaatcgtcgaaatcagcattatggaaaaccaagtcttgtttaaaacggaaacaatgtatttctattcccgcttgctagaaggaaactatcctgataccaatcgtttgatcccatcaagctttaatacagaggtcgaattttctgttcctagctttctagcagcaatcgaacgtgcttctttactttctcatgaaggccgcaacaatatcgttcgtttatccattcgtccagatgcggttgttttatacggaaattctccagaaatcgggaaagtagaagaaagtttgagctatacagcaagcagtggcgatccattggagatttctttcaacccggattatatgaaagcagcgttgcgtgcatttggagatatgagtatcaaagtaaaatttatttccgctattcgaccattcacgttggaaccaacggaagatggcgttcaatttatccaattgattactcctgtacgtacaaattaacaaagattttcaaagatattgaaaatttaattgaaaagaattagaaaaaataaaatttaaacagaaggccctaaaatctcttttaaggctttctgtttatttttgtctaaatcaccttttttagattaaatcgtcttatatggaaaaatatatggataaatttgttttattgcggaaaaaaaggtataatagagtatacttttaataatgaaaatgagggatggacattgaaacaacaagtcattctaaatacggaattcatgacgttgggtcaaatgctgaaagaagccaccgttatcggtagtggcggacaagcaaaatggtatttggcagaaaacactgtgttagtcgatggcgagccggaaaatcgtcgtggacgcaagctttatcccggtatgatggttgaagttccagaagtaggaactttttttatggtaaaaaaaggaaacgacgataatgaggctgaataagctgtatttaaaaaattatcgaaattacgaagagctgaacatcgaattttccaagaatctggtcatttttttaggtgaaaatgcgcagggaaaaacaaatcttttggaaagtatctatgtattggctatgacgcgaagccatcggacaagtagtgagcaggaattgattggttggaatgacgatcaggcaatgatccaaggagagatcgcaaaaggttcatccactctcccattagaaatcttattatctaaaaaaggccgaaaaaccaagatcaaccatatcgaacaaaaaaagttaagtacttacgtgggacaaatgaatgtcattttatttgcaccagaggatctttcgttagtaaaaggcagcccgcagatcaggcggaaatttttagatatggaattaggtcagatcaatccaatttatctttatgatcttgtccaataccaagcgattttgaagcaaagaaaccagtatttgaagcaattgaatgaaaaaaaacaaactgatttgctttatttggatattttgtccgaacaactagcagcgtttggtagcaaagtattgaaagcaagagcacagttcatcaagcgattggagttttgggctaattctttacatcagcaaatcacacatcataaagagcagctggaaatcgagtatctcaccgcagtcgattctttagaaacacatacgcaagaacaaatccaagaacaatttctcgcacttttgaatcaaaacaaaaagaaagacctttttcggggaacaacgacagttggtcctcaccgtgacgatctttccttttttattaatcagaaaaacgtgcagacttatggatcgcaaggacagcaaagaacgactgctctaagtgtcaaattagcagaaattgatttgatcaaagaagagacaggggaatatccaatcctattattagatgatgtgatgagcgagctggatgataatcgtcagctccatctgctggaaacaatcgaaggaaaagttcaaacgttcttaacaacgacgacacttgaccatgtaaaaaataaaatgactgttgaacctgagattttttatgttcgacaagggaaattaaaaggagaagaaactgaatgacagaagaaagaagtttagtagaacgcgctaaagaatatgatgccagtcagattcaagtacttgaaggacttgaagccgttcgtaaacgacctggcatgtatatcggttcgactagttctgaaggtctgcatcaccttgtttgggaaatcgtcgataattcgatcgatgaagtattagcaggttttgcaacgaaaatccatgtgattatagaaaaagacaacagtatcactgttattgacgatggacgggggataccagtagatatccaagcaaaaaccggacgtcctgcagttgaaacggtctttactgttttacatgctggaggaaaatttggcggtggcggatacaaagtttccggtggtcttcatggagtgggatcttccgtcgtaaacgcactttctacgcaacttgatgtcaaagtatacaaagaaggaaatgtgtactatcaagagtatcgtcgtggagctgtagtggacgacttaaagatcattgaacaaacggatcgccatggaacaacggttcactttacgccagatcctgaaatttttacagagacaactgagtttgatttttcaaaattggctacccgaatccgtgaactagctttcttgaaccgcgggatgcgtatctcgattgaggacaaacgagaagaagaaccagtcatcaatgaataccattatgatggcgggatcaaaagttatgtcgaatacttgaatgcaaacaaaaccgtgattttcccagaacctgtatatttggaaggtgagcagcaagatatcgcagttgaagtctctatgcaatatacagacggctaccattccaatatcatgagttttgccaacaatatccatacgtatgaaggcggaacacatgaatcaggattcaagactgcattaactcgggtaatcaatgattacgctcgaaaacaaaagctgatgaaagaaaatgatgacaacttgactggtgaagacgtgcgagaaggattgacagctgttatttctatcaagcatcctgatcctcaattcgaaggacaaacaaaaacaaaattgggcaattccgaagtacggacagtcactgatcggttatttagcgagcatttcatgaaattcttgctagaaaacccaagtgtgggccgtcaaatcgttgaaaaaggattattagcttccagagctcgtctagcagcgaaacgtgcgcgtgaagtaacgagacgtaaaggtgctttagagatcagtaatctgccaggaaaattagcagactgctctagcaacgatcctgaaaaatgcgaattgttcatcgtcgaaggagattcggccggcggatcagctaagcaaggtcgtaatcgagaatttcaagctatcttgcctattcgtgggaaaatcttgaatgttgaaaaagcaagtatggataagatcttggcaaatgaagagatccggtctttatttaccgctatgggtacagggtttggagaagatttcgatgtatcgaaagctcgttatcataaattagtgatcatgactgatgccgatgttgatggtgcgcatatccgtacattgctgctgactcttttttaccgttacatgcgtccaattgttgaagctggttatgtctatattgctcagccgcctttatacggggtaaaacaagggaagaatatcacgtatgtacaaccaggaaagaatgcagaagaagagttgaaacaagtcgttgcttcacttcctgcttcaccaaaaccaagtgttcagcggtataaaggacttggagaaatggatgatcatcaactatgggaaacaactatggacccaagtaatcgaatgatggcccgcgtcagcgtggacgatgctattgcggcagaccagatatttgaaatgttgatgggggatcgagtagagcctcgtcgtgcattcatcgaggaaaatgcacattacgtgaagaacttagatatttaatcatgaaggaggaaaaagaatgagtgaagaaatcagagaaaacatccatgatgtcaatctaaccagcgaaatgaaagactccttcatcgattatgcgatgagtgttattgtcgcacgtgcactgcctgatgtcagagatggtctgaaacccgttcatcgccgtattttatacggcatgaacgaattaggtgtgacaccggataaagcccataaaaaatctgccagaatcgtcggagatgtcatgggtaaataccatcctcatggggatagtgcgatctatgagtcaatggtacggatggcgcagccatttagctatcgttatatgctagtggatggccatggaaactttggttctgttgacggtgacggtgccgctgctatgcgttataccgaagcacggatgagtaaaatcgctacagaaatgctgcgtgatatcaataagaacactgttgatttccaaagcaactatgatgacacagaaaaagaacccgttgtattacctgctcgcttccccaatcttttggtgaacggaacgacggggatagccgtgggtatggcaacgaatatcccacctcataatttatctgaggtagtagcggctatcgatttgctgatggataatcctgatgtgacgaccaatgaattgatggaagtattacctggaccagattttccaacaggtggtttagtcatgggaaaatcaggaatccgaagagcgtatgaaacaggtaaaggttctattaccgtacgtgcaaaagttgagatcactgagatgccaaatggcaaagaacggatcctcgtgacggaattaccttatatggtcaataaagccaaattgattgaacggatttctgagttgcacagagacaagcgtatcgaaggaatcacggatttgcgggatgaatcttcccgtgaaggcatgcgaattgtcattgacattcgtcgtgacgccagcgcatcagttattttgaataacttatacaaattgacatccttacagaattcatttggattcaatatgttggccatcgaaaaaggcgtgccgaaagttttaagtttgaaacaaatccttgaaaactatatcgaacatcaacgcgaagtcatcacacgacggacggtctttgaaaaagaaaaagcagaagcaagagcacacatcttagaaggtttgcgtattgctttggatcatatcgatgaaatcattgcgattatccgcgggtctaaatcagatgatgaagcaaaagcaacaatgatcgaacggttcgatttatccgatcgccaatcacaagctatcttagatatgcgtttgcgtcgattgaccggtttggaacgggaaaaaatcgaaaatgaatatcaagaactattgaaactgattgaagatttgactgacattctggcaagacccgaacgtgtcacggaaatcatcaagaatgagttagcagacttgaatcaacgatttggtgataaacgacgcacagaattactagtcggtgaggtcttaagtctagaagatgaagatttgatcgaagaagaagaaatcgttattacactgacaaacaatggttatatcaaacgtttggcaaataatgaattcagagctcaacgaagaggcgggcgtggtgtccaaggaatgggtatccacaatgacgacttcgtcaagaatctagtttcttgttctacccatgatacattgttattctttacgaataacggaaaagtgtatcgggcaaaaggatacgaaattccagaatacggacgtacagccaaaggtatcccaatcatcaatttgctgggtatcgactcgagtgaaagcatccaagcaattattgcggtgacgggagaagcagaagaaggccactatctcttctttacgacgcgtcaaggtacagttaaacgtacgtctgtcactgctttcgctaacatccgaagcaatggtctgattgcaattggtttgaaagaagatgacgaattagtcaatgttctattgacagatggacagtcaaatatcatcattggcacacataacggctactctgtgaccttcaaagaggaagcagtccgcgatatgggacgtacagcttccggcgtcagagggatacgtttgcgtgaggaagactacgttgttggggcagccctgatgaaggaagaccaagaagtactagtgattacagaaaaaggttacggaaaacggaccaaagtatcggaatatccagtgaaaggccgcggtggtaaaggaatcaaaacggcgaatatcactgaaaaaaatggtccactagccggattgaccactgtttctggagatgaagacatcatgctgattacagataaaggtgtgattatccgtttcaacgtatcgactgtttctcaaactggacgttcaacattgggtgtacgtttgatgaagatggaagctgatacgaaagtcgtcacaatggcagcagtcgagccagaagcggtagaacaaacagttgaagagcaagcaacagaagaataatcataaagatgaagtgtttaagttaacaaagaggttgtgacaaaagtggtcagcttcaagaaataagaaggaattcacgaaaattgcttctcaaatttttgtgaaatttcggcttatttttcgaagaagttacttctggaacaccgtgtaggaggttatgaaaaagctgctctgcatcaagcagtaagaacaatcagacaaaaatagcattccatatttttcatctgattgggcttagtgccatagatgcaagcttttgaacaccgtttaaggaagaggtcgtgagtctgccgtttcactctgagtcacaaggagcaatttcaaaaaaatagcttctcatgtttgttgaatattgtgacttgtgaccgaggagttggcaggagaacaccgtttattcgaaaaaagggaactgcgacaagacttttgtcacagttcccttgcttgcttttttgattaattgaatttctcttaaaatatttgaaactgtttattctgtattgcttttgaccaaaatagagtgtataatcaaagcttgtgagtagtctaattaattagataactctccttgctcttaggaacctaagagccgaaagtccacagggaggtgaatatcaatggaaaacacgaaatatgaaatcatgtacattattcgtccaaacattgatgaagaagcaaaaactgctttaatcgaacgtttcgatgcaatcttgaaagataacggagcagaagttatcgaatcaaaagattgggaaaaacgccgtttcgcttatgaaatgaacggttaccgtgaaggtatctatcacatcgttaaagtatcttctccatcatcagcaaatgctgtcaatgaatttgaccgtcttgctaaaatcaacgacgacatcattcgtcacatgattgttaaagaagaagcttaattgttgtttcatgtgaaacaatagaaaaacgatgagaggagatgactattttgattaataatgttgtattagttggacgtctgacgaaagatccagatttgcgttacacagcaagtggtacggcagtcgcaacatttactttggctgtgaatcgtaattttacaaaccaaagcggcaatcgcgaggctgattttatcaactgtgtgatttggcgcaaatcagcagaaactttagcaaactatgctcgtaaaggaacacttttaggtgttactggacgtatccaaactcgttcttatgataatcagcaaggacaacgtgtatacgtgacagaagtagtagctgacaacttccaattgctggaaagtcgttctgcatctgaaaatcgccaacaaagcggcggattccaaagttctggtcaatcagctggcggatttggcggaaacaataactctaatcaaacatctcaatcatccaacggtatgcctgatttcgaccgtgatacttctgacccattcggctcaagttcaacgatcgacatttcagatgatgatttaccattctaaacgaatttgataggagggaaatagaatggcacaacaaagaagaggcggacgtaaacgtcgtaaagtagattacattgctgctaaccatattgaatatatcgattataaagatatcgaattactaaaaagatttatttcagaacgcggtaaaatcttgccacgtcgtgtaactggtacaggcgctaaaaaccaacgtaaaattactgttgcaatcaaacgcgcacgtatcatgggcttgctaccttttgttagcgaagactaataaatccgaggaattgaatgactgatccttttgatcagctattcaattcttttttttctgtaaaaataaccgatattcgtttagtcgcttgaatgacgaaagttatggtaaaatcaagttagtcatatatgggaggaaaattatggaaaataaaaacaatcatttatccccaaaacctctcttccttatcctgtttatactaatcgaagtattggtagtcttaattttaccatttcgttttgttagcgctttggtcattcttttgatgaatttatggggcgttcgctattggttgaaaatgaaacgctggcttattttaaataaacgtgaaaaaatccagcaggcttcgaccgtagccgaaacaaatctggcttatgtctcagaagtcatgcctgtaggagtgattgcttatcagccatcaagccaaaaaatcgaatggctcaatcctttagcattgaaagtcaaagatcaaagtggattaacagaggaagaattgttagatactttttttactgcaaaagaaaaaaagaaaaaccaagtctatctagcagataaaacatttcagtttgatatggatacagtaaagggtgtcgtttattttaatgatatcacccaaaaccagttgttgaaacttcatcaggcgaacagtcagccagtaatcggtattttatctattgataactatgcagatgctattgataaattggatgataaagagatttcttatttgaactctttcgtcactacactagtttctgactggatgaatgaataccatgtctttttcaaaagaatcaacgcagaacggtttttcttcgtcgcgcagatgatcgatttgaaaaagatgatggataaaaaatttgatttgttggaccgctttcgagcagaagctgaaaaacagagctcgcctgtcaccttgagtatggggattgcttatggcgcaagatccctcgatgaaatcggtggagaagctcagaacaatttagatgttgctctagtccgcggaggcgaccaagttgtcgtgaaagaggtaaaagaaggtgcgaaacctgtttattatggcggtaaatcagctaagaatgtcaaacgcacgcgtgtccgttctcgagcgatgagtactgctttgcgccggatttttgatgaaacaggcgatgtgttcatcatgggacataaatttccggatatggatgctttaggctctgcttttggtgtcagttgtcttgcacgcttcaaccagaaaaaggcttatatcgttatcaacgagaacgaaatcattccagatgtagaacgttgtctcgaagaaatccataaacatccagaattagaaatgcaattgatctctccagaacgcgccatagagctgaaaaaagatgaagacctactcgtgatggtggattatcataaaccttctctatcgatctctcagagcctatatgagcaatttgataaaatcgtaatcattgatcatcaccgccgaggggaagagtttccaagcaagcctttgctgacttatatcgaatcttcagcctcttccgcttcagagctagtttctgagctgatccaataccaaagcagcaaaacgaatcgcttagatcgctttgaggccacactattacttgcagggatggttgtagatacgaatagtttcaatgttcgtacaactgcacgaacttttgatgttgccagctatttaaggtcttgtggagcagacgcatccttagtacaatatttattgagctcggacttagcgacatacttggaaatcagtcatttgattgctggaagcgagtatgtgacttctgatattgttgtggcggcaggaacagatgaaaaagagtataatagtgtcatagcggcaaaaacagcagatacactgctttcgatgatcaatatcaacgcagctttcgtcattacgaagcggacagacggattgattgggatcagtgcccgaagtaccggtacgatcaatgtccaaatcatcatggaatccttaggtggtggaggacacttcacaaatgcagctactcaactggagaatacgacagttgaagaaacaaaacagaagctttttgctgcaatcaaagaaaatatgaatcaaatatatgataaggagtaatccaaatgaaagtaatttttttacaagatgtaaaaggaaaaggtaaaaaaggggacatcaaagaagttccagcaggttatgcacaaaattatctaatcaaaaataacttggcaaaagaagcaacgaaaagtagtatcagtcagttagctggacagaagaaagcccaagaaaaacacgaagctgaaatcttggaagaagctaaaaaattaaaagaattcttggaaaaagaagatacggtagtcgagttaaaagcaaaagcaggggaagacagccgtttgtttggatcgattccttcaaaacaaattgctgaagggctaaacaaacaatacaaaatcaaattagataaacgaaaaatcgaactagaaaacccaatccgttcactaggttacacaaacgtacctgtgaagttgcatcatgaggtgacggctacgatcaaagttcatgtcgtacaagaataacaagttttgatagtgatgttcagctggtaagaagaaccagaaggagaaaagacaaaccgaaatttatctgagaaaagcagctgtagcaacaaaagcacaagctgcatatcgatttcagattgatttcggtttcttttttgagaacagtaaaatagcatgaagaaaacgagtataataaaagagagctatttttttaggatactttcgatgcgaatgatgacttttccatcattttcttgtaaaatgaagcaattgaagacaaggagcgatacgtatgaatgaagtgtggcaggatcgaatcccaccgcaaaatattgaagctgaacaagcggttctaggctctgtttttcttgatgcagaaacgatcattgatgccatggagtacatagagccaaaagacttttatcgtcgcggccatcaaattatttttgagacaatgatcgagttgaatgatcgtaatgaagcgattgacgttgttactgttaaagaccgactagaacaagcaaatttgttagaagatgccggtggtttaagttacctatcagatttggctttagcagttccgacagcagcaaatatcgtctactatgcaaaaatcgttgaagaaaaatcattattgcgtacattgatccagacagcaacgggtatcgttacaaaaggattcgagcaaggagaagaagttcagacgatcttagatgatgcagaacgcagtatcttggaggtttcggaaaaaagaaatcgaagcggctttttatccattgctgaagtactgaactcaacgattgaaaatatcgatcgactagctcaaaataatgaagaaatcacaggcctaccaactggctatcaaggtctggacaaaatgacagcaggtttccagcccgaagaactaatcattctggctgctcgtccggcggtaggtaaaactgcgttcgcattgaatattgctcaaaatgtaggaaccaaaacagatcgttctgttgcgatattcagtctggaaatgggggcggaatctcttgtaaatcggatgctttgtgcagaaggttcgattgaagccagccatttgcgtacaggtcagctttcggaagaagaatggtcgaatctaatcgttgcgatgggaagtctttctcgagcaaatattttcatcgacgatacaccagggatcaagatctctgagatccgcgcgaaatgtcggaaactagcgcaagaaaaaggcaacctaggcttgatattaatcgattatttgcagttgattgaaggtaacggtaaagaaaaccgtcaacaagaagtatcagatatctctcgccaactgaaaaaactggcaaaagaactgaaagtacctgtcattgctctgtcgcagttgtctcgtggagtagaacagcgacaagacaaacgtccagtactaagtgatattcgtgaatccggatcaatcgaacaagatgcggacatcgtagccttcttgtatcgggatgattattatgaaagagaaggcggagatgacgatgatggaaatgagccaaaaaatgacaacgtcatcgaagtcatcatcgagaagaaccgaagcggtgcgcgaggaacagttgaactgctgtttatcaaagaatacaataaattttcgtcgctttcgccaagagaagaattttaaagaagaggttgtggaagcagcgttcagccttgcgcaatgaccaagagcactcgtataagatgcgacgagtaactgcaaaagtgactagagcacttaattaaaacagatttccaaagggattgtgacaaaagtcttgtcacagtccctttttccgaataaacggtgttccagaagtaacttcttcggaaataagccgaaatgccacaaaaatttgagaagcaattttcgtacattccttcttatttcttgaagttgaccacttctgttacaacctcttttttaacaatcattctaaaacgataaaagttcgttttttaagcgtttttataaaataaaaataaaaatcattcgattttatttgaattatgtatctattattgatacaatggttcaggattaaataatatagaacgaggtgttcacatgtcatctgtagtagtagtaggtacgcaatggggcgatgaagggaaaggaaaaatcacagactttctcagtgaaaatgctgaagtgattgcacggtaccaaggtggcgacaatgcagggcacacaatcaaattcaacggtgtgacttataaactgcatttgattccttctgggattttttataaagacaagatcagtgtgattggaaatggcgtcgtagtcaatcctaaatcattggtcaaagaattagcttatttacatgaaaaaggtgtagaaacaagtaatctgcgtatttctgaccgcgcacacgtaatcttgccttatcatatcaaattggaccaattacaagaagatgcgaaaggtgaaaacaaaatcggtacaacgatcaaaggaatcggaccagcttatatggataaagccgctcgtgtaggtatccgtatcgcagacttattggataaagaaatttttgaagaacgacttcgtttgaatctagatgacaaaaaccgtcaatttgtaaaaatgttcgattcagaaccacttgattttgacgatatttttgaagaatattatgaatatggtcaacaaatcaaacaatacgtcacagatacttcggttatcttgaatgacgccttagatgcaggtaaacgagtgttgtttgaaggggcacaaggagtcatgttggatatcgaccaaggaacctatccttttgttacttcttctaatccagtagccggtggtgttacaatcggaagcggtgtaggaccttcaaaaatcaataaagtcgtcggcgtctgcaaagcctatacgtcacgtgtcggtgatggaccatttccaactgaactatttgatgaaacaggagaacaaatccgcaaagtaggacgagaatacggtacgacaactggacgtcctcgtcgtgtcggttggtttgattctgtagttatgcgccattctaaacgggtttcaggtattaccaacctatctttaaactcaatcgatgtattaagtggattggaaaccgtaaaaatttgcacggcttatgaattagatggcgaactaatctaccactatccagcaagcttgaaagagttgaaccgttgcaaaccaatctatgaagaattgccaggctggtcagaagatattacaggatgcaaaacacttgcagaactgccagaaaacgcacgtaactatgtacgtcgtatctcagagcttgttggtgtacgtatctcaacattttctgtcggacctgatagaacacaaacaaacatcttagaaagcgtctgggcgcaaatctaaggataaaaacgacgactgaatcaggacgttcttaccagagcgagtcgaagtgtttatctatacgataataataacttgaacactgtttattcagaataagggactatgacaaaaaccgtgtcacagtcccttttttcgaataaatggtgttcaaaggcttgcatctacggcactaagcccaatcagatgaaaaatatggagtgctatttttatctgattgttcttactgcttgatgcagagcagctttttcacaacctcttccttaaacggtgttcaatcagctgaccctcggcattagctcaacaaacggcaaaatatgaggaactatttttccgtttttttctctaatactcaggtcaaaacgctgatttcacaacctcttattcacggtggtccagaagtagcttctacggaaataagccgaaattccacaaaaatttaagaagcaattttcgtaaattccttcttatttcttgaagctgaccacttctgtcacaacctcttattttgattagaacttgcgaaaataaaccggttaaagtgtgtctagcgcaagagatttgctataatagacgataagggtaaaatgtaacgagaaggggttgaaaaatgtgtatcaaattgtaacagattcttgttgtgatctgccataccatgtattagcagaagaaaaaattgattttttatcaatgaatctccaattgaatgatcaagagttagtagatgatctcggaaagacattcaattatgaccgctacatgaatcagctgaaaaatggtgcgatgcctacgacatcacaaatcaatgttggccgatatttagaatttttccgttcttatgcggaaaaacagattcctgtcttatatgtggctttttccagtggattaagcggctcttacagcagtgcgcttcaagctgttgaattactgaaggaagaatatgaagaccctgagatctatgtttttgatacaaaagctgcaagtatcggggaagggcttttagtattggaagctgcaagattgaaaaaagaagggaaaagtatcgaagaaaccttagagtggctggaaaaaaattatttgaaagtccattcatgggtaactgtagacgatttgaagtatctagaacgaggcggtaggatttccaaagcaagtgctactctgggcagtctattgagtgtaaagcctattattacggtagataaagaaggaaggctgacgaatgttgacaaagttcgcggaaggaacaagtcgatccagacaatcgtcaatgagacagtaaaaacaatcgttgcgccacttgatcaaatcgtttatgtggcttacgctggggatctagagagcgcggagaaggcaaaacggcttttggaagagcagataaagatgaaagatgtcaagctttatcccttaggaccaacgatcgccagtcacacaggctatggctgtatcgcgattttttcgatgggaatcagtcgataaaagcagtaactcattctgtaaaaatgcctaggatttgaatgtaacaaaaatagcgactcttaaaagatagatgagcattctatctcttagaggtcgctgtttttttgttttttaagctaaataggtcgttacgcccataactcgttcaattgtttttgaatatctgtgttttccaagaattcatcatatgtcgtatcagcccgatcaatcacacctttatctgaaacagcaatgatacggtttgccaatgtttggataaattgatggtcatgagaggcaaacaggatcgagccagtaaatgccatcaagccatcattcaatgcggtgattgattctaagtctaaatggttcgttggatcgtctaatacaagtacgttagctttcgaaagcatcatttttgagagcatacaacggactttctctccaccagataaaacatttactggtttcaatacttcttcaccagaaaacagcattcttcctaagaaacttcttaagaaggtgttgtcatcttcttctttacttgcatattggcgcaaccagtctaaaatcgttagatccgtgtcgaattctttcgttgtatcctttggtaaataagaatgactggttgttactccccaacgtactgttccagtatctggtgtaatttcacccattataactttgaatagcgttgttgttgttatatcattttctgcgacaaaagcaaccttgtcttctttgtttaaattaaaagatatatcatctaagattttctttccatcaatcgttacacttacattttctacctgcaataagtcgtttccgatctcacgttcaggtttgaatccaacgaatgggtaacgtctagaagaaggctggatatcgtccaaagtaattttttcaagcatttttttacgtgaagttgcttgttttgattttgatgcattcgcactaaagcgagcaatgaattcttggagctctttgatttgttcttcttttttggcatttgcattcgcttggagtttagccgctaattgactagattccaaccaaaaatcataatttcctacataaagtttgattttaccaaaatccagatccgccatatgtgtacatactttgttcaaaaagtgacggtcatgggagacaacgatcacagtattttcaaaattaatcaaaaattcttccaaccaattgatcgattggatatccagaccgtttgttggttcgtctagtaaaagaacatcaggtttaccaaatagtgtttgtgctaacaacacttttaccttttgtccgccagtcaattcactcatttgctgatggtgcaattcttcagggatgttcagtccttgcagtaaaacagctgcttctggttctgcttcccatccattaagctcagcaaattctccttctaattcagctgctcgaataccatcttcgtcagtgaaatcttctttcatgtaaattgcatctttttctttcatcacttcatacagacgcttgtgtcccatgatgactgtttcaagtacagtatagtcttcatagtcgtaatggttctgtttcaatacggccatccgttcatctggtcccatagtaacggaacctgtggaaggctgcagatcccctgataacactttaaggaacgttgatttacctgcaccatttgcaccaatcaagccatagcagtttccgggggtaaatttaatattcacatcatcaaatagtttgcggtctgaaaagtgcaaactcacatcatttacagtaatcaatttttttcctcacttttatcattattagtttttgacaagtcttatagaattatataggggaaaggtaaaagattcaaggcaatcgaacattctttgtgtttcacgtgaaacagaatgaagaaaataaacataaaagaggagtagaaatagctgctataggattttttagtttgaaacagcataatttttgacgttatttataagaaggagtactataaaactgtaaaagaaatgaaagaaggatagaaaatggatgaaaaaagaaccatcgactggggctcattgattttgggaattttatttgtacttgtctcattgttatcatttcaagaccctgtcggaaatttagttgcaattgtagtagtctttgcgatttttgcatttattaaaggaatatttgaactgtttgtacgtaacagattaaaagagctaacaggatataaaggaaaaatgcccttaataatcgggatcatcgatattctagttggcgtctttttcttattcaatattggtgcaggagtcgcagcattaccttttgtttttgcagtatggtttattgctgattccgttttagcgttatttactgctgacttggcaagaggagtaagtgaaggttattattggtttacgatcatcgtcaatattttaggaattttattaggaattttcttattgtttaatccaatttcttctgcgttgacattaagctttttagttgggttctattttatgttattcggcatcacacatatcgtctatgcgtttagataagtgaaatcaaacaaataaaaaagccagcttccggtaacagtttgactgttgcaattggtagctggcttttttatcatggacaaatatgcacgaggtaatctttaggtgtcgagaaaaatttatgcaaaaatgtgaaaagcaatacgcataaattttatcttaatacttgaaacataccgcagttatcacaacctcttgatatacggtgttcaaaagtttgcatctgcggtaataagcccaaccaaacgaaaaaatatgacgagctatttttgtttggctgttcttattacttgatgcagggtagctttttcacaacctcttgatacacggtgctccacctgctgcttctcggtaataagatcgccgtcctagaaaatatgaggaactattttctgtccatcgttcttattactcgaagcatagcgcagtttttacaacctcttttcatataattcattcaatactggcaaatcatggacttcatatttttctttgaatgcttggatttcttcttcagaatattttcttggatctaaatgcagatcttctactggcaatgggcgcttgttattgattttcacatcgatcactacaggacgatctgattttgcggctgcatcaaaggcaaaccgaagttgcgagtattctgtgactgtaaagctttttgctccgagtgcttctccaactttaccgaaatctgcatcttctaaaaatacaccgaatttcttttgttccgtatcttcttgttctgcttcgatgaaaccataagaatcattagaaaaaacaacattgataattggaagctgatatttaacttgtgtaatgatatcttgcatgaccatagcaaatccgccatcaccacttaaggtaaatacttgtttttctgggtagcttagttgtgcggcaattcctccaggcacaccattacccatagtggcgaaccatccagaggttgtatgtttttgtttaccgttcatatttaataagcgaatagaatggatagtcgtgttaccgacatctgtgacgaaaatcgcatcgtcttcagcaatccgattgatttctttatagacagcctctggtcgaatcggttcttcctcacgatcttcaaaagatttcaaccaatttacccattttactttattttcctgatttgctaggtaccagctatcagcaggacgagtatcacctaattcgaccagtctttgcaaagctgtgtttgcatcaccgagaatcgacagagatgtttcatggcgccgcccgaattttgacgcatcaatatcgatttggataaattcagcagttggattaaaaaatgcacgtccaaacgggaagtcgctgccgacaaataagattagatcggcttctgccaatgcttcatttccgggtttagtagcgacacgtccagcaaaaccaagaaagttttcataatcatcaggaataattccttttgctagaacggaagcgacaataggaactgaaaaatgttctgaaaattctttgatttgcggaaatccgtttcgcgttccttgaccaacataaagaactggtttttttgctttttcaagataaggcaaagcagccagcaaatctttttcttctggtaatatcacacttgttttatgagtgtgagcagtagagaaaggttgttcatcaatttcttcaaacccaagatcaacaggaatagttacgatagccacacctttatgctcataggcggctttaatggcttcatctacgacatgtggaagactttggggcgtcatgactgtacgattgtatacgctgacatctgcgaaaataggattttcatttaattcttggaaagagttatagttcatggatgtagaagcaacttgtcctaagaacgctactagaggtacatggtccatctgtgcatcatacaaaccattgatcaaatgtgtcgcaccaggtcctgcagagccgaagacagcgccaactttcccggttaattttgcatctgcggcggctgctagtgcaccgacttcttcatgacggacttgaatatatttgatttcgtttttttcgtgatatagcgcatccataatcgaattgaaagatcctccgggaatgccataaatatggtcgatgccccagctttcaagaacttttaccattgcgactcctgcattgatttttgacatggtgtttcactcctttagcaatgatgattcataattttttggtatctagagtatagaactttttatcgaaaatcccaactaattcgtcttttcacaaaaatgtagtcatgtttttgggaatatgctagagtagtacataaatagattcaagagaggggaatggcatggttgaatggctattgaggcttgatccttggcagcaagcacttgctgggacagcttttacttattttatgacagctcttggtgccggattggtttttttctttaaagaaatcaaaaaagaagtgctaaatttgatgttaggatttgcttctggtgtcatgattgctgcaagtttttggtccttgctcgatccagcaattacaaaagcagaagaaaatggagatattgcttggctagttgtaagtattggatttggtttaggtggggtgtttttatatatggcagataaaacactgccccatatgcattttggaccgcaacatgaagcagaaggattgcctacccatttaaagcggacaatcttgcttgttttttctattacattgcataatgttcctgaaggtttagccgtgggggtagcattcggtgcagcagcaactgcgaataatccgacagccgctatactagccgctgtttcggtggcgctaggtattggtatccaaaacttcccagaaggagcagctgtatcaatcccattgcgacaagaaggtctgagccgtaaaaaggcctttgtttacggacaagcttctggaatcgttgaaccaatcgctggggtgattggcgcactactagtaacgaaagtggagctgctgcttccttatgcacttgcttttgctgcaggagcgatgatttatgtcgtggtggaagaattgattcccgaagcacagcagacattgtccagcaaacgtcattttgcagtttttggtgttatgagcggatttatcattatgatgatcttggatgtagcattaggataattgggaaaattcatatatgatatatcaaatagggtcgcgaacttatgtcgtgaccctatttttaagtaagttatatcataacggagtgattatgtgattcattaataatagttttttcgatgtgtattgcctttgatccaacgaacgagccagatgataagtgcgattggaatcaaaactttgaccgcaaaccataaaaggccacttacgacactaacaaaaagactgatgacaaagctagcagcaatcaacactaaaagaaccatgaagatatttaagaacatatttttttgacgcatacaaaaccctcctcttgttcattctttactatagaaaaagtataacagggattctctaaaaacacctccaactgcagactgatttttacttcatctgcttaaatgatcaaacaattgctttttcccttgtttatcatctaaaatagagcggaaaaggaggagaatatcatgcctaaaaatcgtcttgaagcatttacagatgctgtaatcgccattatcatgactattttagttttagaacttcatgaacctaacggagatacgtgggaggcgctcgcagcattaggctaccgattttttatctatattgtcagtttcatcatcttagcgatttattggaacaatcatcatcatttatttcaagttgtacataagataaatggacgggtcttatgggcgaatagtttctttatttttgcgctttcactttttccatttgccacttcatggatcagtgagtacatcaatagtctggctccagaaatgacttatggttttgttaccttgatcgctaacattgcgtattatatcttggcaaaagaacttgtcaaagcaaataagggtcacgagaaagcattgaaggcgatgctgaatgattacaagaaatcgtacttatcgattggcttgaatgtcttaggaattgtcttaggctatttagtagcgccagtagccgtgctgatcgcaaacatcgtgattctggctgcttggatcatccccagccgtaccatcgaatcacaatatcggtaaaatgatctttgtttaaaatttaagagaaaaatatagaaaaaataatcaaacgatcaaatatccgagtgatactagtattcaaagagggatgcagatggatcaaaaaagacttcatgtaggactgattactagttttgtcacgatgcttatttatttggatcaaggtcatttgacttggacagtagttagtgtcacggtatttttgacattattcgcagcaataaaaaaataaacatctttatgtaagctaacattctatctacttaataaaaacaggtttacagcagtatgattctgttgtaaacctgtttttatttgtggaaaatttttatttttaggaaagtgtattgaaatataaatcgttagtttttccacagtggataactttatgatagctaaaaaagcaatagattagttaaaggaggcatatagctttcttttgtcaggggatatacaatagaaatgaataaatattaacgagaattcagatggggttaaaaaagtaaattcagaggagtgaaaaataactaaacaactatatttaacttgttatttaatagttaaaaaataacgatacacttgttttgatttctctgctacttctaaaaaactgctgctttttcctttgaaatgtcttcaaaaagtaggatcaggtaaaatctactggcagaaatcaaggaaaaagataccttcataagagagaaaaatgatagaaaagaagaaaaattatttatagaacaagctttttgtaacaaattaatatacctatacggggtataaagaagagcgaagatttctcaatcgatttaagtgtcgaataggaaaatgctaagatttaaagcatgtaagctaaaaaaataatcatttttgattaaaatgcgtacttaaattatgaacggcttatggtaatacttgtttttcaagtaaaaagagcaaacctaaccaatttaacgaataaaaagggaaagtaaacaaaatatatatttctgtactttttgtgatagcgctttaatgatacacttgaaaggaggaataagcctatctaagagtttctttataaactatcagacaatgtttcctttaaacatatggaaaactggagcaggtattctactccagtcatatgagtgtgttgatactatttttttgaatagggattgctaaatggaaaatcgtaccctctttgttgcttttaactcgaagaagccaatcattttttcgaacgagggaggcaacaataaatagtccgagcccagttcctccagctgtagttttcgttgtaaaaaacggagtgaatatcttatctcgtatttcttctggaataccaggtccattatctgctattttgataaagacccaattttttccttgttgcgaaacagggatatccgtcatgcatttagaaagttccgcgcatttttttgatgtgatgtgtatatgggcatcgttttttgcttgataagcgttcattatcaaattatagaggacgatttgcagatcttctttttcaaatctgctacttccattagcggaaagttcagtatctagaatgattgtctcaggaagtaaaatacgaatcgtttgtatcgcttcttgaaccgtttctgatacttgatggactgactgttcccctgaatgtacttttgaaaagcgcaagacattggtagaaagttgcagtcctttttctgcagattgatagatttcttttaaatcttcagttaattgttcatcttcttggcgttcttctatcaaaagctgtaagttaccgatcatgggtgtcaagaagttgttcatgtcatgaacgatcgtagtagtcaataaaccgattgtctctaatttggattcttgaaggatacttttttccagctcatatttttcttgtaaaagcagttgtcgttcttgtagacgaatattctctaagtaagtttcatttcgttttacataatagcggatggaaacagttaacaaaaaaataatgactagcaagaacattaacaatcctagtgtaatcaggttatcctgtaggagcagcccatttctttcgtaataatcttcattgctagcagcgataagtcgagcgttaccaactgtaaaccactcataggaagaaatctttatcacttgtttaggatgtttttttgtccaccagtatgaatagtaggtcaggctgccttttttatgtttcagttgttctttttctagctgctccaaactagcaaaatcaaaagttgggaatttttcttttcgatcatctaccactgttaagccaatctgttcctgagaaggatgcatgatgatcttcatttctgcatttttgaccattgtatagccgatgactgcagaatcttttgaaatattggtctgataaatctgttgtaaatcaagcggcatgacgagtagaacttgttttttagaggcgagagaaacttgctggtataaatttatgtaagcgtgatgttgatggaaatacacatcaccattttcaatagtattctctgacaaagctgttgaaaacaaaggatcagctgttagggtttttggtatatcagtaaaggcactctgaaatttatattggtgaataagttgaccattagaagagaaaaggaaaataccgattgcagctttttgatttttagatatagagacatcagataaatcagaagcaagttcctcgttttttatttgtccgctatacttgtccagtaagcattgataagaaaaaatcttttctttgatcaattcaatagcagaatgattgatttgagctaattgcacttctgcagattttacagctttttcttgtgaagtatgaaaactggcaagtgtaaaaataattccgctgatcgtcagcagcaggatcagtgcgatgggagcatagagacctttgtttgtaggttttttcattgttcgttcctttctgttgctaatctatcaaataaaaatagaggaggagtttttgtgcgaaatgaaaaaattttagttgtagacgatgagccggcgattcggagactgatttggaagtctctacaatctacaggcattttagtttatcaaagcgactcagtagaaaagacgattgaaatcatgtcacgtgtgacatttgatctttttttacttgatatcagccttgattatgaaaacgacggatatcatttagcgcaattgatccgagaagaagatctagccgttccattactttttctaagtggtaagaaaagcgaagaggcgatgattaccggtttagaagtaggagcagatcaatatttgactaagcctttttctttagatcttttacgcgcacaagtgacagcagctttagatcgtaataaagcgattcgcaaccagtctgcccatcctataaaaggagagatcaaagccggagattttcgatttgacccaatacgttatcaattgtttaaaaaagattgtctgatcaaattatcatctaaagaacttcagttgatccgttttttcatggaaaatccagatcaggtcttttccaaagaacaaatttatcgcagtgtttggaatgatgagcattttgatgccaatacgatcatggtttttatcaatcatttaagaaataaaatcgaagccgaccccaaaaacgcaaagtatttaaaaacgatttgggggatcggctatacattcttgcctgatggagacaaggaatgttctaaaaatgaaaaataaatacttaaagcaagtagatcagcagaaccgccggggcttaaatgccgtttggtcaatggaggtcataaattgtcagttcatggataaatgcttgcgctgataaattttttttgaacagatagctgctttcagcttgtacttgctttaaagcttcaaagccgccacgatggagcaaattgctgtcttgtgtctcactcatcaaaaaaatcaatgcatataagtattttatctcttggttgttctgcgtatgctgccgtaaaaaatctaacagcttatttagtgtagggtagccgcttgctgcttcgcctcggattccggtactgccgtgttcgagataaagtttttctccataagtcaatgattctttatctttacatgagaggtgctgaaaatctttttctactattccggagacgatctgctttgctattcgaaggacagactcagtatctttctttgtaaagggaagggtagcaccttttttgatatatagccctgtagcacctagaagaatcgcaaaagagaaattagcacccttatgtgtatttataccatttgttgcgtgtagcattgctttttctgctttttttccaatctttcgtaactgttcaaaaagtaaaggagcatctcctttatgattataaccagcctctgcatattgataaaaaaagggggctaaactgacgatactgtcgagaaaagtataaaaatccatatcgtgatgagcgccattcgagtagcgatcgaccagtccgggttttggagtaagtgagacttcgtatagcaaagccttttctgcataactactgatggtctttaataaaggattagtcaattttttgccgctccatttcttctagaatgaattttagcgagtgatctaaatgttcatggatcaataaagtgagttgctctttgttttttgttttcattcctcgatagataagccaatgttcctccagggctgtatttctacgtttagaggaacgaatggcaatatcacgaaagtagataaggtaagattgtaattctaatacaattccttttagccgaagcatttggctcttttcataaataaatgcattgaaatcggagaaattttgtagtaattcatctactcgatcttctctatttaatttctccccatatatcaacagcgctttcatttttttaaaatcgtcagttgtcatttgatccatagctttaattgcggcgagtgtatcaagcgattttcgaatatcgtagatttcatgagcatctttcgtacttattccctttactacgacaccgattttaggaacatatgtgactaatttttctgtagttaattgctttagcgcataacggattggggtacggctgatattcaagatctcagaaaattctttttcgttgattcgcgtaccagcaggaatttctcctaaaataatcgtttttcgaaacgcttcgtaaagtaagattttcaaggtcttattttgtgaaaaatcaagattttttttgactgcatcaataatcgagctcatttgccaactcctttctgactatctgaattggattctaaaaatcaaataatcaagcaactaaaggaatcataacgaaaaaaataacaaaaaacaattatatataaaaacaaattttcgatttaatttttttatggttatttattgaggaatgtaaagcggcatatgtcctaaaagaatgatcgtaacgacgaaaatgatgaagatccctaatgcatactttgccgcttctttttgccattgtcccatatctaaacctgtcaggcgcaaaagcagataaataaatgcgactagcggactcagtaaatgaaaagcctgtcctaataaggaggcaagagccatctgcatattagtaaatccataagcacgacctgcttctgctaagactggtaaaacaccaaaatagaaaccatcatttgaaataaaaaatgttcctggtgcagagatcaaagcaatgaccaatccccaaaacccagcaagctgctgaggaataaggtgcgtgaaactattagctaaagcggtggccataccggaaccttggaataagcccatgaagattcctgcggcaaaaacaaggatgactacttgaacagcatcgccaccatttgcgccgattcgttctgattgctctttcaatactgggtaattgaccatcaaagcaatacatgttcctactaaaaacaaaaggataggtggaagagcaatacttgagatgaaagaactggcaactaaccagccgatgagaagaatcgtcaatgcagcattgaataaaaaattttgtggacaacgaatctttagcatatctggatcagaaacagttgtcatttctttgatttctgcatctgtcaactcagtgattccaagcctcgcccgctcttgttttcccatacgacgagcaacaaataagatgacataaagcaatgagaaaaacattcctgggagcaaataagtcaagatatccgcatcaacttctagaactgccattgcacgagcagttggtccaccccaaggaagcagattcatgatagtgttttgaaggatgatcagcacaccaagattcatcattttcatctttagttttttatagattgggatgaacgcagagcaacaaatcaatgtagttgtcgttccatccccgtttagtgatactgctgctgcaacgactgcagtcgccactaggactttcattggatctcccttagcaaaatagatcattttccttgtaatcgggtcaaataaacctgcgtctaacataattgaaaagtataaaatagcaaaaagtagcataatccctgtatttgctgtagtagctacaccttctaagacaaaatcgccgatatttcctttatcggctacaccagctagcatcgcgataattgtaaaacaaagtgggataataactaacgctgtaaatggtgacattttctttttcataatgacaaacataaacacgataatcattgcataagataaaattgtaagtatcatgatagttcttcctctctaattctaaaataaatgtaagcgttgacatgttgctgtaaaaaaataaatacatttggctcttgagccacctcacgcctcctttttgttttttatcaattcattgcttaacgtggttaagaataatcaatatgaaatacagtgaaaagatgaatgatgaaaaagaacagagaaaaaacaattcctaaacttatttcttagctttagcttaataagttcttaacgaaatattaattcgaagaaaatacttatataccaacgttttaaagagttttatttattttttgaaaaaaaggaacagcgaaaaaacaattcaaacataaaataatgctagctgattttttagttatttttataatggaaatgagtcgaataacggagaaaggagaaagggcttgaactttttgaaaaacttgttcaaaaaagaaaagcagcaaaaagaagaatttcacacaaaacatccatcaaacgaagctttattttcagatgaatgggaagcggttccagaatatattcccacaagtttcgaaaataacgagatagtgagtgtaatctctgctgctattgttgccaacgatcagccaaaaagccgattcgtagtcagaagtatccaagaacgcaatcctgaagctgtacttgtctccatgattgcgacaagtatcgtagcaggagaaaaagaaaaatcgcaattcattgtaagaaaaattatgagaaaaaaagagaaataattattggaggtcgaaaaaatgctacgtaaattcaaattaacgattgatggaaaagagtatttagtagaaatggaagagattggcggcactcctcaacaactgtctatgcctagccaatctgttgttcagaagccaataagtcaagaagaggaaacaccgttaaaaagagagacagcaccccttacgccgatagctcaaggaacagatgatgccatcactgctccgatgcctggcacgatcttaagaatacttgttgacaatggggaagctgttcaggagaatcagccattgatgattttagaagccatgaaaatggagaatgaaattgtagctggaaaagctggaacagtagctgctatccatgttactgcgggggatatggtcaatcctggtgatgcattgattacggtttcgtgatcgttaatttaaaaagaggaagtgaagtttatggagacattgattgaaggtgtaactgggatcgcaacggaacctggacgcttagttatgatgatcatcggtggcatactgatgtatctaggaataaaaaaggaatatgaaccaaccttacttgtgcctatgggactaggtacgattttggtcaattttcccaattcaggggtacttagtgcgggcggagaagcggggccgtttcaagttttatttgaaatggggatcagcacagaattatttcctttacttttatttattgggattggcgcgatgatcgattttgggccgttattgcaaaatccgtttttgctgttgtttggggcagcagctcaattcgggattttctttacggtaatcgcggccgtcttattaggatttgatttaaatgacgcagcctcgattgggattatcggagccgcagacgggccaacatctatttttgtagcgaatacgctgaattcaaaatatatgggagcgattatggttgctgcttattcgtatatggcactagttccaatcatccaaccagtcgccatcaaagcagtaacgaccaaaaaagaacgtcaaatccgtatgagctaccgtgcaggcgaagtttctcaaacagctaagatattgtttcctgtagtgatttcggtcgtagctgggcttattgcacctgtgtctttacctcttgtgggtttcttgatgtttgggaatttgttgagagaatgtggcgtgttggatcgattatctattacagcacaaaacgaattagtgaatatcatcagtattttgttaggtctgtcgatttctgtcaagatgcagtacgaagaatttttgaaagtcgatacattgatagtgatcggtctagggctagtagcctttatcatggattctgtcggtggagtgctattcgcaaaactgctgaatctattccgcaaagaaaaagtgaatccaatgattggtgcagctgggatctctgcttttccaatgtctagtcgagtcatacagaagatggcaacagatgaagatccgcagaattttattttgatgcatgcagctggagcgaatgtttcaggtcagattgcttccgttatcgcaggtggactgcttttggcactgctcacataaaaaggaggaataaaaatgacagaagatttatataaggcattcgaattactattgtttggctggggcggcgtattcgtagtgattttgattatttatttagcttctttactgctgaccaagacatttccgataaaaaaataaagaagggcttttatgtacgtacttaaacagctttggctatctaaagaacatcaaacaatgattaagtggcaggaattgttgcatactgtagggttgagtggaaacgagtgtccagattatacagttggtatttatgatggtgatcagttgattgcctcagggtcttatgaagggcaggtcattaaatacattgctgtctgtaaaaaatatcagtcggaaaaacttctgattcggatcatcaaccatttaatcgagaagcttagagaagaaggcaagttgcattattttatttatactaaattggaaaatcaaagagtgttccgatcgttaggttttaaagaagtcttttcaacgagagaagtcgcttttatggagttaggagcaccgaatttcaatgaatacaaagcactactgaaacagtctaagaaggcagaaagtgctagcgggatcgtcataaatgcaaacccatttacgaaaggacaccaatatttagtcgaatctgctgcaaaagaaagtgaatatgtgtatctctttgttttatccgcagaagaatcaatgttttcagcggctgatcgttttgaaatggtcaaaagaggtgtagcccatcttaaaaacgtcagtgtactgccaacaaatgattatcttatatctgctgcggtgtttcctgcatattttttaaaggaaaaagcaccaatcgaacaagctcgtatacaagcaacttttgattcacagcttttcaaagaaaaaatagcaccaattttacacatcaataaacgctttgtaggggaagaacctttttcagaggtcacgaatctttataatcaaaccatgaaagaagtttttgattcggacatttctcttattattcttcctcgtttgagctgtaacggcgaaaccatcagtgcgactaaagcacggcaagcaataaaagaacgaaatgaacaaaaactaatgaaattcctacctgagactacgcttgaatacttacatcaaaaaggagtgatgacatgtggaaataaaacaagttgcagctgctggtaccgttgaatccagcgatattttgataacgatcgaaccaaatgaaaaagagacacttagcatttctttagacagtagtgtagagaaacagtttggcaagcagattcgacaagtaataacagaaacactgactcatttaaaggtaacttcagcaaaagtaacagcaatcgacaaaggagcattagattgtacgattattgctcgactgattactgccgtttatcgggctgccgagaaagacgcttatgattggggtgaaatcgacaaatggaaaaattgagaagaacgatgatgtttgttcctggtgcaaatgctgctatgttgagggatgccccattatatggtgctgattccatcatgtttgatttggaagatgctgtatcgctgaaagaaaaagatgctgctcgtacccttgtgcattttgctttaaaaactatagattacggtaatgtagaaacagttgtcagaatcaatgctttggaacaaagtggtgaagaagatatcaaagctgttgtctcagccggtgtggatgttattaggttgcctaaaacagaaacagctcaagagatcattgcagtggataaagtgattaccaaagcagaggaaatattcggctgtacagtcggcacgactaaaatgatggctgctattgaatcagcagaaggtgtgctgaattcacgggaaatcgcacaagcatctccacgaatagttggtattgctttaggagccgaagactatgtgacgaatatgaaaacaaaacgttaccctgatggacaagaattgttctttgctcggagcatgattttgcacgctgcacgtactgctggtatagccgctatcgatacggtttattcagatgtagaaaacatggctggatttcaagcggagacggcgcttatcaaacaactaggctttgatggtaaatcagtgatcaatcctcgccaaatccctgtcgtacacgaaatctatgcaccaactaaagcagatatccaacatgcaaaagaagttatttgggcaattgaagaggcagattccagaggttctggcgttatttctttgaatggaaaaatgatcgataaaccaatcgtggagcgtgctgagcggatgattgcacttgcaaaagctaccaatctactaagtgaagaggagtgatgaaaatggttttgaatcaagcaggtagagagataccaaaagaatatgctgaacattacggtattttcgaaggtgaacttgcgcacatcaattcgtataaagaagccagtcgcaacattaaaccaaaaacaccacgtgaaacaaaattgttaagcaatttacgcgaagcaattgagcgaacaggcttgaaagacggtatgacgatttcattccaccatcattttcgcgaaggagatcaagtcatgaacaaggttttggcagaaatttcagcgatgggtatcaaagatttaacgattgcgcctagctcgattgccaatattcatgaacctttgatcgattatatcaaaaatggagtcgtcacccatattacaactagtggattacgagacgaggttggggcagcaatttcttctggaataatggatgctcctgtgattatacggtctcatggtggaagggcaagggcgataacggcaggagacctatctatcgatgttgcgtttttaggtgcgcctagttcagatgtttatggaaatgcaaatggaacagttggtaaagcaacatgtggttctttaggctatgcaatggttgacgcaaaatacgcagatcaagtagtaattgtgacggacacgcttgtaccttttcctaatacacctattagcatcccacaaacagatgttgatttcgttgttgaaatagattcgattggagacccagaaggtattgctaaaggggctacacgattcactaaaaatccaaaagagttactaatcgcagaatatgcggctaaagtaatcactcagtctccttattatcatgaaggtttttcttttcagacaggtacaggtggagcagcattatcggtgacacgctttttacgtgaatcgatgcttcaagacgggattaaagcaagctttgctcttggcggtatcacgaaagcgatggtcgatctattgcaagaaggattagtagaaaaaatcattgatgtccaagattttgatcatccttctgcttgttcactgggagaaaacagacatcattatgagattgatgccaatatgtacgcgtctcctttgagcaaaggatcatttatcaatcagctagacacagctatcctttctgctttagaaattgatacggattatcatgtcaatgtcattactggatcagatggggtgattcgaggcgcagcaggaggacatcctgatactagtatggcttgccaaatgagtttagtaattgcgccacttgtacgaggacggattccgacaattgtagataaagtcaatactgtagtaacacctggttcgagtattgatgtggttgttacggaatttgggattgctatcaatcctaagcggaaagatctgatccaacactttaaacaaatagatatcccacaatttacgattactgaactgaaagaaaaagcatatgggatcgtagggacaccagaaccgatcaattatggcgaaaagattgttgctttggtcgaatatagagatgggacgattatcgatgtggtaaaaaatgtgtaatcaattattccaaggaacaactgttggtttggagcaaatgcttacagcacgtacgaaacgagcagaaatccaaaaagaaatgttatcgatgaaagaaaatactgttttgctttgtgcaacgttgaatatacctgggcctgtcaaatactctgtaggattagcagaactatttgaacagatcattgaagttgtagaagatgcgatagctttacatgccatccttcgtttatatcgaaaagaagtcactggaccagaatattatttgctactttcaatgcctgaaaaggaagcgaaggagaccatgttagaaatcgaagaaagacatccgtttgggcgtctggttgatctagatattttgtgtttagttgacgggcagccgaacccaatcagcagaagcagtttaggtcatcccccaagaacttgttatctctgtcaggagcaagcaaaagtatgtggacgttcacgaaaacatagtatgaaagaaatgcaggaagcgattctgctaattacagcaaaggggaggggaaaaaataatggcaaaaaaaatccgattgatggaaacagtcttacgtgatggacagcaaagtttgattgctacacgtatgccaacaaaagatatgctaccaatcttgcatacaatggatcaagccggttattctgccttggaagtatggggaggagcaacatttgattcttgtatacggtttttgaatgaagatccttgggaaagattgagaagtatccgaaaagaagtaaaaaacacaaaattgcagatgcttttgcgcggacaaaatttattaggctataaaaattatgcagatgacgtggtacgatcttttgtcgaaaagtcaatccaaaacgggattgatatcataagagtgtttgatgcattaaatgatacgagaatcctgcaaacggcgattagtgctacaaaagaagctggtggtcattgccaaacagcaatctcatataccacaagtgatgttcatacggtggaatattttactgaattagcaaaagaaatggttcaatcggtgcagattctatttgtatcaaagacatggcgggcgtattgacccccaataccggatacgaattagttaggcgtatcaaagatgctgtagatgttcctttggagatccacacgcatgcaactagtggaatttcagagatgacttatttgaaaacagctgaagcaggagcagatattatcgatacagcaatttcttcatttgctggcggaacgagccaaccggcaacggagtctatagcgatggctttggaggatatgggcttcgatacaggattggatctacaaaaaacagaagaaatcgcagaatatttcaatcctatccgagatcgatttagagaagaaggacaattgaatccaaaagtaaaagatacagaacctaaagcattaatttaccaagttcctggaggaatgctttccaatctgttaagtcaattgactgaacaaggactgcaggacaaatatgaagatgtattgaaagaggtaccgagagtacgggcagatctaggattcccgccgcttgttacgcctctttcccagatggtaggaactcaagcattaatgaatgtgattaccggcgaacgctacaagcttgtcccaagtgaaatcaaagattatgtacgaggcttatatgggcatccaccagttcctatacagaaagaaataaaaaaattgatcattggtgaggagaatgtaatcaccgttcgtccagcagatttcattgagccccaacttccagcttttcgtcaagaaatttcaaattatgcaaaatctgaggaagatgtcttgatgtatgctttgtttccaatacaggcaaaagattttctaggaagaagagaagatcgattttacgatgtcccactccaaatggtagaggtgaaaatcgatttttttgaaaatcaataattgaataaaaaaggactgtcataggtacacactggaatgtatctgtgacggtcctcttttatgaacgattttatcgaagacggatagtacgtgtcaaaaataaaaaagctacgattagaaataacaataaaatgtaccccaaaataacggctaggcgatccaacttatttgtcgatatgtgtttgtttaaaagctgatagaaccataatccaatcagacctcctgttgtattagtaattacatcagtgatatccgctacgccaataccgaataggaattgaataaactctgcgaagaagcttacaaggaaaatgatccctaattttttagaaaaggaaagccctttgaaattgacatccaaaagcaccccaaaaggaaaaaagacaatcaagttataagtggtctcgcgcaaaaccgtcgtattttcaaaagaaaaagtagaaaaagggacgagattgacattgctataagaataagtgagaaattgtggaagattaaatgacagcttgaataaaatcaaccataatagaaagaataaataaatacctaataaaaattttgatacataccgcatagacatctcctccatttaaaaagtataccatcgaaaaccgctgaaaaatcataaaaaagtatgaagtttaagggccaatgtagttatcgtacgaaaattagaagctttttttgttgggaatccggtttcttttaaatgagtttaaaatgagaaaatattcaaatatataacttaagtaatttttattcatccactttttcctctcaaagattatttttaataattatataaattacatgcatatatatcttatttttcgtataaaaatggaatatgctatacatgaaaaaattatggaaagataagtctttcaacactgttttcttcgtattcattcgttttacgcttatttcattaatgatatttacttttttattttcttgatgataaaaagaaaaagttagataattgcatatatagttatatatataaatttcagataattcgaattattttgctgaatcaccttgacattgcctaataccaaatgtattatttcaataactttcattatcttttaattatttcaggtgatttattaattaaacatgttgcgcaattatctggttaataggggttgaaaagggtgaaagcagtataaataagagggggatatacattatatgaaaaaagttttagctttgcttctagtaagtgccgttatgctgggagcatgcgggagtaatgcaaaagggtctagctcttcaaagaaaagtgaccttgtatcagaatatagttctgtatatgtaacagatcttgaaacgctagattacacattctcatcccgtaaaacgaatagtgaccactatactaactttgtggaaggtcttttggaaaatgaccaatacgggaacctgaaaggcgatatggctaagtcatgggaagttagtgatgacgggttgacttatacgtatcatcttcgcaaaggtgttccttgggtggatagtgaaggaaatgagtatggggctgatgtgacagcaaatgactttgttactgggttgaaacacgcggtagatgtacaatcagaaacgttatatatcgtggcagatagtatcaaaggcttatctgattatatagatggtaaaacgaatgatttttctactgttggggtaaaagcagtagatgactatacgttgcaatacacattgaataaacctgaaccattctggaactcaaaaacgacttacggtatcttatatccaatcaatgaagagttcctaaaatcaaaagggaaagatttcggtaaaccaacaccagactccatcctttataatggacccttcatccttgcaaacaatacagctaaatcagttatcgaatatacgaagaatgaatcttattgggatcctaaaaatgtccatttagacacagtaaaatggacctacaatgatggaagtgatcccgatgggttatttaaatcttacgaaaatggagaattatctcttgctcgtgtttatccaaattcaccaggatataaagacgtaacaaaagcttatccagatggtgtgacttggtctcaaacaggtggatccacatacaatttaacatttaactttaaccgaggtacatttgatgcaacttcaaaaacaacagataaagaaaaagaagatacacagaaagctattttagatcgcaatttccgtttagctattctattcggatttgataagaaaagctataacgcacaaagtgtaggagaagaaggagccaataaagcattacgtaatacacttgttcctaccgattttgtagaaattggcggaaaaccttacggtgatacagtggcaagtaaattaaaagcactggattccgatgcttttggcgatgtaaatttatctgatggacaagatgggtattataacgcagacaaagccaaagaatatatggaaaaagcaaaaacagaactagaagcaaaaggtgtgcaattccctattcatttagatatgccagttgaggaaacttctgagattagtgtcaacatggtcaaatctttgaaaaaatcagtggaaacttctttaggatcagataacgtagtggttgatgttcaactattgaatgaagataaatatttagctgctacttatcaagcaacgaccggacaagctggcgactttgacattacaaatgcctctggttggggtccagactacactgatccatcttcttacttgaatatctatgattcacgcaaaggggatatgatccatacacttggactggaagcttctgccgtagtacaaggaacggatccatcaactgctgcgaaaaaagcaatcaacttacctgaatacgacgcattattggataaagccgctgctatcactgatgatttagatgctcgttacactgcttatgcagatgcagaagcttggttgttagataatgctttgcaagtaccaatttatgcggatggtgggacgccgcgtgtcacaaatgtagtgccatttagtggaccatatggttgggcaggaattgctgcaaacaaactgaaatatgtagaagtacaaagcgatatcgtcacaacagatcaatacgacaaagcgaagaaagcttgggaaacgaaaaaagaagaaactgcgaaagaagcagaaacaacaagttctaagtaatttagctgaatgaatagtaaaaaaggctttcaatttctattgtagccttttttacttatatgatgaaagagagggaaaattgtgaaaagataccttttatttagagtcctgcgctctatacttagtatttttcttgtaactaccttaacctatgcggtgatctattcacttgttccgagaaaaacgatatttcaaaatgatgtgaattacggaaaattaaaggcaaaaccagatgaactggcagattatgaaaacacagctttcagcaagatgggttatatcgaataccacacgacgaaagaactgaaaaaagaagtaggaagtagttcatcagaaaaagcctcttctgagcagttagaagaaaaataccaagattgggcgaagaaaaatggttggacgctcaaacaatttccaatcagcaaagaatattatgcgacaaaagatatcccattagtaaaacgcgtagtgaatttctatgcgaatatgatccaaatcgatcacccttggaaagtaaaagatgccagcaatcctaacttaaaacattctctgcgtatcgaaaacgatgagttggtcggttgggcacttgtcggttcaggaacacaatataaataccagatttatttcaatggacaatttccttatatccatcaaaatatcgttcatttgaatctaggcacttcatatccgacatttgctggacaagcggtaacaagcatcctttcaggaggacaagggaaaacagaaagtacagagacaacatttaatgatgattttacagcgcgctcttctgctaacatctatctccgtcaatatcagaaaacaaaaaacatctcttcacgagacaaaaaatatttttctgataattatgtcatcacagatacgaattaccaagacccatcgatgatcggcacatcatttcgtatgggagccatcgctgttgttattgcttatgcgatcggcatacctgctgcgatgttgatggctcgttacaaaggaaagataccagataaagcagggattgctattgtaacggtgctgatttccgtgccaagtctagcctttatctatttcttccgatttattggaagcagctggttttctttgccagattccttcccagcattgggcgcacaagatattcgctcctatatattaccgacagtgattctaggactattgtctgtttctggaatcgttatttggctgagacgttacatgatcgaccaacagtcttccgattatgttaaatttgcgaaagcaaaaggtttgaatgcgaaagaaattgctagaaaacacattttcaaaaatgcagctatcccaattgtcaatgggattccaggaagtatcatcggagcgattgctggggcgacgatcacagaaacagtgtttgctgcaccaggtatggggaaaatgctacctgatgcgatcattacccataacaatccattagttatcgcaatcgtttttgtctttaccacagtatccgtattttcaatcttagccggggatattgcaatggcattagtcgatccgcgaatcaaactatcgtcaggaggaaaatagcttggaaaatgtgaaaacagaacaaatgaatgaattcatttttgtagaaacgaattcgttagcttcagaaaagattgatacgccgaagtattcgtattggcgttcggtcatgcgtaaattcttttcaaataaagttgcgatttttatgctgatactgatgttggctgtcttattgatgagctttatccagccattattcagcggatataaatttatggatgtaaaagatatcaatgactttacgaaacgctataatccaccaagtgcaaaattttggtttggtacagatgctaacggcatgtccttattcgatgcagtttgggcaggggcaaaaacatcaatttccatcagtgtcattgctacattgatcactacagttattggtgtagtagtaggggcgatttggggaacatctaaagcaattgaccgtttcatgttggaaatttacaacatcatctcgaatgtgccaactttactgatcgttatcgttctctcttatacgtttggttccggattttggaatttgatttttgcgatgtgtgtgacgagctggctgagcgtagcttactttattcgggtacaagtcatgatcatccgcgaccgcgagtataatctagcctcaaaaacactaggaacaccgaccttgcggatgatttttcgtaatatcctgccttatctgatttctatcatcgtgacagatatatctagagcgctaccttcgtttatttcatatgaaacatttctttcattcttaggcgttgggttaagcagtgatgttccttccctcggacgattgatcgcaaaatatacgaataacatgagcaattacccttatcttttctggattcctgtgactgtactggcgttagtttctgtttctttatacatcgtaggacaaactcttgcagatgcggcagatccaagaacacatatttaggaggcaaacaatggagaatcaaacaattttatcagtagaaaacatctcggtcagcttccatgttcgtcaccgtgaattaaaagcgatcagaaatgtctcattagagctaaaagaaaaagaaacattagccatcgttggtgaatcaggatcaggaaaatcagttctgacaaaaacattcaccgggatgctggaacaaaacggcaatatcacttcaggaacgatccgctataaagacaagatattaagcgaattgaaaaaggatgaagaatgggaagatattcggggaaaagaaatcgcgacgatcttccaagatcctatgacttcactgaatcctatcaaaacaattggctcacaaatctcagaagtcatcatcaaacaccagaagaaatcagcgaaagaagcgaaacgcttagctgtcgaattgatggaaaaaacaggaattcctaatgcggcaaaaagatatgatgaatatcctttccaatactctggtgggatgagacaacggatcgtcattgctattgcattggcttgccgacctaaaatcttgatttgtgatgaaccgacaaccgctttggatgtaacgatccaggcacaaatcttggaactaatcaaagagcttcaggaagaatatcaattcacaacgatttttatcacccatgatttgggcgttgtcgcggctatagcagacaaagtagctgttatgtatgctggacagatcatcgaaagcggaacagttgaagaaattttttatgatccaaaacatccctatacatggagcttgctttcttctttaccacaattagcacaaaaaggagatgtgctttactctgtaccaggaacaccaccttctttatataaagatatccaaggagatgcttttgcgcctcgcagcgcctatgcgatgaaggtcgattttactagtgaaccgcctatgttccaagtatccgaaacccattttgcgaagacttggctgttggatcctcgtgcaccgaaagtacttaaaccaaaacaaatcgaaaatcttcatgaaaaaatgattgctttggctgcagaattggatagtgaagaacaagacggggggaagcaagttgtcagctgataaaaaaactttgttaactgtaaaagatttagaaatcacttttggagaaggaaaaagcaagttcgtagctgtccaagacgccaactttgatatttataaaggagaaacattctctctcgtaggagaatctggttcaggcaaaacgacgattggcagagcaatcattgggttaaatccgacaagcaaaggggatattctctttgaagggaaaaagatcaatggtcccttgtcgaaaaaagaacaagcagaaaaaatccgtaagatccaaatgatattccaagacccatccgcatcgttgaacgaacgggcaacagtagaatatattatctcagaaggcctctataattttaacctgttccactcggaagaagaacgtttggaaaaggtggcaaaaatcatcaaagaagtcggactacttccagagcatatgtaccgctatcctcacgaattttccggcggtcaaagacaacggatcggaatcgctcgtgcattagtgatggaacctgaattagtcgtagcagacgaaccaatctctgctttagatgtttcgatccgtgcgcaagtgttgaacttactgaaagatgcacaaaaaaaacgagaagtgacatatctttttgtcgctcatgatctatcagtcgtacgttttatttcagatagaatcgctgtgatcagacaaggacatattttagaactagctgaaacggaagagttattcaaccatccgattcatccatatacaaaggcattgctttcagctgtgcctataccagatcctattttagcaaggaaaagaaaattacatgtgtatgatcctagcatacacgattatacaaaacacggtccggttttcgaggaagtacgccccggacattttgtatacgggaatcaaaaggaattagaagcgtatcgaaaattgtgagatctgcagtttgactgagcaccgaaaatcaggtgatcaaacataatagttaatcgatattttggtaaaagcaaggggaagacagaggagtcttaccccttcttagtccacaaaggggtggatgaattggaggattgtttattttgtaaaatagtgaatggaagattgcaccgaagaaaaatagttgagagtgaaaatattcttgtatttttagataacgcaagagatgtcgatggtcatataatcgctctagtcaaaaaacatcgggtcaatttaattgattgcgagcaagaactatttatcgaattgatgaacgtcattcgagcggtttctcttcattgtgtcgaaaattgcggttttgatggcgtcaatttgatcaaagcagaagatgagacagtagaagaacatgtctctcatcttcatttccatattattcctagaaaaaaacaagatggggtggatgcttggcccttatttaccggcgcgatgaatgatttagagactatgcaccagcttcttgatatgagacaaaggacaggagaaaaatccagtgcataaaagagaagaatgtacgctcttagatacgattcattcggtttttaataaaaaaagataaggtagcgagttgcttagaaaacttgctatctttttttgttaaaacgactcggaatgtttgttctttgttctgacttttccaagcctttttcttcttgatactaattttatgaaaaatcaagaaacaattgttatactaggtaatgctgacaaacgggattggcatttcattttgattcagcttcttttcaaatcactaggaaggagggatagattgttcaagacttattttcgtttcaataaaatacaagataatccttttcgtatcatgaacctgatgctacttatctttatcgtattgtggttaggttacataaatcatgactttttgatttcaagtttttcatccttagggatctttacttttttctattatcaaaacataccgatgaaatctttgttgaaacgtatgtttttgattggttgtggtcttttgtttgctttcgttctagggattttgtcaacttatgttttatggcttgaaccatttgctgtagctttggttgctttttccagcagatttgtgttgcgattattccatatctctaaaccaggtggcttgttttttgcgatgctttctgccatgggaacgagcatgcagctgccaatcgctcaattaccgatcgtctcgctttatttttttataggtgtcgtttttgccctgattgcggcagtgattacaaaattactggattcacggcctgagcagacaattgaaaaagcgactctaaaagaaaggtttcatgaagagcctttggtgatcattgattctgttttctacagtgccgccttgtttctgtccgtttatgtcagtcatggcttgaatctgcataatccttattggttgaccttgtcatgtgcatcgattttgctggcggaaaatttggatgcgatgaagcatcgacaagttcaatatctgattggatcgatgggtgggttatgtgtatcagcagtcttgtcatttgtgccgttcacgcaactgcagacgatttttctgattacgtttctttatggaatcgcacaatttctagttgctagaaattacgcggttgctaatatttttcttaatcccatggcgttgatgctatctacacttattcgcggggcctatctgatgtctttgatcgaatatcgttttttaggaatcatcataggaagtttcatcggtttaggtgttgcgtgggtaatgaatgtcggactgcaacattatttaaatgtcgttcgaaagaaattagaatagaaggacaaatagaagtatatgtgctaaaaaaggttgtgaaaaagtcattttcacaacctttttcttaatactcaaaactgagcggctttttcacaacctcatctaatcgaatgatacctcaaagcggacagaagaggggaattccgcaatgatttcgtttaacatagttggtttcacgttttttacctcttttctgtgtttccaaactggtcgcactttttcttctgatgcaacgattttatgtctatccgagtgagctacatgtttcaaaagatagacgaaattgatttgctgataggctttatctgtgtttccttcaattgaaaaggtagtttcaataagggcaagcaaacggacgatttctgtttcataaccagtttcctccagcatttcgcgaacaacggcttgtcgacttgtctccaaacgtttgaccgctccgccaagcaacacttggatgacctgtttatcgttttccctgttcaaaagaatatcatctgtttcctcattccataaaattccagatgcccgtatatcaaattgaaaattctcttctaccatacgcaaatcatttgtttccattccaacgcccaccaatctttttcgcaaaaaatttttatttatgttggcggatggataaacttttttgagataatcaacgttttacttgaaagtcgtacagatattcttgctttctccatagtgaaggttctacacgtcgcttttccgtaagagacaagctaattaggtcgagttcccaaatgattagattattatcatgatcatgggtagcaatcgctacgtgttcatcatcaatcacggagacaataaataccccactaagatccatgtttgtcgggagttttttagtagtttctgcagtctcaagatcaataaagtagatcgtgccgttacttgaaaagtaaacaagctgatctttataaataaaacttccttttgaaaaactgaatcctatatcttccagtattatttctcggtctgtttctttaaatgtatacgatgaatctttcagcgaatagctaaataatccagctcgccgattattagcaaaatcaaaagccactccgtataagtggttttcatgaacatttagccgataacctatcagatattcactcccttctatattggggaacgaaccaaggttctcactgataagcgtatcttcagaaagatagagtctatcaacaaataattttcctatttcttcgtcacgtaaaatatagagagactgctcatcgtttccagtcgaaaaaatatgcccgttgataatcgtatagtcattattaaaataaagattgttttgataaaggatgtcattggtatctggatagccatgattgaacaaagtaaccagcttcccgtccaatatgacgctgtctattcctgtatgttcttttgtttggcgcttttccttttcgatttttcctgaatgaggtgtataaacgaagtcatgcgttcgatcagataaaaagactttttgatcatgttgtacgaaagtgcctagttccagtccttctgtttttaaaatcacttgatccttctttccgataccaacgaatctgccagatgttacaaacttgtccattgtattcgaaaaatagagataataatcataatcacctgtcagtttcttttcctacaccggtacatcccgatatccctaacaataaaaggaaccccaagctaagaaataggtatttatatttcatgacatctccttgttaacggtcatattctaaaaaacattcccatattattccacctattaccgattttttcattctctaacactccttttatttttttatatttcaacaattacagtgtattctaactagcaatcaaatgtaagacacaaatcattgcgccatatattcaattcctaaattttccgttatagttaatatgggagagaatacttaaatgaaaggagcgagggatggagatccatcagtggttgcgtgagaagagaagggaaaaagggtatactcaaaaatgggtgtcacttcagttacatattacaagacaaggtttgtccaattgggaaaatggccggtcatatccaagttatgagatgctctataaattgatttgtttgtatggatgctcagctaaagagatttcagaactgtttacaagagaaagagaaacaaagaactaggatacaccatttcttttttaagatcccaatcgttatagactcttttcaattacaaatgtttctaatatagttgatattgagggaaatggatgcggtttaacaacgaggaggatgcttggatggtatttgctcgatggctgacaaaaaaaagaaaagaccgaagttatacacaagatttcgttgcacgacaattaggtatcacaagacaaacactttccaaatgggaaacaggtctatcgcgtcccagttacgagatgttacaaaaaatttttcgtttttacgactgttcgcaaaaagaagtagctgaattgtttaagacaatcggaaacggtaagatgtgaatgtgggaagaataattggtagatcatatgtaataataaaacttatttccgaagaagcaccttttggaacactattcattcggaaaaagtgattgtgacacgacttttgccatagcctcgttttagcaggttgactttctttttgacatttgataccattcagaatgcaaatcgtaattatttcgatttgcattctttaacatgactacaatcaaagaagaaagtgggtcgtctatatggaaaaaacagatatctcaagtgcgtatcgccgtttgaaaagcccaaatatcaaaacacgaaaacgtgcgttgaaaatcatcaaagatgtgaaacgaaatagtggaaaaaggtaagaagaaggaaacttaataaaaaaatgaggttgtgacagaagtggtcagcttcaagaaataagaaggaattgacgaaatttacttctcacatttttgtgtaatttcggcttatttccgaagaagctacttctggaacaccggttattcgaaaaaaggaactgcgacacgatttttgtcacagttctattttcaattatttttgtttattcccactcgaaaataaaaagatagcgtatagaattatttcgctaatctaaaggtttgcaacatattataatatgtttagaatacgatggattttatagagtattatcattttatttacttatttctacgtattaatgtgttaaaattttttcttgcttatctaggacagttaaatctaacgtatttttagtaaagtttataaactttttgtcatgagtcacaaaaacaacggtagcatgatgttcgacattaaatttttttatgatgcgaaagactaattcagcatttttttcatcaagattacctgtaggttcatctgcaaaaatataagaaggtttttttaaaattaatctagctaacgcaatacgctgctgttctccgccgcttaattcataaatctttttctctaaaacattggatagacctacttcgaataaactgtgtaacatcatttcttttttcacttttttattcattttttggttttttaatgctataagtagattactttcgacactttcatcgtttattaaaccgaaattttgaaagatatagccaatcttatctttttgtagtaaatgaacttctttagcactaggattttctataccttcaaatatgatttttccactatcaggtttttccagcaagcctaacaagtttaataaagttgttttgccactcccgctttttccataaatacataaaaagtcaccatctttaatcgttaaggagaattgtttaaaaattttattttttccatatgaaataccaacgttttttatctctatcatctctaaactccttttttttctatgcttggcttgttaatagaagtgcttaagtaatacatggttaataaagtgataagtaattctaaaatgctccagcaagtaattataaaaataatatattggtttctataaaggatgaataatactgatacaagaatgatatctaataagataattggcatgactattggagtaaagagttttataaaagagtatccaaaaagtctcttaatatgcaagctatatctatatttttctacgattaattggtaggatgaaaaaacattaaaaatttggattacagttaaacaaatcaatagaattcttatagtgtaaatcaatgttttctttgtattcaattcttcagctcggaaattgtaaattgaaatagtattctggatgcttggtaaagtatttgttttgataatggtcggtaataaataattaaatccatccttttttttctgtttgaacaaaagaagatgtcgtcaaccaggctgcataaaaactagcatctagatttcctgtatctactatagagattggatcaactatagtaaagtcttttttatcaatgtgaggattatacgtaaaatatttttgatgacttttcacatatatgatgtttatttttgcatttatcggttctgaagacgcgctcgtagctcgcctcaaaaaagaaaaatattccagatattgcgattcaatttctttttcaaatttattcaagaagtcaggcactaatagattcaaatggttaggtgaatagattattttatctataggagattttccttgagtatctatgatcgggttgtgcgcgaaatagtttttattgataatgatcgattttccagcaggagaagtcaattgttcaatatcactatgagtattcatttcatagagcggttttccatttgatagtttttcataattggatgagtttattaggaataatccttttttatttgttgcctcgttaaaaaaatttttcaaatttttctcgtaaggacgatattcatctggatcattcgtgataaatcttaattgtgtggcatagatattctttgttttctcccaatagacattttgattttggtgctgaaccaatacctgttgatcttttaataatgaagtacctaaaataataatggttgttgcaactgctaatttacagaatagattaaaggctatcccaaagctgctgtaattgttgccttttaaattattgggatgattcgagcgataaatgagtttaatagatagataaatacagatagaatacagcgtaatgagtaaaagagtggtcaataatgacaaagagaaaaaggaaattataaatggcattcctttataacggataaaaaagtatgggacaataataaggctgacgatagataaactcaataaaagtacacgtatgataggaattgtaaaagaacttaaagtatcttggatactccagccaaatagtttaaatagagtgatttttttagtttgtttaataagaagttggatcaatattgctaaattaactaccaataatagaaaccatactaaaatcaataaatatttgtcgaaaaactcttttcggacatttaggttgtaactatcattgttatcggtttgtatagttcctagtttattgatatctctgagaaacgcgtggatctgtttttgagtgtttccctgaatataatagacgcctgaaatccctgtttcaggaatgtcggcgaacttttttagctctaggtcaatttttgaatttgtccaaacgaaatcttttctagattttaaagtatctgtactgctttcatttggattccctagagtagtaaattcattcttcattgtttgatttgtatatatttttaaatcggagtcactagaaaatatatatttaaagatttcaatttgattgttgtttgctgtttcaataataaaatcagcttgttgctgaggttctcttaacattgaattagattcgactagaatagtaatcttttctttatctttataaagtaatttatttaactctaattggtcaataactgaaaggaaaataaaaacagttaatattaattgggcaattattcctatgtaaacatattttttcataatatctcctttaataattacttaaacagatagcttcatactgtgattttttgtgttttaattaacgaaagttataatatgctttatttccaccaaaaagagtccagccaacacttgcgttactccattgatatggcgctttccaaccaccactattaaacgttccgtttccgttctcgcatgaggcatggccctcttttgtatagtgttggtattcagaaatattacggttgccattctggcctctacgccaccagccaccaccaacggcacttgaagcatatcttgatgaactatcgtttttattatcttttgtttcaattacagtagtatatgcatctacattttcttgcccaccagagtataaagagtcctgtgtagcattagcaataggtactactattccaatggctgttccggaaattaacaaagtactaataattatttttttcatttatatctccttttagtataaagctatctcaattaaagatagcgcttacaacgatggttgtcaatagttgaaaataaaatgtcaagcaattagctcagaatattttttctatcggaaaatgtttgtattgattaaggtaatactagagttatcgaatatatttttattatggtttaccttatttaaaattattattgttatttagtattaactataaaagtttcattttttattatttgagaacacatattgaatcatgtccagaactgttaaataattagcaagaaatatttggtaaggaacaaagaagactaaaggagcggacatataaaaaacgcttatgaagtactattgaaggaattttcatgttttgtcaaaagtaaatcaattaaaattacgtataaagtaattgatgaaatcttttaaaaactttgtaactgtgataaaagtgtgataatgaaaaaacaaacagccaacaaacattgacatatcaaaatttgttggctatttttgattattcccactccactgttgctggtggtttagaagtgatgtcatacacgatacggttgacatgggctacttcgtttacgatacgtacagagattttttgcaagacttcccatgggatacgggcaaagtcagctgtcattccgtcgattgaagtcaccgcacggataccgactgtgtagtcgtaagtacgtccgtcacccataacaccgacagagcggattcctggaagaacagtgaaatattgccagatatcacggtcaagtccagcagctgcgatttcttcacgcaagatagcatcagattcgcgtacgatttctagcttgtcttcagtgatttcgccaagaacacgaataccaagaccagggccagggaatggctgacgccaaacgattgaatcaggcatgcctaattgagtacctaattcacggacttcgtctttgaatagtgtgtttaatggttcgatcaattcaaattgcatatcttctggcagtccacctacattatggtgagatttgatcgtttgtgctgtttctgtaccagattcgataacgtcagtatacaacgttccttgtgctaagaaagagacgccttcttcaccagcaagttttgttgcttcgtcatcaaaaacatatacgaattcattcccaatgattttacgtttttgttctgggtcagatacacctttcaacttgtctaagaagcgatctcttgcatcgactttgatgatgttcaagccgaattttccgcctagactttccattacttgttcagcttcgcctttgcgtagcagaccatggtcaacgaagatagatgtcaattggtcaccaatcgctttttgtaaaagaaccccaacgacactagaatcaacgccgcctgaaagaccaagcaagacttttttgtcaccaacttgttcacggattttttctacttgcatatcgataaagttatccattgtccagttaccttcacagtgacaaacatcaaaggcaaagtggcgcagcaattcgattccgtattcggaatgacgtacttctgcatggaattggataccgtaaaaattacgtgtggtgtcttggatagaagcaatcggacaatctttgcttgttccgactgtttcaaagccttcaggaactttagttaccaagtcaccatggctcatccatactgtttgttgttttggtgtttctttaaacaagacagcttgatcgcttgttacttctaacaaggctttcccatattcgcggtttttagcaggctctacggaaccgccaagtttgtatgtgatcaattgcataccatagcaaatccctaatacaggaatacctaaattgaagatctcaggatcgatcccaaatgcattctcatcatatacactgtttggtccgccagaaagaataattccctttggattcatcgcttttacttcttctgcagtaatgcggtggctcaataattcggaaaagactccaagatcacgaatacgtcttgtgatcaattggttatactgactaccgtagtctaatacgataatcttttcaacgttcgtcatatcggcaacgtttgtcaaatttattacccctatccctttaaattttatctcaaaatagtcaaactattttaaaatgctaatattttcgcatgaaaatcgaatcgatgatatgattttcagttttatggagaattatatcggctcttcctcgtgtaggcaagatatattcctgtaaatttttcaaattcacatttttccatacatcttttgccattttaaaggcttcttcacgatctccgatagcaaaacgataataataattctctggattttggaaagccgtatccagtaacgcgccaaaacgatccaaataccaattttcgatcagcacgggatcggcatcgacatagacagaaaaatcaaaaaagtcgctgacgtagatttgctgattcgcaggtaattgaagcgtattgatcccctcaacgatcaagatatcaggttgctggatcagctcgtacttatctggaatgatatcatacacatcatgtgagtaaacaggtacttttatctcttcctgaccagattttacacgattcaagaagtcgatcagcatctccatatcataactttcaggaaatcctttgcgatccataattccacgctcttttaatatacgatttggataaagaaatccatcagtcgtgatcagctgaacatttcttcgtttgaaggtacgagacaaaatcgtctgcagcagtctggctgtggtacttttaccaacggctacgcttccggcgatcccgataataaaaggcggtacttctacgtatttatgaagaaataaacctttactcaagaacaaagattcgaattctttcatatatagatatatcagatgagcaagaggtacgtagatatctcgaacatcctgcatggaaatgcggtcattcaaacttttgatattatctagttcatcttgtgtcaaaggtgcttgcccattacgataaaattctcgccattcttctcttgccacacggtagtagttcattggatcattcatattagcctcctgcgttctcccatcaatggaactattttaacacaaaataaacacaaaccccaccacttaagagagattgccaatctttttgtacaatctttataatagaaagaaaaggagttttattcttgacttgcgcacggatacataaaaggatagactgttgacatgaaagaaatgagaaggatggaagacatgacaaatcattactattctgaacgcccagatacggcgcacgattttgaacaatgggcttttgagttaaaaggcagaacctttcaatttgtaactgattctggtgtattttcacgtgaaacagtggattatggttcacgtgtcctgattgatgcttttgattggggagagttacctgacgaaggaaagatcttagatgtgggatgcgggtatggaccgattgggctagctttggcatttgcgacacaacggtttgttgaaatggtcgacattaatgagcgagcagtgagtctagcgcaaggaaacgcaaagcgtaaccaaatcgaacaagtggacatccaccaatcaaatatctatgaagtacttcatgaagaaacctatgcagctatcgtcagcaatccgccaattcgtgctggaaaaaaagtcgtacatgaaatcttgacaggcgcatatcctcgattgaagcagggcggtacactgacaattgtgatccagaagaaacaaggagcgccgagtgcgcaaaagaagatggaagaaacatttggcaatgcagaaatcgttacaaaagataaaggatattatatcatcaaaagtgtgaaagaataactagctgaaaaataatagagcgacgaaaaagtggaactgggcgtgcatgtaagggtacgtatcagttctttttttgctgagaagtttttaaaaaacaaagaactattttttcttcaaaaagaaatagtaggaacagagtcgttgttttttacgataaaataaacaagatacagaacttgtatagaaggctgccaagttggtagataaaggagatttttatcaaaaaacatactttctttttttctctattcttttcttgggggttttggtacactgatagggaatttagatagaagggagccactagggtgaagctgaccatcagagatattgcagaaatggcaggggtatcagtaacaactgtctcacagattttgaataacaaaggaagccgatttagtgataagacaagaaaaaaagtgttgtcgatcgtgaatgaacatcattataaacccgattatttcgcttcaaatgtgatcaatcgacattcaaagaccatcggaatgatcgttcctgatgtcaccgatttcttcttctccaaactgatcgaaggtgtagagagctatttgaatcctttgggctatgtgatcatgttgtgcaattctcgtcatagccaagaaaatgagatcaagtatttacaagagctttcccaccgctcagtggacgggatcttgctggcaacaccaaatattttacctgagaaatacgcattagacagcggattttatcaaaaaatgccgattattttaatcgatcgcggattgaatcgtcgggataacggacggcttatcgtaaaggaatatgagggagcctatcaagctgtttcactatttattgaaagtggccatacgaagatcggcatgctgaaggaaaccactggatactatcaattagaagaacgtttcaacggatatcgtcatgcgctgaaagatcatggcctgccttttaatgggaaatttgttgaacatggagagttgactgtccaaggtggatatactgcatcaaaaaaattactcaaacataaagatattacggctattttttgcgggaatgatgccatggcgattggctgttatcaggcgatagatgaattgggcaaaaaaatcccagaagatatctcagtcataggattcgatggattaaagctgtcagaatacatgattccgcaattgacgacagtgcagcaaccaagttttgatattggattttatgctgcgcgtttcctgattgatacgatcgaatttcctcaaagaaaagttccgaacaaagtgttcgaaacaaaattaattattcgtgagagcgtaaaagtattgacaaagggctaactcggcggtatattgcttatgtaagcatttacaaaggcgagttagtgctttttttatttttagtaaaccagtttactaaagtggtttaccttttctaaaaataatgtataataccgaatgaagacaaggaggatcaggcaatgcgaatggtggatctgattgaaaaaaagagggatggaaacgagctgtcgaaagaggaaatcgagtacatcgtcacgaactatacgaatggaaagattccagattatcaagtcagtgcattattgatggcaattttttatcaagacatgacaaatgaagaaatcacgaacttaacattggcgattgctaattctggtgatgtcatcgatttgagttctcttgaaggaataaaggtagataagcattcgacaggtggcgttggtgacacgaccacattgattttagcccccctagtagctagtgtcggagtgacagtggctaaaatgtctggacgcggtctaggttacacaggtggcacattagataagctagaagcaattcccggatttcagatcgagctttcggatgaagcattcgtgcgcattgtcaatgaaagcaaagtagcagtaatcggtcaatcaggaaacttggcaccggcggacaaaaaattgtacgctttgcgtgacgtcacagcgaccgttgattctcttccgctgattgccagttcgatcatgagtaaaaagatcgcggcaggagcagatgcaatcgttttggatgtgaccactggagacggtgctttcatgaagaatatcgaagatgcaagacgtctggcaaagaccatgacaaacattggcaaactagcgaaccgagaaacagtggcggtaatctcggatatgtcagaacctcttggcgaagcaatcggaaatagtctagaagttgtcgaggcaatcgaaacattacaaggaaatggtccagaagatctagtagaaatgtgctacgccttaggaagccaaatggttgtccttgctggcaaagctaaaacaatcgatgaagcaagaacgttgcttcaagaagctctggaatcaggtaaagcgttagcaaaattcaaagaaatgatccaaaatcaagggggagacccaaccatcgtggaaaaaccagaacgaattttgactgcacgttacacaatggaacttcctgctaaacaaagcggagtcgtgtcaaaaatcgtggcaaacgaattaggaattgctgcaatgatgctaggtgctgggcgtaaaaccaaagaagacgatattgatcacgccgttggattgaaactgcataaaaaaatcggggacactgtgacaaagggcgagtcattattgacaatctatagtaatgatgaagaaatctcttcggttattgaattattatataaaaatattgaaattggcgaatcagcaatgaagccaacattgattcatgacattatcacagaataaaaggaaaaaagcggatttaccgtttgaaagaaaaggggaaaagaaatggaactaaaccgaatgatcgaccatactattttgaaagcagacgcatctaaagaagctgtgatgcaaattatcgaagaagcgaaaaaatatcatttttactctgtctgcatcaatccagcatgggttgcgctagcaaaagaacaattacaaggcgaaccagtagccgtatgtacagtgatcgggtttcctttaggagcaaacacatccgagacaaaagcatttgaaacgacagatgccatcaataacggtgctgatgaagtcgatatggtcatcaatatcggtgcgttgaaatcaaaagatgatcaaaaagttcaaaaagatatcgaagcagttgttgaagcagcaaaagatcgtgcacttgtcaaagtgatcatcgaaacatctttattagatagagaagaaatcatccgagcatgcgaattagcaaaagctgcaggcgctgattttgtcaaaacatcaactggtttctcaacgggtggtgcaaaggtagaggatgtccgcttgatgcgtgaaacggtaggacctgaaatgggcgttaaagcttctggcggtatccataacgaagaagaagcaatggcaatgatcgaagcgggtgctacaagaatcggaacaagcgcaggagtagcaatcgtatctggttcaactggcgaaggctattaattttcaaaggagaaactcatggcagaactcaaacaagaatggatcaacatagctattgaagcgttagataaagcatacgttccttattcccattttccggtaggtgcttgtctcataacagaatcaggcaagatttatcaaggtatcaacatcgagaatgcatcatttggattaacgaattgtgccgagcgcacagctttcttcaaagccgtatcagaaggagaaagatcgtttacccatttagtcgtagcagggcacaccccggatcctatttctccatgtggtgcatgtcggcaagtaatggcagagttctgtgctcctgatatgccggttacgctagtgggagacaatggtgtgacgaaggcaacgaccgttcgagaactactgccttatgcatttactgaaaaagatctataactcatgttcattcagtcagctgactgttgaaaaataaaacaattattttaggaggctttacagaaatgaaaaaagcaaaattatttggtttaggtgctgtcgcactagcagcagggttatttttaggtgcatgcggcaacaacggctctactgattcatccggtggcaaaagctcatcagacacaacaactgcagcattgatcacagatacaggtggtgtagacgaccgttcattcaaccagtcagcttgggaaggattacaaaaatgggggaaagatcaaggtctttcacgaggcaatgatggcttccaatacttccaatcttcaaacgaatcagattatatcccaaatatcgaccaagcattgaatgctggattcaaaacgatttttggtattggttataaactaaaaccagcgatccaagaacaagcaacgaacaatacaggtacgaacttcgttatcatcgatgatgtgattgacggattagataacgttgtatctgctacattcaaagacaacgaagcttcttatcttgcagggattgcagcagcttacacgactgaaacgaacgtagtcggctttatcggcggcgtaaaaggtgaagtaatcgatcgttttgatgctggatttaaagccggtgttgatgcaggtgcgaaagaactaggaaaagaaatcaaagtattgaaccaatatgctggtgacttctctgctccagataaaggacgttcaattgctcaaggtatgtatgcacaaaatgcagatatcatcttccatgcttcaggtggtacaggtaatggtgtattccaagaagcaaaatcattgaacgaatcaggcgacaaaaaagtttgggttatcggtgttgaccgcgaccaatcagacgaaggcgaatacacattgaacggcgaaaagaaaaacttcacattgacatctacactgaaagcagtaggaacagtagtagaagatttggcacaaaaatcagctgacggtaaattccctggtggtgaacacactgtttatggattgaaagaagacggtgttggtctaacagaaggacaactttctgacgaagcgaaaaaagcagtggatgaagcaaaagaaaaaatcatttcaggtgacgtaaaagttccagaaactcctgaagaaaattaaaaccatttctatagccttgttagacacatgtttgacaaggctatggtttgattagaacaagaattgttcatttatccaagctgccttgagacagtttggataagggaacaattccctgaagtaatgtttgtttcaaaagaagaacgctcgctaagcgtgaatcttagtcaatcgttgccctagatagaaatcgttaggatgtgaaaaaaaggtggttcaagaaaatattgtcatagaaatgcagaatattaccaaagaatttggaacattcaaggcaaatgacaacatcaatttacaagtaaaggcaggagagattcatgcgttgcttggagaaaacggtgctggcaaatctacattgatgaacgtgctttccggattattagagccgacatcaggaaaaattttgatgcgtgggaaagaagtacaaatcacaagcccgacaaaagccaatcaattagggattgggatggtccatcagcactttatgcttgttgatgcctttactgtaacagaaaacatcgtgttgggaagcgaacctagtcgtgcagggatgcttgaccataaaaaagcgcgaaaagagattcaaaaagtttctgaacaatatggattatcagtcaacccagatgcttatgttcgtgatatttcagttgggatggaacaacgggtagaaattttaaaaacactttaccgaggagcagatgtactgatttttgatgagccgacagctgtattgacccctcaggaaattgatgaattaatcgtgatcatgaaggaattagtcaaagaaggcaagtcaatcattttgattacgcataagttagatgaaatcaaagcagtagctgaccgttgtacagttatccgccgtggaaaaggaatcggtacagtcaacgttaaagacgttacctcacagcaattagctgatatgatggtcggaagaacggtttcattcaaaacgatgaaaaaagaagcgaagcctcaagaagtcgttttgtctattgaaaatctagtggtgaaagaaaatcgtggattagaagccgtgaaaaacttgaacttagaagttcgtgctggcgaagtacttggtatcgctggaatcgatggaaacgggcagtcggagttgatccaagctttaactggtttgcgaaaggcagaaagcggacatatcaagctaaaaggggaagacatcaccaataaaaaacctcgaaagatcactgaacatggtgtaggacatgtgccagaagaccgtcataaatatgggttagtcctagatatgacattgtctgaaaacattgccctacaaacgtaccatcaaaaaccttacagtaaaaacggtatgctgaattattcagtgataaatgaacatgccagagaattgatcgaagaatatgatgttcgaacaacgaatgaacttgttcctgcaaaagctttatcaggcggaaatcagcaaaaagcaatcatcgctcgggaagtcgaccgagatcctgatctgttgatcgttgcaaatccaactcgtggactggatgtaggtgcgatcgaatttattcataaacgtctgatcgaacaaagggacaaatacaaagcagtgttattgattagtttcgaattagaagaaattttaaatgtttcggatcgtattgctgttatccatgaaggagaaatcgtcgggatcgttgatccgaaagaaacatctgaaaatgaattaggtctattgatggcgggctataccttagaagaagcacgaaaagagttagaaaagggggctggcgcacatgaatgatcgcagcgagaaattccgtaatttattagtgcctgtactttcagttgttttaggattaatcttaggcgcgatattgatggctgcttttggttttcagcccatccaaggttattcttctatgttagatgcagctcttggttcgcaaagaggaatcggtgaaacattaaggcaagcaacgccgttgatttttacagcattagggttttctgtagctaactcagctgggttcttcaatatcgggctttctggacaagcactttgcggatggatcgtcagtgtctgggtggcacttgcttttccagatcttccaaaagtcgttttgcttccattgtgtgtgatcctaggtgccttagcaggtgcgatggcagcggctgttcctgggttgctacgagcattttttggaacaagtgaagtgatcgtaacgatcatgatgaactatatcttattatacgtaagcacatttgctttacatgaagtgatgcctgaaagctaccgatcaagtttggactcttccaatatgatcagtcaaaatgcatcgttgcggttaccttggttaacacaagcttttggcggctctcgcgtaaactcaggtttgtttttagccatcatcgcgcttatttttgtttggctattgatgaagaaaacgactttaggatttgagatccgttccgttggtttgaatccttttgcttctgagtatgcagggatgagtagtaaacgtacgatcgttttgtcgatggtcatttctggcgctttggcagggcttggcggtgtggttgaaggattaggaacgtatcaaaacttcttcgttcaaacgacttcactatctattggatttgatgggatggctgtttccttacttggatctggatcagcaatcggtattcttttatcagcgattttgttcagtattttgaagatcggcggacttggcatgcagacaggagctggtgttccgtttgagatcgtcaatgtatcgattgctctgattatcttctttgttgggatcaatttcttgattcgtttcgtcatggctaagttcttccaaggaaaaaaacaagaagaaatcgttgcgacaatcgaagcgaagccaacgaatcaaaaccatgaaggaggcgaactataatgtcgactatcgaattaattgccttgattcttacttcaacactggtttattcaacaccgttaattctaacatcactaggcggaacgttttctgaacgcagcgggattgtaaatgtagggttagaaggaatcatggtcatgggtgcttttagttccatcgttttcaacttgacgatgagcccctcacttggttccatgacgccatggatcgctattttagtgggtggcgtcgtaggtatcctattttctttgatccacgcagtagcaacagtcagcttgcgtgctgaccatattatcagcggtacagtgatcaatctgatggcaccagctttaggtgttttcttgatcaaagcatggtatgggaaaggtcaaacagataacatcacgcagaatctgggatatttctctttcccaggtttagcagatattccggtcattggaccaattttcttcaaaaatacattcttgcctgcttattgtgcaattttgattgctgtcattgcttgggtgatcatctttaagacgaaattcggcttacgcctccgttcagttggtgaaaaccctcaagctgccgatacattaggtatcaatgtatatgctatgcgttattcaggcgtgctgatttcaggcttgttaggcggtatgggcggtgctgtttttgctcagtcgatttccggtaacttttcagctggtacgatcgttggacaagggttcatctccatggctgctatgatctttggtaaatggaatcctttaggcgcaatgggtgcctcactgttctttggttttgcacaaagcttgagtatcatcggtgcacaattaccagttatttcttcgattccaccagtattgctgcaaattgctccatatctgctgacaatcattgtgttggttgttttcttagggaaagcttctggaccaaaagcaaacgggaagaactatatcaaatcaaaataatcttttagcgaataaaaagggtgggttacgggaagtgtttttcgtctcgccctttttgttttaaaggtaataaaaataaaaagaaagaaggaataatcatgtttaaacgcgtacatctaatcgtcatggattcagtaggaattggagaagcaccagatgccgagaagttcggtgacgttggttctgatacattaggacacattgcaaaagaagcaggattgaatattccgcatttagagcagcttggtttgggaacgattcggcctcttgaaggtgtggaatcagtgaaagatcatcaaggctatgcgacgaaattagaagaagtttctgtagggaaagatacgatgacaggccattgggaaatcatgggattgaatatcaagacgccgtttcgtgtgtttccgaacggattccctgatgatctgatcaaacaaatcgaagagttttctggccgtaaagtcgtatgcaacaaaccatatagcggaacggctgttattgacgattacggtgaacaccaaatgaagacaggtgatttaatcgtatatacttctgccgatcctgtccttcagatcgcggcacatgaagaaatcattcctttagaagaactataccggatttgccaattcgttcgtgatataacaaaagatgacccgtacatgattggtcgaatcattgcacgtccatatgtgggagaaccaggagacttcacacgaacaagcaatcgtcatgattatgcgttgaatccattcggacacaccgtccttgattctttgaaagaagcaggaaaagatgtgattgctgtaggaaagatcaacgatattttcaatggacaaggaatcactgaatctgtccgcacgaaaagtaatatggatggcgtcgaccagttgctgaacgttatgaaaaaagagtttacaggtatcagctttaccaatttagtagattttgatgcattatacggtcatcgccgggatgtagtcggttatgcgcatgcgattgaagaatttgacttgcggatcccagaattgcttgaagcgatggaagaagacgacttgctaatgattacagccgatcacggaaacgatccgacatttactggtaccgatcatacacgagaatatgtaccgttattggcttacagtaaaaaaatgaaagaacaaggggcgttgcctcaaggatattattccgatatctccgcaacgattgctgagaactttagtgtttcttcgactgaaaatggcgaaagcttcttaaaattattaaaataatctttttaaaataggagaaagcaaatgaccaagttaagtgagatgttacaagaaacgacccagtttatccttgataaaggagtaaaagaaattgattttggtttgatcctaggttcaggattaggtgaattagcagatgaaatcgaagatgctgtaatgatttcttatgatgagatcccgttctttcctgtttcgacagtagttggacatgcaggacagctggtttacggatctctagcaggtaagaaagtgttagccatgcaaggaagattccactactatgaaggtcattccatgcaaacagtgacctatccagtacgtgtgatggccggactaggtgcccattcagtcattgtgaccaacgcatgtggcggtgtcaacgaatcctttgtaccaggagatttgatgctgattaccgatcacatcaattttactggtgaaaatcctttgatcggtccgaatgaagatgaaatgggccctagatttccagatatgagtcaagcatatacgcctgactatcaagcaacagcaaaagcagcagcagaaaaactaggtttggatcttaaagaaggcgtatatatgggctactctggaccaacttatgaaacgcctgctgagattcggatgtctcgaacaataggggccgatgcagtagggatgtcgactgttccagaagtcatcgtagcagctcacagcggattaaaagtgttaggaatttcttgcattaccaacttagcagcaggtatgcaagcgaatctgagccatgaagaagttgtagaaacaactcagagagtcaaacaatcttttaaagcattggttaaagaaacattgacattattgtaataggaggagcaacaaaatgagtgtgcatatcgaagcgaaagaaggcgagattgccgataagattttacttccaggcgatcctttacgagctaaatatattgcggagactttttttgaagaaccagtttgctacaatcaggtccgtggtatgctaggctttaccggcaaatataaaggagaacgtatttctgttcaaggaacagggatggggatgccatcagccaccatctatgcccatgaattgatccagtcatatggcgtaaagaaattgatccgagtaggtacatgcggggcattgtcaaaagatgtccatgttcgtgatttggtactagcgcaaggcgcagcaaccagctcttcgatgatcgaaaaaaatttccaagcctttcactttccaccaatcagtgatttcaatctattactgaaagcatatgagatagcgaaagaaaagggctatacggttcatgtaggaaatgtcctttcggaagattctttctacaaagatgatctgacagagacattccaattagctgaacttggcgtcttaggagtggaaatggaagcagcggctctttattacttaggcgcgaaataccatgtgcagacattaagtttgatgaccgttagcgaccatttgattactggggaagaaacaacagctgcagaacgtcaatcgacgttcaatgaaatgatcgaagtaggattggaaacggcgattcaagggtaaagtaatagctaaatagcaagaaagtgtgactgcctaaacttctattaatagaaattaggcagtcacattttttgcagaaactgtctcacataacctgaaaacaatgacaaccgttgcttcagttacttcgagagtcctcctaaagtcaaccatttgaatgtctaaaatgtgaatcgacattccttttaaattgcagacgaatggcacaatcttaatcaaataaaaaagaacagaaagaagcgagttacgctctttctgttccgaactaggccaccaacaggagatgacaaatgggtcatctcctgttggtggcttcgtctaaatgaataccttaatcattcaattgctcatgtgatgatgcttgaagaatgaaaaattcaacttaaatcaagtctgcatcaataataagtgtttcgaataatacagcgtgctcaagtgaggtgcttgatccaggacgtcctggtaggcgatatacttctactcgctgtcctgcttttccaggaaatgctcgacgtatttgaatgttaccatcaactattcttgtaaagctatagaatgttctgccgtcaaatgtttcaaaatgatatcttccatcaatgtaaacgaccaatctttcttgactgtaaaaacgttcaggtgtcaatgttaaataagcaaatgctcgagagccttctcgccctgcagacaacaagtttgtttctgttacgcctgtttccacttggatattgtcatatttcgcccaaccattccatgtagaagcaaatcgtataaggtatgtattttcatcgtctggagtcgtaaaagtaagtttaccacgttcccagttctcattattatgttcactgcgctctaatacatcaaaaccgacatcatgattcatgatccctaattcaacacgtcctggtgctgattcgcttgctgcaacatcataactaaatgtatacgtggtacttggttttaatgtcacgtattgatgaacattttcaccatctcttgctaaagcaaagttatttccattaacggtttgcagtgtgggattatttggctcttggccactagcgatccaatgatcaaacccgtcattaaagtcaccattatggatatacaattgttgctcaatggcctgcttacttgtactaacgaagtcagttgttgatagacttgttgcgaatgtcgaaacggatcctcctaaacttaaaaataccatacctgctgccatcactgtttttaaattatttttgatcatcttgtatctcctcgctctctatttttattttttgattttgtttgtaagatgcagccgtgtaatctgtctgtatctcacaaattaatcataaccgagaaaataacggtcgtgtaaacgcttttttctatgtaacatttattattagaaaaaaatgataaaataaatagttttatgaggttgacttctatctaaatttcatttattagcaacataaaaaaagatggagagttgtggtgatagctcatacaaatgaaacttcctcttagaaacaggataaaagaatgaaatttaaataagtttctaaaaaaaatgttcgctccacatctgaatgtttgtcagacattcttttttctctcaatgctacgccttctctcttaattttttatttattcaaacagtacttactattataatcatatagttattatgtaaattgatgtcattcgtattagatagccaagactaccgtcttccaatatctaaaaaaacagccccttcatctcttacaataataggaggtgagagggctgtcttacttacaatagagtatctattataggtagtattttttagctactgttaagtcatcatttaattcataaacaagtggttgacctgttgggatttcaagatccatgatgtcttcgtcagagataccttcgatatgtttagctagagcgcgtaatgagttaccgtgtgcagctactaaaacagttttgttgtctagtaatgctggagcaatttcatcttgccagaatggcaaagcacgttctaatgttactttcaagttttcgccaccaggaatatcgcgtttgtctaacattgcgtaacgacggtcgtttgctgcagaaccttcgtcagtttcttccattaatggaggaagagtatcgtaagaacgacgccagatgtgtacttgttcgtcgccgtatttttcagctgtttcttttttgttcaaaccttgtaatttaccatagtgacgttcgttcaagcgccatgatttgatttgtggtacccaaagttgatctgaatattctaaaatcaagttacatgttttgattgcacgagttaaaacagaagtataggcaacatcaaattcgattccagcttctttgattttgcgtccgccttcttttgcttcttcgattccttctggtgctaggtttacatcagcccaaccagtaaattggttcaatgcattccattcactaagaccgtgacgagaaaaaactaattttggcatgtttagctctcctttaagataggtttatatttctgaaaatttcagttctgttttattgtacaattttttggaagagatttccatcgaaaaattggataagattctatgagaaaacgagtagagaagataaaaaaacgaacagctgcgaaagcactgttcgtttttaggcattagatgcataattgctcgatttctttttcaggcaaattgatatatttataacatgttccaactgaaacaccgcattttgaagaaataaattggattgtttcttttttttcataatagagacgccggatttttttgatcgtttttgcatcaatttttggtcttccgccgatttttccttttttacgagcttcatctaatccaactaatgtacgttctttgatcaatgcgcactccatgtttgctaggttttccatcaattggaaatagatttttcccatttcgcgcgtatcgattccttcatcaatgctaatcaagtgcagcccgcggtctttgaataattgcgtaagttctgttaattgccgtgtagatttgcccaatcgatgaagttggcagacgactagtgcatcgccttgctgcatgtcagcaatcactgattccaaatgaacagcagtagcatcgttttgttccacttcatatgtctcatggaaaatttcttgacaaccaaagtcagataattgttcaacctgagttgttaaatcaacatcatttatggttgtgcgtgcataaccaataattttcatggtgattcctttctagcagtgattttctaactggatataacagtaaaaatgtagcataaagtacgtcaaaaagatagttttttcgcaaattttccgctgtctttttttattggatgatcaagcagtttttctttatttatggcggatggcatcaagaatctcaacacctttttctgagccaacaacaacttttgaaaccatatttaggaaaagtccatgttcgactaccccaacaagttcatctaaataggtagctaaactttctggttgttcaataacttctagatgcagatcaatgatataatgaccaccatctgtggttaggacttcgccgttttcgtctgtacgcaaaacaggttggaatcctttttcgtcaaaaatatgaagtagctgtttggagccataagggatgacttcaactgggagtgggaacttcccgagtttatggactaatttagaagaatcaacgatccaaatcgtttcttttgagtacgtagcaactattttctcgaaaagcaaagcagcaccgccgccttttattccttgaaaatcagcactgatttcatcagcaccatctatcgtcagatcgactactgggacttcgtcgatactctttagcggtattcctaatttttccgcttgttcttttgtcgcatttgaagtagtgactcctgtgatacgtaatccttcttcacgcatgcggcgaccaatctcttctaccatataataggcggttgaaccggtcccgagaccaacgatcatcccgtcctttacgaatttcgcggcttcaatgccagctaattgttttaaattcatctttgcatccacctttttttagtttgagcttcgtgctttcctcactattttagcgtgatttacggcaaaaagataccattcttttttattccaataaagctttttcaaaaaaatttccgtctcttgttgacatgctttttcattcatgatattctaacaaaggtgctttatctacaggtttctgtgaagaaacgtgctgactgtttatcaaagcatatttgataaggatgcagacattgcatttattttttatcgcaaaaaaagaaccacctggatgtgtggaactagacgcaaatcgtgggaaggaggaaacaaggaatgcctacaattaaccaattagtacgtaaacctcgtaaatcaaaggtggaaaaatctaattcacctgctttgaacaaaggatataacagctttaagaaaactcaaactaacgtaaactcacctcaaaaacgtggggtagcaactcgtgtgggtacaatgacacctaaaaaaccgaactcagctttacgtaaatatgcacgtgttcgtttgtcaaacttaattgaagttactgcttatatcccagggattggtcataacttacaagaacacagtgttgtattattacgcggtggtcgtgtaaaagacttaccaggggtacgttaccatatcgttcgcggtgctttagatactgctggtgttaacgaccgtaaacaaagccgttctaaatacggaactaaaaaacctaaagcttaattttaattattaaacaaatgaaacttgcttctattatatagaagtaattactatgaacaatatttcggaaggaggagttacggatgccacgtaaaggtcctgttgcaaaacgtgatgttttaccagatcctatttataactcaaaattagtaactcgcttgatcaaccgtgtaatggttgacggaaaacgcgggattgcagctaacattatctataatgcctttgatttgatcaaagaatctacaggtaacgatccattagaagtgtttgaacaagcaatgaaaaacgttcaacctgttcttgaagttaaagcacgtcgtgttgggggttcaaactaccaagtaccagttgaagttcgccctgaacgccgcgttactctaggtcttcgttgggtagtaaactacgctcgcttgcgcggtgaacacacaatggaagaacgcttagcaaaagaaatcatggatgctgcaaacaacacaggtgcttctgttaaaaaacgtgaagacactcataaaatggctgatgccaaccgcgcgtttgctcactatcgctggtaagattctctctgtttggtcggcttttataagtcgacctcagatagtgtccttatttttagcaactagatagtaaagagaggagaaacaaggagaatgaccagagaattttctttacaaaacactcgtaatatcggtatcatggcccacattgatgctggtaaaacgactgctactgaacgtatcttgtactatactggtaaaatccataaaattggtgaaactcatgaaggagcttcacaaatggactggatggaacaagaacaagaacgtggtattacgatcacttctgctgctactacagcacaatggaagggtcatcgaatcaacatcatcgacacaccaggacacgtagacttcacagttgaagttgaacgttccttgcgtgtacttgatggtgctgtaactgttcttgatgcacaatcaggtgttgaacctcaaactgaaacagtttggcgtcaagcaacaacttacggtgtacctcgtatcgtatttgcaaacaaaatggacaagattggtgctgacttcttatattcagtatcaactttacatgaccgtttgcaagcaaacgctcacccaatccaattaccaattggtgcggaagacgacttcacaggaattatcgaccttgtaacaatgaaggctgaaatgtatacaaacgatcttggaacagagattgaagaaacagaaattcctgaagaataccgcgaattagctgaagaatggcgcgaaaaattggttgaagctgtagctgaaactgatgaagaacttactttgaaatacttagaaggtgaagaaatcactgaagctgagttaaaagaaggtatccgccgcgcaacagttaacgtagaattctacccagtactatgtggctcagcatttaagaacaaaggggttcaattactattggacgctgttcttgattacttgccatcaccgttagatatcccagcaatcaaagggattgaccctaaaactgatgaagaagtagaacgtcctgcagacgacagcgctcctttctcagctttagcatttaaagttatgactgacccattcgtaggtcgtttaactttcttccgtgtgtactctggtgttttaaaatcaggttcatacgtacaaaacgcaacaaaaggcaaacgcgaacgtgttggtcgtatcctacagatgcatgccaactctcgttcagaaatctctgaagtttacgctggagatatcgctgctgctgttggtttgaaagacacaactactggggacacactgtgtgatgaaaagaatctagttattcttgaatcaatggaattcccagaaccagttatccaagtcgctattgaacctaaatcaaaagctgaccaagataaaatgggtgtggctttacaaaaactatctgaagaagatcctactttccgtgctgaaacaaacgtggaaacaggcgaaacaatcatcgctggtatgggtgaacttcacttagatatcatcgttgaccgtatgcgtcgtgaattcaaagttgaagctaacgtaggtgcgcctcaagtatcttaccgtgaaactttccgtgccggcactcaagccgaaggtaagtttgtacgtcagtctggtggtaaaggtcaatacggtcacgtatggatcgaatttacaccaaacgaagaaggtgctggtttcgaatttgaaaatgcgatcgtcggtggggttgttcctcgtgaatacattccagctgttgaaactggtttgaaagatgctatggaaaatggtgtcttagctggctatccattagtagatatcaaagctaaactttacgatggttcataccatgatgtcgattcaaatgaaactgccttccgtgttgctgcttctatggcattacgtgcagcagctaagaaagctaatccagtaatccttgaaccaatcatggctgtagaagttgttatccctgaagattacttaggtgatgttatgggtcacgtaactgctcgtcgtggacgtgttgaaggtatggaagctcgcgctggcggccaacaagttgttcgtgcgatggttccacttgctgaaatgtttggttatgctacaactcttcgttctgctactcaaggtcgtggtacatttacaatgacatttgaccactacgaagatgtaccaaaatcagtacaagaagaaatcattaagaaaaacggcggaaaagctgaataatttcttaaaaccggatagtcctgcaaagagattatccaaagagactatatttttaatatagtttcgtgtaaaataattatcgatgatatgggcatgtgatgtacctagtgtacatcatatacctatcagacaaataaaaaatatattgtatttttaggaggacattttaaaatggcaaaagaaaaatttgaccgttctaaaccacacgttaacattggtactatcggacacgttgaccatggtaaaactacattaacagctgcaatcacaactgtactatctaagaaaaacggcggccaagctatggcttacgatcaaatcgatggtgctccagaagaacgcgaacgcggaatcacaatctcaacagctcacgttgagtatgaaacagatacacgccactacgctcacgttgactgcccaggacacgcggactacgttaaaaacatgatcactggtgctgctcaaatggacggagctatcttggtagtttctgctgctgacggcccaatgcctcaaactcgtgaacacatcctattgtctcgtcaagttggtgttccttacatcgttgtattcttgaacaaagtagacatggttgatgacgaagaattactagaattagttgaaatggaagttcgtgacctattaacagaatacgaattccctggtgacgatgttcctgtagttgctggttcagctttgaaagctctagaaggcgacgcttcatacgaagaaaaaattcttgaattgatggctgcagttgacgaatacatcccaactccagaacgtgacaacgacaaaccattcatgatgccagttgaagacgtgttctcaatcactggacgtggtactgttgctacaggtcgtgtggaacgtggacaagttcgcgttggtgacgaagttgaagttgtcggtattgctgaagaaacttcaaaaacaacagttactggtgttgaaatgttccgtaaattgttagactacgctgaagctggagacaacattggtgctttactacgtggtgttgcacgtgaagacatccaacgtggacaagttttagctaaaccaggtacaatcacacctcatacaaaattctctgcagaagtatacgtgttgacaaaagaagaaggtggacgtcacactccattcttcactaactaccgtccacaattctacttccgtacaactgacgtaacaggtgttgttgaattaccagaaggaactgaaatggttatgcctggcgacaacgtaacaatggaagttgaattaatccacccaatcgctatcgaaaacggtactaaattctcaatccgtgaaggcggacgtacagttggtgccggtgtcgttacagaaatcaaagcttaattgatttaagcaaaactaagcaacatttattcggacgtaatcgcttggaatgaagatctcaggatctttgttccgagcttttttatttattgtaggatcagggaaaaagacaggagcattataatagaagaaacacgaaataaaagagtcagtattttctaaatgaaactttatgaaaacaaaatgttttttacaagaaaaagccttgcgttgtgagtttatatatattataatgacaaaggtgcgtttactttagtgaattgcacagacgtaatcagattgatttcgtcggctaagaaacgagaggttgcgacacgcccggacgctttgccacgaacgagcgtgacggaaattttcgtggagctatgtctacttttcaaaataggcgaaggagggaacaagatggcaaaacaaaaaattcgtatccgtttaaaagcgtatgaacaccgtattttagatcaatcagcggataaaatcgtggaaactgcaaaaagaactggagctagcgtgtctggtccaattccattaccaactgaacgcagtctttacacaatcattcgtgcgactcataaatacaaagattcacgcgaacaattcgaaatgcgtacacacaaacgtcttatcgacattgtgaacccaacaccaaaaactgttgatgctttgatgaagctagacttaccatctggtgtaaacatcgaaatcaaattataaaactaaaacaaaaataatggaggtgtactcatgaccaaaggaatcttagggaaaaaagtgggaatgacacaaatcttcactgaatctggtgaattaattccagttactgttgtagaagctacgccaaacgtagtactacaagtgaaaacaatggaaacggatggctacgaagctattcaagttggttaccaagatatgcgtgaagttttatcaaacaaacctgcgaaaggtcatgttgcaaaagcaaacacggctcctaagcgcttcattcgtgaattcaaaaatgttgagctaggagaatatgaagtaggaaaagaaattacagtagatgttttccaagcaggagacattattgatgtaacaggtactacgaaaggtaaaggattccaaggggttatcaaacgccatggacaaagccgcggaccaatggctcacggttctcgttaccatcgtcgtcctgggtcaatgggtccagttgcacctaaccgtgtattcaaaaacaaacgtcttgctggccgtatgggtggcaaccgcgtaactatccaaaacttggaagttgtacgtgtagatgcagaaagaaatgttatcttgatcaaaggtaatgttcctggagcgaaaaaatctttaatcactatcaaatcagctgtgaaagctaaataattgtaggaagaaaggaggaactaaggaatgccgaatgtagcattattcaaacaagatggaagccaaaacggtgaaatcacacttaacgaagaaatcttcggaattgaacctaatgaaagtgttgtttacgatgcaatcgtaatgcaacgtgcgtcattaagacaaggaacacacgcggttaaaaaccgtagcgctgttcgtggcggtggacgtaaaccatggcgtcaaaaaggaacaggtcgtgcacgtcaaggatctatccgctcaccacaatggcgtggaggtggcgtagtctttggaccaacaccacgttcttacagctacaaacttcctaaaaaagttcgtcgtttagcaatgaaatctgtattgtcagaaaaagttgctgaaaacaacttggtagcaatcgaaggcttgaacttcgacgcaccaaaaacaaaagaattcaaacaagttcttgctaacttatctatcgactctaaagtattggttgttctagaaaaaggtaacgactttgctgctttatcagcacgtaacttaccaaacgtttctgtagtaacttctgataatgtgagtgtgctagacgttgtatcaaatacaaaagtgttagcaacacaaactgctcttactcaaattgaggaggtgcttgcataatgaacttactagacgtaatcaaacgcccagtgatcactgaaaaatcaatgcttgccatggacgacaagaaatacacttttgaagtggacactcgcgcaaacaaaactttagtaaaacaagcggtagaagctgcttttgacgttaaagtcaaaaacgtgaacatcgtgaacgtacgtgcgaaattcaaacgtatgggcaaatatgcaggatatacaaaaaaacgtcgcaaagcgatcgttacattgactgaagattcaaaagaaatccaattattcgaagctgctgaataagcgctaatagataactcattaaattaggagggaaaaacgtggcgattaaaaagtacaaacctacctcaaatggtcgtcgtaacatgacaggttctgattttgctgaaatcacaacatcaacacctgaaaaatcattgttacaaccattgaaaaaccatgctggacgtaacaacaacggccgcatcactgtacgtcatcaaggtggcggacacaaacgccaatatcgcgtgatcgacttcaaacgtaacaaagacaacgttgttgcaactgttcaaacgatcgaatatgatccaaaccgttcagctaacatcgcgttagtacactatgaagatggagtgaaagcttacatcttagcacctaaaggactagaagtgggtatgaaacttgtttcaggtccagaagcagatatcaaagtcggaaatgctcttccattagaaaacattccagttggtactgttatccacaacattgaaatgaaacctggtaaaggtggacaattgatccgttctgctggtacaagtgctcaagtacttggtaaagaaggcaaatacgtattgatccgcttgaactctggtgaagttcgtatgatcttagctgcatgccgcgcaacaatcggttctgtaggtaacgaacaacacgaattaatcaacatcggtaaagctggacgctctcgttggatgcgtaaacgcccaactgtacgtggtagcgtaatgaaccctaatgatcacccacacggtggtggtgaaggtaaagctcctattggacgtaaagcaccagtttctccttggggtcaaccagctcttggttacaaaactcgtaacaaaaaagctaaatcagacaaacttattgttcgtcgtcgcaaaaataaataattactttgaccatgtgtcgcacattttgagaggaggttcaccatgggtcgtagtttaaagaaaggaccttttgtcgatgagcatttaatgaaaaaagttgaagctcaagcaggggttgaaaagaaaaaagttatcaaaacttggtcacgccgttcaacagttttcccaagttttgttggatataccatcgcagtttatgatggacgtaaacatgtaccagtttacatccaagaagacatggtaggacacaaattaggtgaatttgcacctacaagaacttatcgtggacatgctgctgacgataagaaaacgaaacgctaatttgaggggaggataaatccaaatggcagaacaaatcacatcagctaaagcaactgcaaaaacagttcgcacttcacctcgaaaagcccgtttagtaattgaccttatcagaggtaaaagtgtcgcagatgcaatttcaatcttgaaattcacaccaaacaaatctgctggaatcattgaaaaagtattgatgtcagcagttgcgaatgcagaaaataactttgacttagatgttgaaaacttggtagtaaccgaagcttttgttaacgaaggacctacaatgaaacgtttccgtcctcgtgcaaaaggatcagcttctccaatcaacaaacgtacaagtcatatcacggtagtcgtatcagaaaaataaggagggataatcagtgggtcaaaaagtacatccaattggaatgcgtgtaggcatcatccgcgactgggatgctaaatggtatgctgaaaaagagtatgctgagttcttacacgaagatttaagaatccgtaaatttatttcaactaaacttgctgatgctgctgtatcaacagttgaaatcgaacgtgcaacaggtcgcgtaaacatttcaattcacacagctaaaccaggtatggttattggtaaaggcggttctgaagtcgaaagcctaagaaaagaattaaacaaattaactggtaaaagaatccacatcaacatcgtggaaatcaaaaaaccagatctagatgcaaaattagtaggtgaaggaatcgcacgtcaattagaaaaccgtgttgctttccgtcgcgctcaaaaacaagcgatccaacgctcaatgcgtgctggcgctcaaggtatcaaaactcaagtatctggtcgtctaaacggagcagatatcgctcgttcagaaggatactcagagggaactgttcctcttcatactttacgtgcggacattgattacgcatgggaagaagcagatacaacatacggaaaactaggagttaaagtgtggatctatcgtggagaaattcttccaactaaaaaaaacactgagaaaggagggaaataatcatgttagtacctaaacgtgtaaaacaccgtcgtgaattccgcggaaaaatgcgcggggaagctaaaggcggaaaagaagtagcattcggtgaatacggtttgcaagctgttgattcacattggatcacaaaccgccaaatcgaagctgctcgtatcgcaatgactcgttacatgaaacgtggtgggaaagtatggattaaaattttccctcacaaatcttatactgccaaagcaattggggtacgtatgggttctggtaaaggggcacctgaaggatgggttgcaccagtaaaacgtggtaaaatcatgtttgaaatcgcaggcgttcctgaagaagtagctcgtgaagcgttacgtctagcttctcacaaattaccaatgaaaactaagatcgtaaaacgtgaggaaatgggtggtgaatcgaatgaaggttaaagaaatcagagaattaaccactgccgaaatgcttgatcaagaaaaacaattaaaagaagaattgtttaatcttagattccaattagcaacaggtcaattagaaaacactgcacgtattaaagaagtacgtaaatcgattgcacgcatcaaaactgtgttgcgtgaacaagctaagtaattatggaaggaggccattaagcgtatgactgaaggaagaaatcaacgcaaagtttatcaaggtcgcgtggtttcagacaaaatggataaaacaattaccgttgctgtcgaaacaaagaaaaaccaccctatctatggcaaacgcatgaactattctaagaaatacaaagtgcatgatgaaaacaacacagcaaaagttggcgacatcgtgagaattatggaaactcgtccattatcagctacaaaacgtttccgtttgttggaagtagtcgaagaagcagttattatctaataacacgagattttcctatatagattgaatgcaaaatctgaaaggaggatacacaacgtgatccaagcagaaagtcgtttaaaagtcgctgataactcaggcgcacgtgaaattttgacgatcaaagtccttggtggatctggtcgtaaaactgctaacatcggtgatgtgatcgttgctacggttaaacaagcaacgccaggtggggttgtcaaaaaaggtgacgtcgttaaagccgttatcgttcgaacaaaatcaggagctcgtcgtacagacggttcatatattaaatttgatgaaaatgctgcagtgattattcgtgatgataaaagccctcgtggaacacgtatctttgggccagttgcacgtgaactacgtgaaaacaacttcatgaagatcgtttcactagcaccagaagttttataatcttgagacacttatcaaaggaggtgcgaaacagttatgtttgttaaaaaaggcgataaagttaaagttatcactggaaaagacaaaaacaaagaaggcgttgtactagcagcgttcccgaaaaaagataaagttattgtcgaaggtgtaaatgtcgttaaaaaacaccaaaaaccttctcaagctgctcctcaaggtggaattgttgagatggaagcgccaattcatgtttctaacgtgatggtggttgactctactggtgtagctggccgagttggctacaaagaagtagacggcaaaaaagtccgtgtttctaaaaaaaccggtgaagttttagataaataaaagtttaaggaaggagggtcttactgaatgaaccgcctaaaagaaaaatatcttaaagaagtaactccatcattgatggaaaaatttaactatagctctgttatgcaaacacctaaagttgaaaaaatcgtcatcaacatgggtgttggtgatgcggtatcaaacgctaaaaacttagataaagcagttgaagaattaactttgatcactggtcaaaaaccaatgattacaaaagctaaaaaatcaatcgctggattccgtttacgtgaaggaatgccaattggtgcaaaagttacattgcgcggagaaagaatgtacgaattcttagacaaattggtttcagtttcactaccacgtgtacgtgacttccatggtgtaagtaaaaaagcctttgacggtcgtggaaactatactttaggtattaaagaacaattgatcttcccagaagtagattatgatttagtagataaagtacgtggtatggacatcgttattgtaacaacagcaaactctgatgaagaatctcgtgagttgttgacacaattaggcatgccattccaaaaataattaaaggaggcgaactacgtggctaaaaaatcaatgattgctaaaaacaaacgtcctgcaaaattttcaacacaagcttatactcgttgcgaacgttgcggacgtccacattcagtttatcgtaagttccatctttgccgtatttgcttccgcgaacttgcctataaaggtcaaattcccggcgtgaagaaagctagctggtaaaaagtaaattcgcataagaaggaggtaaaagatcaatggtcatgacagatccaattgcagattttctaactcgtatccgtaacgcaaacatggttaaacatgagtctttagaagtacctgcatcaaaaattaaacgtgacatcgctgaaatcttgaaacgtgaaggtttcgttcgtgatgttgaatacatcgaagatgataaacaaggcgtgatccgtgttttcctaaaatttggtaaaaacggcgaacgtgttatcacaaacttaaaacgtatctctaaaccaggtttgcgtgcttatgtcaaagctgacgaagtaccaaaagtattgaacggtttaggtatcgcaatcatttcgacttctgaaggtgttgtcactgataaagaagctcgtgaaaaaaatatcggcggcgaagttatcgcttacgtatggtaatcaagtagaatctacaaggaggtgtctttaagtgagccgtatcggaaataaagtcgttgttatccctgaaggagtaacagttactcaagaaggaaacaacgttacagttaaaggaccaaaaggtgaattgactcgtactttctcagcagatatcaaaatgaatatcgaaggaaacgaagtgactttcactcgtccaaacgacagtaaagaaatgaaaacaattcatggaacaactcgtgcgaacttcaacaacatggttgtaggtgtcagcgaaggtttccaaaaagcgttagaactaatcggggttgggtaccgtgcacaattacaaggatcaaaacttgtattgaacgttggttactcacatccagtagaaatcacaccaccagctggagtaactgttgaagtaccagctaacacacaagtaattgttaaaggtgcgaacaaagaagaagttggcgaattagctgcaaatattcgtggaactcgtcctccagaaccttataaaggtaaaggtattcgttatgttggcgaatatgtacgccgtaaagaaggtaaaactggtaaataatcgtttagaaaaattgcatagaagccagcagcaggaaaaaggcatttggctgaagtttaccttcaaaaaaataaatttttacttgtgccgcagcttctatttttcgaaacgtatttactgcttgaaatagtagtacaataaaaataaagaggtgacaattgtgattacaaaaccagataagaacaaaacacgtcaaaagagacatcgtcgtgtacgtaacaatatctctggtactgctgagcgcccacgcttgaacgtttttcgttctaacaaaaacatctacgctcaaattattgatgacgtagcgggtgtaacgctagcaagtgcctctaccttggataaagaaatttcaggtggaacaaaaacagaagcagcacaagctgtcggtaaactagttgctgaacgtgcagctgaaaaaggcattaaagtagtagtctttgaccgtggtggatacctttaccatggccgtgtgcaagctttagctgaagctgctcgcgaaaatggactagaattttagaagaaggaggaataccattcatggtttatatcgatccaaaacatttggaattagaagaccgcgttgttgcaattaaccgtgtaacaaaagttgttaaaggtggacgtcgtctacgttttgctgctttagttgttgtcggtgacaaaaacggacacgtaggatttggtacaggtaaagctcaagaagttcctgaagcaatccgtaaagcaattgaagatgcgaagaaaaacttagttgaagtacctatggttggttcaacaatcccacacgaagtaatcggtgcttttagtggtggtagaatcctaatgaaacctgctgtagaaggttctggggttgctgctggcggaccagttcgtgccgtattagaattagctggggtagcagatatcacttctaaatctttaggctcaaatacaccaatcaacgttgttcgcgcaacagttgaaggtttgaaacaattgaaacgtgcagaagaagttgcagaacttcgcggcaaatcagttgaagaattaatcggataaggaggacaacaataatggctgaattaaaagttactttaaaacgcagtattatcggacgtcctcaaaaccaacgcgatacagttaaagcgttaggtcttacaaagattaacagttcagtggttaagccttctaatgaagcaattaaaggcatgatcaatactgtttctcacctagtggacgttgaagaagtttaattaaaaaaatcagaactagaatattaaggaggtgccaaacctatgaaacttcatgaattaaaacctgctgaaggttcacgccaagtacgtaaccgtgttggtcgtggtacttcatctggtaacggaaaaactgccggacgcggacaaaaaggacaaaaagcccgttcaggcggtggtgtgcgtttaggatttgaagggggacaaacaccattgttccgtcgtttaccaaaacgaggattcacaaacgtgaaccgtaaagactatgcagtcatcaatcttgatgtattgaaccgctttgaagacggagctgaagtaactcctgttgctttagttgaagctggaatcgtgaaaaacgaaaaagctggaatcaaagtattagctaacggggaactaaacaagaaattaactgtgaaagcagcaaaattctctaaagcagctcaagaagcaattgaagcggctggtggatcaatcgaggtgatctaatgtttagactattaaaagatgcttttaaagtaaaagacattagatcgaaaatcctatttactgtatttgtgttgtttgtatttcgcctaggtgcacatatcactgtaccaggcgtaaatgctgcttcattgcaaaacctttcttctttgccatttttcaacatgttgaacttggtaagtggtagtgcgatgcaaaacttctccattttctcaatgggggtttcaccatacattactgcttctatcgtcattcagcttcttcaaatggacatcgtgcctcgatttgttgaatggtcgaaacaaggggaagttggtcgtaaaaaattgaatcaagccactcgatatctgacattagtattggcatttatccaatctgtcggtatcactgctggattcaatcaatacgctcaattaggtttcgtgaataatcctaacgtagcaacttacgtaacgatcggtttgattctaacagccggtacgatgtttgttacttggctaggagaacagatcacagaaaaaggtatcggaaatggcgtatcaatgatcatttttgcagggatcatttctagattgcctgaaagtatcagagaaatttatgaagattactttataaatatcgatccttcagacatatggaaatctgctatttttgtggccattttattagtagcgatcttattgatcgtgacattcgtaacatttttccaacaagctgaacgcaagatcccgattcaatatacgaaacgcgtcgctggcgcgcctacaagcagctatctgccgttgaaagtaaatgcagctggagttattccagttatctttgctagttcgtttattgctacgccaaatgctgttttacaagcattgagtggtagattcggttctgaaaactggtataaagtgatgatggagatctttaactataatacagcacctggtgctacgatttatacgattctgatcgttgccttcactttcttctacgcctttgtacaagtaaaccctgagaaattagcggaaaacttgcaaaagcaaggaagttatataccaagcgtacgccctggtaaggggactgaagagtatgtctcaagattactgatgcgcttaagtacagttggtgcagtcttccttggtttagtggcattgcttccaatcattgctcaaatggtttgggatcttccacaatcaatcggattaggcggtacaagcttactgatcgttatcggtgtagctttagaaactgcgaaacagttagaaggcttaatgctgaaacgtaaatatgttggattcattgagtaagaaagcgtgttgaggttcttcctcaacacacgttctcacacatttattaggagggaaaacaatgaacctcattttaatggggctgccaggcgcaggtaaaggaacacaagctgaaaaaatcattgacgcttatggtattccgcacatctcaacaggagatatgttccgcgcagcgatgcaaaacgaaacagctcttggcctggaagcaaagtcttatatggataaaggtgcattagttcctgatgaagtaacaaatggaatcgtgaaagagcgactagctgaaccagatacagagaaaggcttcttattagacggctttccacgtacactagatcaagcaaaagctctggacgcaatgctaaaagatttgaataaaaaaattgatgctgtcatcgatatccatgttggtgaagaaatcttggtcgaacgtctagccggccgatttatctgcagcaattgtggagcaacttaccataaaattttcaaccctacaaaagttgaagacacatgtgatcgttgcggtgggcatgaattctatcaaagagaagatgataaacctgagacggttaaaaatcgtctggctatcaacatcaaaaatagtgaaccaatcttggcttattataaagaacaaggtttgctaaacactattgatggtgctcgtgaaatcgatgctgtatttgcagatgtacaaaaaatcattgaaaaatagcacgattgcccgtagccgacttgcattatgcagttactcttgtcaagttcaataaattatgatagaatatgtcagtccgacttctagagaatcctctagatgatccattttgagaattttgaggtgggaactgcagtttccgccattttatcgtgtgaaaatgcgaaacaagtacaaggaggtactgtgcgtggcaaaagaagatatgattgaagtcgaaggtacagtcgtcgaaactttgccgaatgcaatgtttaaagttgaactagaaaacggacaccaagttcttgctactgtttcaggtaaaattcgtatgcattacatccgtatcttacctggtgacaaagtaacggttgaattgtctccatacgatcttaaccgtggccgtattacttatcgctttaaataattgtactccgtaaaactacaggaggtattatcatgaaagtaagaccatcagtaaaaccaatgtgcgaacattgtaaagtaattcgtcgtaaaggacgcgttatggtgatttgcccagcaaatccaaaacataaacaacgtcaaggataattggaggtgctataaatatggctcgtattgcaggagtagatattcctcgtgataaacgtgtggtagtttcacttacttatatctatggtattggtaacactactgctaaaaagatcttagctgatgctggtgtatctgaagatgttcgcgttcgtgaattaacgaatgaacaaacagatgctatccgtgcggaagtagataaattaaaagttgaaggggatcttcgtcgtgaagtgaacttgaacatcaaacgtttgatggaaatcggttcttaccgtggaatccgtcatcgccgtggattgcctgttcgtggacaaaacacgaaaaacaatgcacgtactcgtaaaggcccagctcgcgctatcgctggcaagaaaaaataattcttaagtgaaggaggttaaaacttcatggcagcaaaaaaagtgaatcgtaaacgccgtgtgaagaagaatatagaagcaggtattgcacatatccattctacattcaataacactatcatcatgatcactgatactcacggaaatgcattagcgtggtcatcagctggttcattaggtttcaaaggaagcaaaaaatcaactccttttgccgctcaaatggcagcagaaactgctacaaaagcagcaatggaacacggattaaagactgttgaagtaacagttaaaggacctggttctggacgtgaagcagcaattcgttcattacaagctacaggtttagaagtgactgcaattcgtgacgtgactccagttcctcataatggtgcccgccctccaaaacgccgtcgtgtttaatgagtgccgctcattttgagttttatcagtaacgtcattgaacaagacacttttcgttttgaaaggggtaaagataagaatgattgagttcgaaaaaccaagaatcgcaaaaattgatgaagaaaaagattatggcaagttcatcgttgaacctcttgaaagagggtatgggactactttagggaattccctacgtcgtattttattatcttctttgccaggtgctgccatcactaatattcaaatcgatggtgtactgcatgaattctctaccatcaaaggtgttagagaagacgtcactcaaatcatcttgaacattaaaggcttagcgctgaaaatgtatggccaagaagaaaaaacccttgaaatcgatattaccggacctgctacagtaactgctggcgatattatcgttgatagtgatgtagaaattcttaacaaagatatgtacatctgtagtgtctctgaaggagctacgttccatgctcgcttaacagtgaaacctggacgtggttatgttcaagcagatgaaaataaaaaagaagatatgccaattggcgttcttccagtcgattcaatctacacacctgttcgtcgtgtgaactatcaagttgagaacacacgtgttggacaccgtgaagattttgataaattgacgatggagatttggacagatggttcaatcgaaccgttggaagcaatgagtttatctgcgaaaatcatgactgaacatttggatatttttgtgaacttaactgatgaagcaaaaaatgctgaaatcatggtcgaaaaagaagaaacacaaaaagaaaaaatgttggaaatgacgatcgaagagttagacttgtctgttcgctcttacaattgtttgaaacgtgcaggaatcaatactgtacaagaacttacaaataaatctgagcctgaaatgatcaaagtccgtaatttaggacgtaagtcattagaagaagttaaagcaaaattgcacgacttaggtttaggtttacgtaaagaagattaaaaccttttacgaaggagggaaaccaacgtgagttatcgtaaactaggacgcacatctagccaacgtaaagcgatgttgcgtgatttaacaactgatttattaatcaacgaacgtattgtgactactgaagctcgtgcgaaagaagttcgctcaactgcagaaaaaatgatcactttaggtaaacgcggagatttgcatgcacgtcgtcaagctgcggctttcgtacgtaatgaagttgccagcgtgcgtgaagaaaatgaggacatcgtcattgaatcagctttacaaaaactattcaacgatattgcacctcgttacgcagaacgtcaaggcggatacacacgcattttgaagacagaaccaagacgcggtgatggtgcaccaatggttgtcttagaacttgtctaaaatcacactaataacatcactttatagatgattcttttagagtgttatgatgttggaagatatttttccgagtctagctcagcgctgctcctcaagcgaatatcgcttggggagtaagcactcatcataaagtgtttttttataccttcaattaactgtcatgacatctctgcttgaaggcataaaaaaacattttaagcgagaaataattgaaaattttgtctttttttgatagtgttagtaggaactttaggatgaagaaggagtaatcatggagccaattattgaattagagaaaataaattataaataccagccagatgatcttcgccccgcattgaaagatgtctcctttacaattgataaaggtgagtggatcgctattattggacacaatggttcaggaaaatcgacacttgccaaaacaatcaatgggctacttctgccagaatcaggggtcgtgaaagtcggaaatcaagtattggatgaagaaaacatttggacgatccggcaaatggttggaatggtttttcaaaatccagacaatcagttcgttggttcgacagtagaagatgacgttgcgtttggtcttgaaaatcaagggattcccagagaagaaatgctgatacgtgtgaaagatgcacttgagaaagttagaatggctgagtttgctacacgcgagcctgctcgtttatcaggaggacaaaaacaacgtgttgctattgccggcgtggttgccttacgacctgatatcattattttagatgaagcaacaagtatgctagatccagaaggtcgtgaagaagtgatttctacgatcaagaagatcaaagaagaaagtcaattgaccgttatatctatcactcacgatattgatgaagcagctaatgccaatcggatattagtgatgaggcaaggagaacttgtccgtgaaggtacaccaaaagaaatcttttctgcgggacccgaactgattgatttaggtctagatctaccatttcctgaaaaactgaagcgtgcactgaaagaacgcggggtagatgtgccaagtgaatatatgacagaagaaaggatggtggattggttatggacatccgttttgaacaagtagacttcacttatcagccgaatacaccctttgaacaacgagccttatttgacatcaatatgacgatcaaagaaaacagttatacagcattagtagggcataccggaagcgggaaatcaactttactccaacatttgaatgcgcttgttaagccaacaagcggtaccgtccatattggagaacgcgacattcagccagatacggataataaaaatctaaagccgatccgaaaaaaagtcggcatcgtctttcagtttccagaagcacagctattcgaagaaacggtggcaaaagatattgccttcggtcctaaaaactttggtgtcagtgaagaagaagcgctgatactagcaaaagaaacgttagaacaagttggactggatgaaagctatttggaccgttcaccatttgaactttcaggagggcaaatgcgtagagtagcaatcgctggtgtgcttgccatgaagcctgaagtacttgtattggacgaaccaacggcagggcttgatcctcagggcagaaaagaaatgatggagatgttttggcgtcttcataaggaacaacagattactattgttttagtgacgcatttaatggatgatgtagccaattttgcagactatgtctatgtactggagaaggggcgaatcgttaatagcgggcagcctcaagaggtttttcaaaacatcaaatggctaaaagaaaaacagttaggcgtacctactgccacagaatttgcagaagaattaatggctaaagggatggacttcactaccttacctttgacagctgaagaattagcagacgccatcgtccattctgctggaggaaatgcccatgatgaataaattgatatttggtcgttatatgccaggagattccttgatccatcaattggatccccgagccaaattattagccagtttttattttattggtatcatttttttagcaaataattgggaaacatatcttgtattggcagttttcacattattttctgtcttcttatcaaaagtagacttgaaattttttatccgaggtattcgcccattgatttggctgatcctctttactgtagctttgcaaatcttgttcaccagcggaggagaaacttattggagttggggtgttttccatatcactgaatttggtgtgatgaacggtctctttattttctgccgattcgtgttgattatttttatgtcgacgctactcacgcttactacaccgcctttggaattatctgatgcgattgagtacttgcttcgtccattgaaagccgtacggttcccagtccacgaaatttctttgatgctgtcgattgctcttcgttttgtgcctacattgatggatgaaacagaaaagatcatgaacgctcagcgcgcgcgtggtgttgactttggtgaaggcaatctagttcagaaaatgaaagcagtcattcctttgctgattcctttatttgtcagcagtttcaaccgagcggaagatcttgcgaccgctatggaagcgaggggctacaagggcggggaaggaagaacgaaatatcgtgtcttgcattggcataatagagacacgatggttatcattgcttttatattattaaccgtgctgctgatctttttaagaggataaacgttcagtggaccgctatctatccttttcttgctaatctatttgcaagaaagtatgcgagcagtgtatgacaagaaacattagggtctgtggcagactaatgtcacaggcctctttcttttatttgaaaaaaagaacaaacaacattatctggaaaaaccactatttctagacaactttttagaaacaaaggagagaaaaccatggtacgttacaaagcaatcattgcatacgacggaacaaatttcaatgggttccagaaacagccaaatggacgtactgttcaagaagaagtagaaaaaacattacaaaaaatggcaaatgggaaagaaatcacggtctttggttcgggaaggacagatgccggagtacatgcaatcgggcaagtgatccattttgattatccagaagaacgcccgttagaacgaatgcgttttgcgttagatacccagtcaccagaggatatcgctgtaagacaagtagaaatcgtttcagaagaattccatgcaagatatttggtcaaagaaaaaacttatcaatttcgagtagatatagggaaaccacgcagtccttttcgacgccattatgcaagttattttccttacccccttgatttggaaaaaattcagcgggcacttcctgatttattagggacccacgatttcacctctttttgtgcatcaggaagctcgatagaggataaagtacgtacgatctacgaggctaagatggaggttaatgaaacaaaagacgaattgttgtttacttttaggggaaatggcttcttgtataagatgatacggatcttagtaggaacgcttttgaaaattggcaatggccgattgcctgaagatagtatcccagatattattgcgaaaaaagatcgtaatgcagcaggacctacagcacaccctgaaggactttatttgtatgaagtgaaatatgaataagaggttgtgaaaaagcggttctgcatcaagtaataagaacagccaaaccaaaatagtttctcatattttgccatttgttgagctaataccgaaggacagttgattgaacactgtttaaggaagaggttgtgagcctgccatttagctctgagtcacaagaaacaatttcaaaaaacagcttctcacgtttgatgaatatcacaacttgtgaacgaagcatggataagtgaaccttctttttgccacactacttttttgtaactaaaaacgatggaacgttgttttgattgcccttggcagacagtctgaacaggttccatcgtttctttattttcttcgtcttcttctgtgtgtatttcgcggtttttcttctattgttggatcaatcgtgccatagaagggttgattgcggtcaaggtaccagacatagagaataaacaatgcaatgcatagtacaaaaaggattgcacctattataaatccttcaggcaagtagctgaaagtaaccgtgtgtttacctgctggaacttttagcatcaagaatgcgtttttgaagttgctgactttgactggcttcccatcgatttcggctttccatcctttgtcgtaaggaatagttgtcaccaacatagaatcttctgcggtatctacagttccagaagcttttctgccagaggcttccatttcgacacctttttctttgatctgattcattgcggcttgataggctacaacatctagaccaacgactttcggctccatgaaacttacttctttcgtcccataaaaacttgcagtaaatgtcaccgttgtctcttggggataatagccaagatcatagtattgtccagaaatattgatttgcgttttcctcgatgtaccattgacagtaatcgttgcactagaactttctaattgtgcaaaattggttgggaacaaacttaagtaagcttgtgtatttgcaggtacatggacttcccatgtgagctctttcggttgattgtctgccgtctctgaataagtcacaccagtcgttgtttttgtgattgtcgtatttaactgattcttcaaagtaggcgtatagaatgtaaaatactgttcatttagaccagataatgtattgatcaagtttgtctgactagttaaattatctgttacgggctgctcaatatcattaacggataacggtgcggtaaatgccagtggcaatgcattgacattctgatacagtgtatagtcgccgctttgaccagcttggcggaagccatatttgctgaacgtgctttcgttcttagaaatgttgtatttgatccctgtaaagccatccatcagcaaagtattattattgtaacggatattcaaatttgtccctcttgaacgaaaccctaatgtatccagataagaggaagaattacgatttcttatagaagaaaacaagctgatgccactgtaaccgtagttgatcgaatcgtttggcgataccggatccagattttctaagcggtaaaacgagtcagaatcttcttttgtttcatttacaagagctttcaagtcaggagaaggatccgtatacaaactgcgggaagcataattccaatcatcaaggataccatggatcatgctgttcgtattgactagagcctcagcagacatgatcaataacaacaatatacttagatgattgaaggaaagttttttatgctgataaaatcccacagcaaaagcatagatccctaagaaaacaactgtcaatacaaaggaagtcatcgtcacataggtgtagcttccttcaggtttgatgccccatgccaccgcaaagagagcagctacgaccaaaatgattcctaacaacagcccacgatcgtcttgttctatcttttcccatccttttcctgcaagcaggagaactaagaaagagaacagataggcataacggaataaaaacatattcggtgcatgcataccatgccagaacaaattcaatgggacaagataaaaacttgcgataagtatggcgaaaagaccaccgtacaaaaacttatttttcaacggtactttccgactggcaaaataaaacaagcaaaggaccaacggaagtagacctgcgtaaatgaacggaatcgaaccgtattttgtggtgtcataaacaccaatcatgtttttcatgatcagatccagataagaagtcgcttctgttttcaacgtagtgatttgactcaatgcttcgccatttgagcgaagatccagtactgctggcaatacaatgatcattgaagcgccgcctgccagtaaagaagtgatcccataaggaacaatcgattttttgtattctgaccagtttgtcaatagacgggcaataaaatataagaaagaaaagacaccaatcatgaagcccatataaaaactggatagaaacaagagcaaatagctgatgaataaaagtttcggccgtttcagatccatgacacgatgaatccccaaaatcactaatggaagataaacaaatgcatccagccacatgatgatctccgaatgtgcagtaatgaatgagatcaatgcgtaactgacgctaagtgcaacatgcccccagcgaggaatcttgaacgtgcgtgcaagaaaccaaaaagctaatccggcacagccgactttaagtaaagtcagaacataaagtgcatctggcatcatctggtttggaaagaagaaaaccagtggcgtgaagatcccgccgagataataagaaatcaaagatagataattcaagcccagagaagcattccatgtatagaaaatactttgctttccaagaaggacatttcggaagcttgcatgaaaattagaaaattgtgaaaaggcatcacttgccaaaatacttctgctgctcccaggatagatcccgatacttaaataaacaagtgctaaaatcaaaaacggaatcaggaaactagctgctgcgtagcgtccgttttctctaaagaatgactttaagttttttttcatatttattttccaccaaatttctatgaagttgtatttagtttatcatatccttgtttttctctgcttaaaaagagtctagttttcataaaaaaataaaatttgggaataaataacttcacaatttgttcgtataacaaaaataaacacaaaaaaaggggaggaatcaaaaattccacccgccaaaatttttattaaataaaaaaccgttcactatctgaacggtccaagtatcattcaattaaacgcgttcaacttttcctgatttcaaagcacgagttgacacccaaacttttttaggttttccgtcgaccataacgcgaactttttgtaagttaggtttaacagtacgttttgttgagttcatagcgtgtgaacggttgtttccactttttgtcttgcgacctgtaaagtaacaaacttttgccatggtaatttcctcctttgccttgatttggagcaatagaataattcagctcataccagactaacatatcatatagattggaaatttgcaagtacattttcatggatacaattgacatttgtgaagaataattgtaaattaaacagggttatacctgaaattttgcaaggtttttgagtactttgggtaactgccttttatttcaagttgcgctatgataaaatatgatagaagaaaaatgggagtattttacccgttaaggaggctcattcatggctgtaaaaattcaaacgtcagctggaaccattgaaattaccaatgatgtaattgcaacagttgttggtggcgccgcgacagatgtgttcggtgttgtaggaatggccagcaaaaatcaaattaaagataatattactgagattttgcgtaaagaaaattactcaagaggagtagttgtccgccaagaagataatggtattgctgtagatgtttatacgattatcagctatggtacgaaaatctctgaagtttctcgcaacgtccaagaaaaagtgaaatacaatctagaggcattattaggtgtagctgccaattcggttaatgtctttgtacaaggtgttcgtgtactgccagactaggcaggagactggctgataactcagcagtcgatctgaaggaggattatctaggtgagtgtaacagaaataagtgcaagccagttccaggaaatggtgcaggctggtgcgaatcgtctgcaagtaaatgcagaatacgtcaattcattaaatgtattccctgtgccagatggtgatacgggaacaaatatgaatctatctatgactagtggagcgaaggcagtagtagattcaacctcagaaaaagtaggagaattagcagcaatgctttcaaaaggattgttgatgggtgcgcgcggaaattccggcgttattttgtctcaattgttccgaggattttctaagcaaattccagatgttgtctcattaaatgcttctgatcttgctgcagcattcactcatggtgttgaaactgcgtataaagcagtaatgaaaccagtagaaggaacgattttgacagtagctagagaagcagcaaaagctggagaaaagaaagctaagagtacagacgatgtcgttgaagtgatgacagctgttgtaaaaggagcaaaacgtgctttagctaaaaccccagacttgcttccagtcctaaaagaagtcggtgttgtagacagtggaggacaaggattgctgtttgtttatgagggctttttaagcgcattgaatggagaattccaagcggatgaaacatatgaaccttctccagcagaaatggatgatatggtcaatgcagagcaccatcgcagtgtccaaggacaaatggcgacagaagatatccattttggttattgtacagaaatcatggtgaaaatcggtgaaggacctactgttgatagcacgttcgactacgaagaattccgtaactatttagatggtattggagattctttacttgtggtcaatgatgacgagatcatcaaagttcacgtgcatacagaaaacccaggagaagtcttgaactatggacaaaaattcggttcattagtcaaaatcaaagtcgacaacatgcgcttgcagcatgagacgattttggaacatgatgaagaagtgaacgagtttgcgaaaaaagaaacaccacgtatcccgtatggtatcgtagcaatcgctgctggtaaaggcgtccaagagctgtttgaaagtttaggcgctaattatgttatcagtggtgggcaaacaatgaacccaagtacggaagacatcgttaaagcgatccaagaagtgaacgcagataaagtgattgtcttaccgaacaacaaaaacatcttcatggcagctgatcaagcggcagaagtagcagatatcccagtagcagtcgttccttcaagaacgatttctcaaggattgacggctatgctttcattcaatgatcaagcttctttagaagaaaacaaagaaacgatgacagaaatgttgtctagcgtcgtaagtggtcaagtcactcacgcaatcagagatacctcaatcgacggtgtagagatcaaagaaggcgactttttaggcatgattgatggaaaaatcatgatctctaacccagatatcacagcaacagcgttaagtacactagaacaaatgatcaatgaggacacagagatcgtaacgatcttagcaggtgatgaaggaacagttgaacaagcaaatgaatttgctgagaaactaacagaaaaacatcctgatttggaaatcgagatccaccaaggagatcagcctgtctatccttatctattttctgctgaataattcctgtgacagaatatctttctaacacagtattcattcataaaaggccttcggttagtgatcaggtatgatcactgaccaagtcctttttttgttaaaggagggaggaaaaaatatatgcgttctttagatgatccaatcactatgctggcaggagtcggagaaaaaagagcagctagtcttgccagcttgggtatccaaacgattgaagacttactgacttattatccttttcgctacgaagatattcaggaaagaaatctaaacgagatccaagatcaagaaaaggttactttgaaaggaatcgtagtctctcctcctgtgatgaatcgatttggttataaaaaaagccgattgcaatttcgtatgatgcaagaacatgatgtgttcaacgtttctttttttaatcaaccttatctaaaagaaaaagtcattttatcggaggaaatcgccgtatacggtaaatgggatgcaaagcgtaaagccttgaacgggatgaagattttaggttctcaaacaatggatgacttttcgccgatatatcacgtcaataaatcgattcgtcaaacgacattagttgatctaatcaaaaaagggttccaagaatacggcacattgatcgaagaaaacctgccgaacaaccttgtggagaaatatcgactacttgaccgagcttccgctgtaagaagtatgcactttccgaaaaaccacgaagaaaatcaccaagccaaacgacgtgtcgtttttgaagaattctttttatttcaaatgcgtcttcaaggattgaaaaaagcagaaaaagcagaaacaaatggcttggagatcctttatgatgtccaaaaattaaaagaatttactcaaaagctaccttttgaactgacaaatgcccaaaaacgagtaacgaatgaaatctgtcgggatcttcgcagtcctcaacatatgcagcgacttttgcagggagatgtaggtagcggaaaaacagtggttgccgcaattgcattatatgccaccgttacagcgggtttccaaggtgcgttgatggtgcctaccgaaatcttggcacaacagcacatggaaagtttgcaacagctgtttgatcccaatgaagtaacggtcgcattgcttacagggtcaacgaaaacaaaagaacgacgtgaactccttgaaaaactagaacgaggagaaatcaacgtcgtgatcggtacacatgcattgatccaagatggagttgaatttcagaacttaggtctagttattacggatgaacagcaccgttttggtgtgaatcagcggaaagtccttcgtgaaaaaggctggcgacctgatgtcttgtttatgacagccactccgatccctagaacgctagctatcacagcgtacggtgaaatggatgtatcgatcattgatgaacttccagctgggcgtatccctattgaaacacgctgggtaagaacacctcaattagacagtgtactggattggacaaggaaagaactggcaagaggacatcaaatgtatgtcatctgtccactgatcgaagaatcagaagcattggacgtaaaaaacgcagtggaaatctatgaaaaacttcgtgaactatttgcgccaaaatatgaagttggcttgttacatggtaaaatgaagaatcaggaaaaagaagtgatcatggaagctttcaaagataaccagatgcagatattagtttctactacggtaatagaagtaggggtaaacgtgccaaacgcaaccgtcatgctgattatggatgcggatcgatttggtttggcacagctgcatcagcttcgtggacgtgttggacgcggaagtgatgcttcctactgtatcttagttgctaatcccaaaaatgaactaggcgtggaacggatgaaaatcatgacagagaccaccaatggttttgtactaagtgaaaaagatctggaattacgcggtcccggtgaagtattcggcttccgacaatctggtttacctcaatttgcgattgctgacttggtgacggatggaaatgttttggaggtagccagagaagaggctgcagctctttggcagataaagaattggcagatgatgcctgagtatcagcctctagcacaaagcctccagatagaaaatcaggataatcgttatttcgattagcagactatgctatactttataatgatgatggaaaaaggagtgggaacaatgaaaattgccgtagatgcaatgggcggagatcacgcacctcaagcaattgtagaaggcgtggctttagctcagcaagattttccagaagtagaattcttactttacggaaaagaagcagaaatcaagaaatacttaacaaatgaaaaaaacatcacgattatccatacagacgaaaaaatcaatagtgatgatgagccagtaaaagcgatccgacggaaaaagactgcttcaatggtccttgctgcacaagcagtgaaaaacggcgaagcggatgctatattttcagcagggaatacaggtgcgctgctagcagcgggtttgttcatcgtaggacgtatcaaaaatatcgaacgccctggcttgatgtctaccttgccagtagtaggaaaagaaggtgccggtttcgatatgctggatcttggcgctaacgcagaaaacaaaccagaacatttgttgcaatacggtattttaggttctttctatgcacgtaaagtccgagggatcggacgtccccgcgttgctcttttaaacaacggaacagaagccacaaaaggtagtgaagtgacgaaaaaagcctatgaacttcttcagaatgaaaccagtttgaatttcattggaaatgtagaagcgcgcgagttgctcaatggggtggctgacgtagtagtcacagatggatttacaggcaatgctgttttgaaatccattgaaggaacggcaatgaatatgatggatctattaaaatccgctattctaaacgaagggatcaaagggaaaatgggcgccatgcttttaaaagacggcttgcgttctttaaaatctgaaatggattattccaaacatggcggagctgttttgtttggcttgaaagcaccagtcattaaaacccacggagcaacaggtcctgatgctgtccgctatacgatccgccaaatccacacgatgcttgaaacaaatgtagtagggcagttagtcgaacaatttgaaaaaagcgaagaataatattcagatagctgaggcaatccggttcgttaaaaaaaggtggacaatcctgaaaaatgtcagtaaaattagccatggtgtaggtaattgacaagtgtatgattcttggaggtgaaaaagttgactcgcgaagaagtatttaacaaagtagcgaaaattatttcaaatcattttgagatagataccgataaagtgtcggatgaattgaacatcaaagatgatttaaaagctgattcaattagtattatggagttcgttttagaacttgaagatgaattcggtacagaaatttcagatgaagacgctgaacaaattgaaacagttggcggtgcagtagattatattagcagccatctcaaataatttcaataaaagcaaagaaggataaaaagttatatgcaactttttatccttctttttttaatctttctgacacggaaaagacatttttctgataattctggcgataattagaaattatgttgcaaagtaaagcggttttctatataattattaataattcattacacaaagataagaataacctttgttataaaacgctttattctgtgtaatgttctttctttactaagaaaaacttccgtttaggaagcagagaggggtattcgattgtcagataatcaattattagaagttcagaacctacatacaggcttccgactcaaagatgactattatgatgcagtagatgatgtttcatttactttagacaaaaacgagatcttagcaatcgttggggaatctgggtgcgggaaaagtacattagctactacgattatgggattacttgatcctaataacacaaaaattacaggtgaaattttatataacgatctgaatttaatcgaactgaacgaaacgctttataataaaatccgcggaaatgatatcggaatgattttccaagatccgttgtctgcattaaatcctctcatgagaatcgaagaccagatcaaagaaggactttcctatcacacaaagatgaatgcagaacagcgtcaagctcgcgcactggaattactagaacaagtagggattcctaatccagcaagagttggacgtcaatatccccatgaattatcaggcggtatgagacaacgtgtcatcatcgcgatcgcaatcgcctgcaaacctccaatcgtcattgcagatgaaccgacgacagccctagatgtaaccatccaagcacagattcttgatttactgaaagatcttcaggaagaaacaaaaacaggaatcatcctgatcactcatgacttaggagtcgtagcagaaatggctgatcgagtggcagtgatgtacggcggacagtttgttgaagtagcgggtgtaaaagaactgtttgatcatccgaaacatccttatacgcgctctttattgaactctatacctcaagaaggaaatcatgatgcagaactccatgtgatcgaaggtgtggttccttctctgaaaaacatgcctcgtaaagggtgccgatttgctccacgtattccgtggataccagcaagtgatcacgaagaagatcctatccttcatgaagtcgctccgaaccatttggtacgttgctcttgctacaagcatttccactttagagacgaaaaaggagaggtgtagatgacagaattaatcacaatcaaagacctgaaagttcattaccctattcgcagtggattcttcaatcgagtaacggatcatgtatatgctgtagatggtgtggattttattatcgaaaaaggaaagacgtatggtttggtgggagagtccggttccggaaaatccactacaggaaaagcagtcgttggtttagaaaagacgacagctggacaaatcatgtatgaaggaaaagatgtaacgaagcgaagcaaccgaaaaaaaatgggttataacaaagacgtacaaatgattttccaagattcaatgtctagtttgaatcctaaaaaacgagtattggatatcattgcagaacctatccgaaattttgaacggttaagcgatcaagaagaaaagaagaaggtaaaaggattgctagatatcgttgggatgccggaagatgcactttacaaatatcctcatgaattttcagggggacaacgccaacgtctaggagtagcccgcgctgttgctactaatccaaaattaatcgtggccgatgaaccggtatctgctctggatctatctgttcaagcacaagtattgaatttcatgaaacggatccagcaagaatacggtctcagctatttatttatttctcatgatttaggtgtagtaaaacatatgtgcgacaacatcgcaattatgtacaaaggtcgatttgtagaaatcggtacaagagaggacatttataatgacccgcgccacatctatacgaaacgtctgctttcagcaattccgcaaatcgatgtagaaaatcgggaaagccacaaagaaaatcgccgaaaagtagaacaagagtatatccaaaaccaaagagaatactatgatgcgactggccgagtctacgatttgcgtacgatcacaactacacataaagtggcgttgaaagatggaggtgcgagctaatgtggaaaacgattctgcgacgtgttttattgatgatcccgcaagttattattttaagtgttctgatcttcttattagcccaagcgatgccaggggatccatttactggtttgatcaacccaaaccaagatccggcagtgatcgaacaaatgcgacaatcagctggattgaatgacccatggtatgtccagtacttccgttggatcggaaatgctttgcaaggcgattttggtcaaagtttcttatacaaacgctctgttgctgacctaatcggtgaacggatcatcaacacgttatatctatcgatcttgacagttgtccttacttatttgattgctgtgcctctagggatgctagcaggccggtatcaaaattcgatcttggataagatcgtcgtgatttataacttctttagttttgctgttccgttattcatcttcggcttgatcatgctgtttgtttttggttatcgtttaggctggttcccaacaagcggttctcaaacactaggtttgcaagggggatttatcactcagtggatagatcgcttgaaatatattctgctaccatcgattacccaagcatttctggcgactgccgttacgatccaatatctgcgaagcgaagtaatcgattcgaagtcgcttgattttgtcagaacagcccgttccaaaggggtaccgacgaataaagtattcagtagacatatcttccggaatgcagcgttgccgatggcttcgcaaatggggtatgaaatcacttcgttgattgctggttctgtagttatcgaaaagatttttggctatccaggagtcgggaaactatttattgactctattggtcaacgagactacaccgtgatcacatccttagtattgattttaggaatcgcgacgctagtggggacgttactgtcagatatcattatgagtatcgttgacccgcgtattcggattcaataaaaccaatcagaaaggagaatggatcgatgagtgaaaaaaacaatacagcagttcaagaaagtatccctcctatggggatacgaatgattgctcgagaatttaaaaaagataaaatcgctattttttcattaggtttgctagtggttttattattagtgatttttatcggtgcgatgctgaccgatcaagataaagtgatgtatgttagtatttttgacaaatatgctgccccaggagcagtttcgacacaaggacaaaagttcattctgggagcagatgaaggcggacgtgatgtattaggtcaattgatcataggtgctagaaactctgtcacgatcggatttgcgatcacgatccttacttcgatcatcggggttggattagggatcatctctggctactacggagggatcattgacaacatcttgatgcgaattgttgattttatcatgattctaccgattatgttgatcatcatcgtcttcgtttcgattatttccagatacaatgtctggtcctttattttcatcatgagtgcattttattgggtagctaaagcccgattattccgaagcaagacattatctgaagcaagaagagattatgtcagtgcctcaaaaacaatgggaacaagtgattttaaaatcatgttccgcgaaattatgccgaatctaagttcattgatcattacgaacttgacaatgaactttgcggcaaacatcggtatcgagacaactttgactttcttaggtttcggtttgccggcaaatgtacctagtttaggtacactgatcggttatgcaagtaatggagaagtcttagtgaatcggcaatggatctggttacccgcatcaatcctcattttagttttgatgttgagtatcaattatgttggacaggcattcaagcgttctgcagatgcacgccaacggttaggctagttatagaagcgaagggggaaataggaatgaagaaaacgatttttggatttgcaacgctgatgtctgctgttgttcttgcagcatgcgggggcggaggtacagatacttctggaaataactctggaggcaacagcaataacaaagaggaattaacttttccaatcgcaacaaaaaacaatgatgatgcaatcgaagacggtgaattagaagctgcggtcgcaacggacagtcagttcaaaggattgttccagtgggagttttatcaagattcttttgatgcagctttcatggctccttctcatgaagcgttatttgcaagtaacgatgatttccgaatcaccgatgatggagcagctacacttgacctagatcaagatacgaagaaagcaacaatcaaaataaaagacaatgtcaaatggtcagatggtgaagacgtaacagctgatgacgtgattttcccatatgagatcatcggtcataaagattacactggtatccgatacgacgatacgttccgtaatatcgtagggatggaagagtatcatgatggaagtgccgatacgatctctggtatcaaaaaagtggatgacaaaacagttgagatcgaatataaagatgtaaacccaagcatgctgcaagctggtggcgggatttggtcttatgcagcaccgaaacatacattggaaggtatagcaatcaaagatatggaatctagcgatcaagtacgtaaaaacccagtaactttcggaccgtactacatgagcaacatcgtagctggagaatctgtggaatacttgccaaatgagcattactggaatggtacgcctaaactgaaaaaaatcacgatgaaatctgtaccaacagccagtgcaactgaagcattgaactctaaattatacgatatgattttccaaatgccaacagacacatatgatacgtataaagaaatttccggctatacaaatttaggtcgtgaacaaacatcttatacttatctaggatttaaactaggtaaatggaacgcggaaacaaagagtgtagaatacaacccggattcaaaaatggcagataaatcattacgtcaagcaatgggctatgctttagacaatgatgcagtaggcgaacgtttctatgcaggattaagaagcaatgctacttcattgatccctccagtattccaatcttatcatgatgatgaattgaaaggattcacgcaagatttagacaaagcgaaaaaactattggatgatgccggctacaaagatgtggacgacgatgggttaagagaagacaaagatggaaacaaattaaccatcaactttgcttcgatgtctggtggagaaacagcgcaaccattggcagattactatatccaacaatggaaagaaatcggtttggatgtccaatacacaacaggtcgtctgattgaattcaactctttctacgataaattagaaaacgatgatcctgaaatcgatgtttaccaagctgcttggaatacaggaactgatccaaatccaagtggactatggggaccgaatgcagcattcaactacactcgttatgaatcagaagaaaatacaaaattgatcaacgatatcagttcaagccaagcatttgatgaagactatttgaaagaagcctatcaaaaatggcaacagtatgcgtttgaagaagcatttgcgattccaacgttgttccgtaacgaagtattgccagtgaacgaccgcgtcaaagactgggattggtcttatgatgtaccaaacccatgggcaaatgtttctgttacagcagattcacgttcataatcaataaaaatgaccgaaaaagggcgatgtcctttttcggtttttttaattatcgttatttttgatagcaaataaaaataaatgtagtttttaaaactttattttaaaaacacgttgaacataaatgtgttattatatataatttaaatagattttaaagaaggaaaatgcataaaatgcgtgttatttaatttaagttgaataaaaattattgttattttaaattgatgggaatttttcgcgtagttaataaaagagaaggttcacacttatctctttttaaaataaaaaaagggggaccgaacgactgtcgcctttgcttgttcaagtatgtttcaatagtcactcgtgagacactttaggcactcaaagaagggagcggatacaaatgaagagaaatgtgaaaaagatgatagcaagttcatgtacacttattgccttgagcagctggatcgcaccaatcaatgccgttagtgcggctgatccagccgcttctttcttctaaacgatgaaaaaaatctatcgcttcttttttctattcacagtcaccagttttttatatgctatttcttttgctggaaccgaaatgatcaaatcagcgattccagaaatccattcatcgatcatcatcgaagcagcgagtggtgaagaaaatcagcaggaaatgtaccagacgattacttgaccttggtctcaaaagaggagcagaaaatcaaagaatccctcgaaaaatttcaggtagaccatttgatagacaaaaaaatatttctcttaagcggaggagaacagcagcgagttgctcttgctcgtttatttttgaaagaaccaaagatcatctttgcagatgagccaacagcctctcttgatcaaaagaacaaaggaatcgtccttcaagcattacaagaactgaatgcaaaaggagctacggtccttgtggtcacccatgatccaacattggcagcagaattcgatcatgtgttggacatgaatgaatggaagaaatcaatccaataaaccttatttatgtgttcattctgttggttttgtctgatagtttaccagtgattggactgtttttttcaatcgttttattgaaaagtcatcagccaaagattcacccacgatggataaaatggtgtgtgttcatttcgctcctttttcaagtgttactaacggtgtttcttctattgagcattcatgtttcagaggttcagctaggacccgtccaagaagtcatttaaaacatacgagaataagggattgtacaaaaaaggaatgtgacaatagtcgtgtcacatcctttttttgtatgaacagtgttcaatcagctattccacggtattcgttcaagaaacggcaaaatatgagaagctgtctttttgtttatttctctaatactccgaactaaacggctttttcacaacctctcgtcaatcactaggattattaaagctttacttaccttttacccgaaccatttcaaatttaacaaaaaaccagtataataaggaagtatcgaaaaaatatccataaaaggaatgtggaaaatggacaaccagctgacaaaagaactaaaagaaaattataacatcgtttttcacgatctaaatttgcttgaacaagcttttacccattcatcctatgtgaatgagcatcgcaatctgcaattatcggataatgaacgacttgaatttttgggagatgccgttttagaattgatggtttctcagtatttattccgtttatatcctcatttgccagaaggaaaattgacaaaaacacgagcagcgatcgttcgcgaagacagcttatcgaaatttgccaaagaatgtcactttgatcaatatgttctgttgggcaagggagaggagaattcaggaggacgtacgcgaccagcattgctttgcgacctattcgaagcttttttaggcgcgttatatcttgaccaaggattcgacacgacccatgcgttcatcgaaaaagtgatttttcctaaagtcaaagcaggtgctttttcacatgagatggatcataaaacaaaattgcaagaagtcttacaaaaatcaggtgatgtatcgatcgaataccgattgatcaatgaagaaggtccagctcatgaacgagtattttggatcgaagtttatgtagatgatcaattgattggcactggacaaggaaaatcgaaaaaattagcagaacaagctgcggcggaaaatgcattagcagcactgtaaaagtaagtgagggaaagctttgtatttgaaacgaattgaaatagccggttttaaatcatttgcagacaagacagtcattgattttgaaaacagcgtcacagcagtggttggaccaaatggcagcggaaaaagcaatattacagaagctatccgctgggtattaggagaacaatctgctaaaagtttgcgaggcggaaaaatgccggatatcatctttgccggttccgatacccgaaagcagctgaatattgcagaagtcacagtgattttagacaatagtgatcattatctgccattggagtacaatgagatcagtgtaacccgccgttatcgacggactggggaaagcgagtttttcatcaataaacaaagctgcagattaaaagatatccaagaattgttcttagattctggattaggaaaagaatcattctcaatcatttctcaaggaaaagtagaagcgattttcagtagtaaaccggaagaccgtcgtgggatctttgaagaagcagctggtgtgttgaaatacaagcagcggaaaaagaaagcagaacaaaagctttttgaaacagaagacaacctcagccgcgtccaagacatcatccatgaattggaagaacagttaactcctttggccgcccagagtgaggcagcaaaggagtttttacagctaaaagaaacactgactcaaaccgatgtttctttgatggttgctgaaatcaagacagcaaaaaaagattgggacaacaaacaagcacagcttgcgaaattcaatctagaattaggtaaactatctgagtcgatccaagaacaagaatccattttggcgaagcatcgtaaagaaaatgcgcaagccgaccgtctgatcgaaaaaaatcagcaagtattattagatctttcggaaaaactgaagcagacagaaggacaaaaagatgttttgcaggagcggacaaagcatacacaaaaaagctcgcaagaatatcaaacttcattagcagaagcacaaaaaaaggttaaacattttgaaaagcttcaagaaagcttgatgaaagaagcagcagaaaaagaaacagagatccaaaaagctgaagcaaatctcataaaaacacagcaagaattagaaaaataccaaaaatcaacgaaagaattattggcagaattaagagatcaatatgttgatttaatgcaagaacaagcagctgtaggaaacgaactgaagtatctggaacgtcaatatgtacaagaaacagcaaaaagcaagcagacgttagccaagcaatcggaagtagaagcatcagtagaccgattgatcttacagaaagaagaattgatacaaaagcaggcgcagctaaaatcatctttaactgaaacaaaagagaagttagaaatgatccaacgaaacgggaaaaagttccaagaagcattagcaaaagaacagcctaaaatgtatcaattgatgaatcaagtccagcagctgcgtgctcgtcagaaaagccttcaagagatccaagaaaactattttggtttttaccaaggcgttcgattggtcttgcagcataaacagcagctttccggtattgtcggagcagtagctgaactgatcgacgtccctgcagatttcacgttagccatcgaaacagctttaggtggagcagctcaacatgttatcgttgaaaatgaaaaagatgctcggcaagccatcacgtatttgaaacagcaaagaggaggaagagcaactttccttccgctgacgacaatcaaaccaagacagttaccagctcatatattgacacaagcggcagctatagaagggtttatagggattgccagtgaacaagttgcttatcctgatcaaatccaaacagtggttcaaaacctgttaggaacgatccttttagcaaaagacttaactagtgccaatgcgatcgcacaaacgatccgctatcaataccgagtggtttccttagaaggtgacgtgatgaatgccggaggatccatgacaggtggagcgaacaaacgaggaaaccaaggcagtttgtttgtacaaaaccaagaattgaaacagttgactagtgaattcgaagaagcagataaacaacttcaagtgcaagaaaagaaagttcaggagctgcaacaagaaacagctcgtttagccgaagaacaagaagttttgcgtacacgaggcgaacaattacgttttgaagaacaagaagcgacaaatcagctgcaaaacatcataaacgaacttgaacgttttgaaaaagaaaagcaaatctcaacttttgagacacgtgagctacagcagtttatcgaagattacgaaaaacaaacgaacgagttgaaagacaaacaaacagatcttgaaacgcaacgtcaacaaatcgacgaagaaatcaaatctttaagtcaagaaagtgaccagatggaagccagaagagcacaagtgcaaagtcaaaaagcacaagaacaagcagatcttgctgtcttgaaagagcagtttaatcatctgcagatccagctccgcggtgcccgagtccaaaaagcagaggcaatcgaacgccaagaagcgatagaaaaacagttggcgacattgacagcagacttttctgatcatgaagtcacagaagaaagtttggaaaaacaaattaacgaattatctgctcagcgagaaacattaaaagccgagttggcaaaagccaaagagcagcgagatagaaggcaaagggagatcgatgagcttgaagcagtcttggcagagcgtaatcgtgagcaaaaagcacgactgtcggaacaatccaaattagaagtccaaaaagaccgagctgaaatgattttagataatcatttgacctatctgcagtcagaatatcagctgacatttgagaaagcttcccacgactatcaagaaacaaccaatattgaagacagcagaataaaggttgcctccttaaaagaacaaattgaaaaactggggccagtaaacttaaattcaatcgaacaatacgaacaagtcagtgaaagacataccttcttagcgacacagcgagatgatctgttagcagcgaaaaaccagttgtttgaaacgatggatgagatggatgatgaagtgcggacaagattcaaagaagtatttgaagctatccgtcaagaattcaaaattgtctttcccaatatgtttggcggcggtaaagctgaattagtactgacagaaccaactgatctgctgaaaacaggtattgagattgaagtacaacctcctggcaagaaactgcaaagtttaagtttgctttccggaggagaacgagcacttacagccattgcgctgctcttttctattatccgtgtctgtcctgttccgttttgtatcttagatgaggtagaagcagcgttagatgaagcaaatgtaaaacgttttggtcgttacttaagcgacttccaagatgacacacaatttatcgtagtcacacaccgcaaaggaacgatggtcgcagcagatgtactgtacggagtgacgatgcaagaatccggtgtatcaaaaatcgtttctgtacggatggaagatatcaatgaagaggcgaaaatcaacgaaacgaaagtgtaggaacgaaaatgatcaaattagtagcaatcgatttggatggtacattattaaatgaacaaaagctgatttcagatgagaataaacaagcattagcacaagcaaaacagcaaggggtcaagatcgttctatgtacaggacgccccttagcggcgatggcgcattatctgcaagaattagggctggtagatgagggtgattacagcatcactttcaacggcggtttagtacaaaaaaacgatactggtgaaatcatggaaaagaaagtgatggaagtatcagatatccaacgcttatacaaattggctcagcaattggatctgccactagatgttttgtctgacaatgtggttttacagctgcctagtgccccaagaaagcaatccttgtacaatgtgttgaataagctgctgcacttccaaccagcggatataagcgatattacagatgaatttgtgcttaataaggcagtaatcgcttatgaccaagaagaattagatcctaaaatcaaagaaataccagtagaattccatgaaatgtatgagatcatcaaaacgagaagtatgcttttggaatttatgccaaaaggtgtcacaaaagcttatggtatttctttattggcaaaagatcttggtttgaaacaagaagaaatcatggcaatcggtgatgaagaaaatgatttaccgatgatccaatacgctggtctaggcgtagcgatggagaatgctgtgcctttcgtcaaagaagcagcagattttgtgacagtcagcaatgaagaaaatggcgtagccaaagtgatccaaaaatttgtattagattaggggggagtcaaatgggattttttgataaaatcaagcgtgcttttactggcgaagagaaaacggaagaagttgaagtacaggagaagtatgacaagggtttagaaaagacgcgtaaaacatttggtgaacggatgaatgagctgtttgccaattttcgaacagtcgatgaagacttttttgaagaattagaagaaacacttatcggggcagatgtaggttttgaaacagcgatacgaatcaccgaagcgttacgtcaagaagtgaaactcagaaatgcgaaaaaatcggcagaagttcaaaatgcgatcatcgagaaacttgtggatctctatgaagcggaaggaatcaatgaagtaaatgaactaaatatccaagaagacggactaacagttattttgtttgtcggcgtcaatggtgtagggaaaacaacaagtattggtaaacttgctcatcagttcaaaaacgaaggtaaaaaagtattgatggcagcagcagataccttccgtgctggagcaatcgaccaattagttgtctggggcgaacgcgctggtgttgaagttgttcgtggcaatgcaggcggcgatccagcagctgtcgtattcgatgctttggaaagagcaaagacagagcaggcagatgttttattagttgatactgcaggccgactgcaaaataaagtgaacttgatgaacgaattagaaaaaataaaacgagtaatccagcgggaattaccagaagcaccccaagaaacactacttgtattagatgcaacaactggtcaaaacgcgatggttcaagcaaaacaattcaaagaaacaacagatgtgaccggtcttgttttgacaaaattagatggtacagcaaagggcggtatcgtacttgctatccgtaatgaactgcatttaccagtgaaattggtcgggttgggtgaaggcatcgatgacttggagccgtttgatccaaacgattttgtcgttggattattcaaaggattactaaaagaagaataacccatgtctaaaaagcaggagctgtaacaaaagttgcagctccttgtttgaatgattgtttttaacatagctgtgtttttgatgccttcatttttatacttatttgtaagcggttctcaaacaatttcgttctttttcttagactttttgattataattagattcatatgaattggaggtcacttaatgatgaattttaagcaattattattgcatgtcaatgcgcgcccttttatcgaccaagctcgatttggtatagaacgggaaggacagcgggttgatcttgcaggaaatctagcaaaaaccgatcatccagcaatctttggcgatcgatcctatcacccctatatccaaacagattttagcgaaacacaaacagaaatgatcacccctgttaccgattctattcccgaattatttcagtatctggctgctgtttatgatgtgactgctcgttctataccgaaagaagagatgatctggccattaagtatgccacctgccttaccggaaaaagacgaagaaatcattattgcaaaattaaaaaatttcgaagatgttttgtatcgacgttacttagcaaaagaatacgggaagcgaaaacaaatggtgagcggtatccatttcaattttgaatttggcgatgagttgctaagaacattgttcagccatcaggaagaatttcaagatttttctgaattcaaaacagaactttatttgaaaacagcgagaaactttatgcgctatcgctggatgatcacttatttattcggtgcttcaccgatgagtgagaagaactattttataaatgaatcacatccgcaagaacctgttcgcagtattcgcaacagtgcgctggggtatacgaatcatccaaatgtgaaagtttcctatgcttctatgaaacagtatttagcagatattgagcgaatgatcgaggaagggaaactttcagaggagaaagaattttatacaccgcttcgtttccgaggtggaaagaaagtcgcagatttagcaacaacaggcgttcgttatattgaattgcggaatatcgatctgaatccttatgcaaggctgggaatcaatccagaacaagttcgtttcttacaattattcctgatgtatatgctatggacagaagaaaaagaagacagtgaccaatgggtggcagaaggtacgactcgaaataacaaagtagcactagaacaaccatcacatcagactgaatttcatcaagaaggtagagaaattcttgaagggatgaagcaaatgctggttgaattggattggttggattctctttatttagtagaggaagcattgactcaaatggatcatcctgaacaaacgttagcagcgaaactctatcaagaagcacagctatcgagtcagcaagaagttgctgtggcattggggcatcaatattataaagaaagtcatgaacgtccctatcagttggccggttttcgcgaaatggaactttctactcagatatttatgttcgatgccatccaaaaaggcgtccaagtcaaagtattagatgagtcggatcaatttttgcgtctgcaattccaagaccatgtagaatatgtgaaaaatgcaaacatgacaagtaaggacagctatatcgttccacttatcatggaaaacaaaacagtaacgaaaaaagttttaaaagaagctgggttccgagtaccaggaggcgcagaattttcatccatggaagaagccgtaaaagcttatccaagatttgccgatcaggcatttgtgatcaaacctaagtccacaaattacggattaggtatcacgattttcaaggaaggggctgatctggaggattatcaagcaggattggcgattgcttttcgtgaagacagctcggttttagtagaagaatttatgccgggaacggaatatcgtttctttgtaatcggtggagaagtccaagccatcatgttgcgagtccctgctaatgttattggtgacggtatccgaacagtgaaagaacttgttgaagaaaaaaatagtgaccctttgcgtggaacgaatcatcgtgcaccgttggaattgatccaattaggcgaattagaacaattgatgttgaaagaacaagggttaacgatcgaatcagttccccaagccaatcaaattgtttatctaagggagaactcaaatatcagtacgggcggtgattcgatcgatatgactgatgaattttctgaagcttacaaaaaaatcgccgtttctgcggtagaagcactaggagctaaaatcagtggtattgatttgatcataccagataaagaaatcgatcctacaaccgataaaaaagcatacgggatcatcgaagcaaatttcaatccagcgatgcatatgcatgtttatccttttgcaggaaaaggcagaagattgacgatgaatgtattgaaattgttatatcctgaaatattttaaacgaaaaagcttttgacagattgtcctatttgatgtcgatctgttcaaaagcttttttgcatgtaaaaatttatgtgttttttcgttttaaaataaacgatcccagaagctttttttcttttttggtttttctttttcagatggcgaagagttttcttctgggtattttttttcgatatcgatcacaggttcatttactgcttcttttgctgttaagagcaatccgaattcctcaggatttgcagtgacgtaatcgttgactacagtaaatcggctattgtttttcgttgctagctggatatattggttttggacagaaaggggtagagccccattcaagagtatggaagcatctggatgttttttgagttcttttaaaaagttttctttgtttttcggttggatcatttcagcaacagtcatactaagatagcaacgttctctgaatgtccctaaatatttatgctgttcttcagggttcactaaaggtgtaccataaagtcccttatccaaatggctttttacatcatcttgtgccataaaaaataccctccttcttctctttgtctttcttacgattatagcatattcccaataatacctaaaacatatgaaaaagcggttgcttttgttcaacgattcacttaaaataagaatgaaaatcattctcaattagaaaggtggattggatgcgctacggacgactagtagcattattagttattttaagtagtatttcattgttcattggagtatcaaatgtacaattgtcagaattgctccagttaaatgggcaaagtttacaaattttgctagcgactcgtttgccgcgaacgatttgtttgatccttgtgggagcgactagtagtatttgtgggttgatcatgcaacatttgacccaaaataaatttgtttcaccaacgactgcgggcacgatggatagtgcgcgtttaggtattttagtggccatgattttcctacctggtgcatccttgatcgtccgatccttgactgcattttgctttgcttttgcaggaacattgctttttttatcccttacgcgattgttcccccagaaaaatcaattgatgcttccgttgattggggtcatgttagggaatatcattggttcagttgctactttttttgcttatcaattccagttggtacaaaatatgacttcgtggcttcaagggaattttgcgactgtgatacgaggaaattatgagttactgtatgctgttgttccattgctgctcttggtttggctatttgcttaccaatttacgattattggtctgggcgaatcgtttgcagtaaatttgggaatagattaccagaagatgcagtttttaggcattggcttggtttcattggctagtgcagtcatgttgatcatggtgggaagcattccttttatcggagtgattattccgaatcttgtctctagaatatatggagatcaagtgcacaaaaccattggcgtaactgctttagcaggtagtttgttcttagtattttgcgatcttgtcgctcgtgtgttgatttttccttatgaaataccagtcagtgtgatcgttggaatcatcggtggggctatcttcctttgtcttctgataagggggcgacgatatgcttaaaaaaaagccgtctatttttattggtatgcttgttcttgttctatttgttacaggagtgtacttgatgatccatacatatggaaactggcattttgtgtgggtattgaggagcaagaaaatttttgcatttatccttgtctcgctagctgtcagcagtgctacgatcagctttcagacaattacgcataaccagtttttgactccttccgtattgggacttgagtcgttatacgtccttgtccaaacggtccttttcttctttatcggaggagtgacgatgcttcagcagacaggtacaggttttttcttattgaacgttgggctgatggtcgggttgagtctgttgttgtttttctttcttttgaaaaaaatgaaagcaaatctttttttgttactgatgtcagggatgattttaggcacgctttttggtagtgtcagtacctttttacaagtcatcatggatccaaatgaatatgatttgcttcaagggagattatttgcaagttttggcaatatccaaagccagtatcttttgcctgcttctttgatcattatcggctgttggttcctgttatttcgatatcgacatgtgctagacgttttccatcttgggaatgaacaagctgtaaaccttgggatagacacagatcgatttgaattttttattttatgttgtgtcagtcttttgacaggaacagcaacggctcttgtaggtccagttacttttttagggtttattgtcgcaaatgtcagttaccgtatattttctacttatcgtcatggtctgctatttatcggaagctttctaatagctatgctgtttctgacaggcggacagctcgcagtagagcagattttcggctggaatacaacagtgagtgtcgttgttgaatttgtcggaggaatttattttgtcacaaaattgattcgcgaaaggaagagtatcctatgatcgatttacaaaaggtcaataaactgtaccatggaaaatcagtggtcaaagatgtacagttaacgattcctgaaaagaagttgactgcttttatcggtccaaatggtgctggaaagtcaacagtgttgtcgatgatcagtcgtttgataccaaaagatacaggtgaaatctatttagaccataacgaagtaaaggcttggagatccaatgaattagccaaaaaattgtcgatcctgcgacaatcgaatgaaataaatgtccaaatcaccgtgaaagaattagtagaatttggacgatttccttatacgaaaggaaaattgacgacaaaagatcagaaaatcgttcaggaatcactggaacacctcgggctagaagaaatagcagatcaatcgattgacactctttcaggaggtcaactccaacgtgcgtatattgcaatggtgctagcgcaagacacggattatattttactggatgaacctttgaacaatctagatatgaattttgcggttcaaatcatgcagattttaaaaaatttagtacaaaaaatcggaaaaacgattgttattgttcttcatgatatcaactttgctgcaagttatgcagacgaaattattgcaatgaaagatgggaagttattcacgcaaggaacgacccaagaaatgataaaaaaagatgtattggatgaattgtacgaaatggacatacggatttgtgagattgaaggccgcagattctgtctttatttctaaaactaacattaggagagaagagatgaaaaaattagtagtaggtatcttgattctagcatcatttggtttagcagcatgtggaaatagtaacaacaccagtcaggcagacacaaagaaaagcagtacgcaagctgaaacggcattaacgataaaagacagtaatggtgatcaaatcgaggtgccaaagaatcctgaaaaagtcgtcgtattcgataatggttctttagatacgatggatgctcttggtgttggagataaggtagttggagcagctacgagcagccttcctgagtatctttcctcctataaaaaagtggaatcagcaggtgggatcaaagaaccagacttagaaaaaatcaatcaacttcagccagatctgatcatcatttctggtcggcaaagagattttcaaaaagatctaagtcaaatcgctccgaccattttcctttctttagatgcgaaaaagccatgggaatctttccagcaaaatgtcactactttaggggagatctttggcaagcaagaagaagccaaaactcaattagaggaattatccaatgcaatcgatcagacgaaaaagaaagcagaagcgtctgacaaaaaagcactagtcacacttgtgaatgaagggcaattatcagcctatggatcaggttctagatttggtttcatccatgatttatttggctttgaacaagcagatgatcaaatcgaagcatccactcacggtcaaagtgtttcttatgaatatgtgctagaaaaaaatccggatatcttatttgtggtagaccgaacaaaagctatcggtggagacgatagcaaagatgatatttctgccaatgaactggtagcacaaacgaatgctggtaaaaatcagcagatcatctcccttgaaccagatgtctggtatttaagcgggggcggtttagaatcaatgaaactgatgattgaagatgtggatcaagcatttaagtagaatcaataataatcgaaaaaattgaaccgacctctaaaagttagattttccagctaatttttagaggtcgatttttatgtgtttgggcaatcttttttctttaatactaaggtcagagcgctgatttcataacctctattcacgcatgtgtctcagcaagcggttgatagttgatgatctgcatttttcgataaaaatcggcgggaagcttactccaacgttttaataattgatagaaataactttcttctgctttgatcttatactcgcttaatatcaatccaaaactattcgtttgttttgcagctaattttttatagatatccaatgcttttgttttatcttcattgacaaaaagtgtttttacttcaatataagaaccctcgatgttttgtgtttcttcgataaaatagatactttttatatattctttcataatgattcctccaaagaagtctttttatttgataagtttactttaccgaagagttgttaataatccgtgaacaaaaagttattctttttccaatagttattaagggatgtttattttttagaatatattttgttatttaaggaatggataaggttggacaaataacaggttgctttttggggcctgcttcgctatagtagagaaaaaataacgaaagaagcggatttagatgggagaagaaattaaaacagaccttgtactggcagaaaatcaatggatagaaacagaacgacttattttacgacccgtcactttagcagatacagaggatgtatatgaatatgcaagtgatgaggtaacgacacggttcctctttcccgcaaaccaatcattagctgaaacaagagcaaatattactacatcctttataaaggaccctttaggaaaatatggtatagaactaaaaaaatcaggtaaactgatcggaacgacagatatccgtgtgaatgaccataacgggactgccgaaattggttatgcgctaaattctgcctattggggtaatggctatatgcctgaagctaccgctgctttgctgaaactaggtttcgaacaattagatcttgtaaggatctttgctacccatgacgtgagaaattccaattcgggacgggtaatggagaagttacatatgaaaaaagaaggattgatctcagatgctgagcgaagaaatggtgaagtggtttctttagtgataagaggaatcacaagatccgaatggttggctctccaacaaacagaaaacagctaaaaccagacaaattagttgcatctgatgaataaagtgattattctatgacgtgaggtgatacagatgaaattagaagtgacaaaagaagcacaagaagtattgaaaaataaattagaagcagatgatcaactgttattagatatcgaaaacggcgacggtccatttgcagaaagccaagtcagttgccaattagacacggcatttcgattgatcattgtcaaaaaagatacacaaacagatctaagtctttattctgtagtggctgatacaccagttggaccaatcaaaatcaaagacagtgcaatactttacatggatgatccatcaacacttgctttagaaccaacttataatagtttacaattaaaaggacccagcggcttgagaaaaggcaacttgcaagttgttcgaaaagactagagggataaaatgggaaaattggcgatcatcagcgacttacatgtggacatcaataaattcggcgaatcagagctgaggcagctttggcaagttttgcaaaagcacaagatcactcggcttcatctagccggagatacggccaataaagtagatcgttgcctagctgttgtcgaatttttcgtcaataaaggattatctacgacctttcatttcggcaatcacgagttggcagatgtgcccaatgaacagatgatggaccattttccagacccacattttttaaatgaacggtatattgctttaaatgagcagaccgttcttttagggatgaatggctggtacgactatcagttttctgaattgaaagattacgatgcaatcgtacgaatgaaacgtttgtattggtatgatcgattcatccagcgtgggaaaacagatctcgaggtcaatgcagaaatgcttgcagctgcaaaaaatttgctagaccagttggaagcaaaaaaacttgaggtcattctatccactcatttcgttcctaaacgagcatttatcgtgtatcaatctgctccttatgagcgttggaacaaattaaatgcgtttttaggatcagaatcattcggaaaattactagaccattactcaaatatcaaacaagtagtttttggtcatacgcatcggcggttcgaagatcagttgatccatggagcaatttatagttgtcgaccattcggttattattatgaatggcaactgactcgtgattttgttttgaaagaacagttgttagacagctatgatcctatgaaattacgtgtactcttgcgtgcccatcacccagcttttcatgcctatcaaacacaacatttgcaagaagaatttgaacaagcgatgacgatcatttcgtattgaaagaaacagttacacctgtgtatgattgatcgataaaccattctagaaaaacaaaaaaacttggtacacgaatgttgtaccaagtttttttgtctttctatatctatggcatcatgagagaaagcaatagcggaaaattcattctattcaagataaatcaagtcgtcccttagaagataatatagggatcttctttccaaatatttcttgatcttccgcagtaatcattgagtcagtgattaggtagtcagcgtcttttaaagaataaaaactgtaaaaatcttttttatttattttgtggtgatcagcaacaataaatctctgttcagcaatattcaacgcacatttttgagttaatccttcgtcttcatttgaagtatagatagcagatgtatctaacccatttactccgataaagcttttcatcacatggattccagaaataaaatcatttgcaatcgtccccacaaatgcacctgttttactccgataagaaccgccaatcaaaatcaattcaaatcttgaatcatgtttgaatttgtcgaatacatgtatggaattcgtgataatcttggcatggttcacggttaaaaactcatagaccagttcgatggttgtacctgcacccaaaaaaacagtctcgtcttcgaatatattctcagcaatgatctttgcaatctccaatttttcattgagatggatatgttgtttttcccgatggcttagctcagtaagtatatcgttcttattgtcttcaataattcttgcaccgccatgtacacgaatgatcagtcctttatcttctaattcttgaaagtctctgcgaacagtcatgtcagttattttaagttcattgacgatgtctcttacttttaagaatttatattggctcaataaatccatcaaatacttttgacgttcttcttttatcatttttttcttgcccctcgttcaagtccttcttttatgtccgaattaaacatattatattttgaaaataaagtcaattttaaacagtaaatctgctattgacaggaatggattcttcttttatgatgtgtttggaagaaacaaaaacaaacaaaaataaacaaaaaggagaagtcgatgaataaagaagaagcagcaatgattggatttgaagtagttgcatttgcaggagaagcacgatccaaattaatggaagcgcttgaagaagcagaaaagaaaaattttgagcaagcagagcggctagtagaagaagctcataccagtttgatgcaggcacataaatctcaaacacaaatgttagcagctgaagcaaacggtgaatcagtcgaaatcggttttatcatggtccatgcacaagatcacttgatgacgacgatgttattgaaagatacgatcagacatttattcaatatctacaaaaaagcgtaagggggcagaagcagtatgaaacagctgatacaaacaatcgaaaagatgaaacctcattttgaaaagatttcgaataatccttacttgagagcgattagagatggctttatcagccttataccagtgattcttttttcaagtttctttttgttagctgcttatgttccaaatgctttcgatttccattgggatacatcaatcgaaacgattctaatgaaggcttacaacggatcaatgggtattctaggtttgcttatggcagctactgtgacaaaaagtttgacggagacttttaataataaactacctaaaaccaatcaaatcaatcctacttcaacgatgatcgcagcatttattggatttgtgattattggcgtggatgcgattgaaggcggtttctcttctgattttatgggaacaaaaggattgttgacagcttttgtagtcggatttattgtcccaaacatctatcgtttctgtgtcaaaaacaatatcactgtaaaaatgcctgaagaagttccagggaatatttcgcagacattcaaagatcttatcccaatcacgttagcaactgtctttttttggttattcgacttagggttcaggcatttagcaggaacaggattctcagaaaagattattgaattgttccagccaatttttagtgctgcagatggatatttaggactggcattgatttttggggcaatggcttttttctggtttgtcggtatccacggaccttctatcgtagaacctgcagttgcggcaatctatattacaaatgttgaagcgaatcttcagctctatcaaagtggtgaacatgcaccacggattctttctcaagggatccaatattttgtcgctactttaggtggtacaggggctacgcttatcctaacattcatgtttgcttttttggcaaagtcgaagcaaatgaaaacgattggtcgtgcttctgctatccctgtgttatttggtgtgaatgaaccgatcctgtttggtgcaccagttgttttgaacccgattttctttattccttttgtgactgcgccaatcttaaatgtgtggatttttaagtttttcgttgatactttagggatggatggatttatttataatttgccatggacaacgcctggaccaattggtttgattttaggaacaggatttgctggattagcagttttattagtcatactattactgatcgttgatttcttaatatattttccatttttcaaagcatatgacaatgaattagtggcaaaagaaacccttgaggaagtaaatgctgaaccgatttttacagaagaacctcctatagctgaacaagtgactacagggttaatggaagaaggtggtcaaaaaaatgtattggttctatgtgcaaatggtgcaacaagttctatgttggctaatgcaatcaaaaaaggtgctaaagctcgagctatcgatattgaatctacagcaatggcttatgggcaacacaaagatttaatcaatgaatttgatttgatcgttttagctccacaaatggcttcaatgtttaaagaattggaagaagatgtaaaaaattacaaaacaaaagctgtttctactagtggagcggagtatgtggctttagcgaaagcgccgaatcaagcagtagattttgtttttaagaatttaatttaaggaggtaaagaatgaataagtttccggagcattttgtttttggcgctgcgacagctgcttttcaagcagaaggtgcactattagaaggaaatcgagggaagaattattgggatgattatttaaaagagcaaggtatgtttgatccaagtctagcaagtgatttttatcataaatacccagaagatctagaattatgccgtacattcggtatcaatggtcttcgtatttctattgcttggtcacggatatttccttcaggtgtcggaaaatttgatccatccggtgtccagttttatcacaaattgattgatgaatgtatagctaatggagtggaaccctttgttaccttgcatcactttgacacccctttatctttgttcgaaaagggcgattggctttctcaaaaaacgattattgcttatgttgattttgcggagttttgtttcaaagaatatgggaacaaagtaaattattggatcacgttcaatgagccttggtctgtagtagctggtcaatacattattggtcattttccaccgaatataaaatacgatcttccaaaagcaatccaagctatgcataacatgatggttgctcatgcaaaagtagttgaaaagtataaaaaggcggagtacctaggagaaatcggtattgtccacatcttggaatcaaaatatggtatcactaatcatcttgaagatacacgttctgcaagaaaagaacatattttagcaaatcaatttttattagacgctacttataggggacattacgctgaagatactttggagaacattgaagaaattcttcgcgaaaatgaaggagtgttgaagactacacgtgaagaatttgagatattagcttatgcagctgatcaaattgattttattggagtcaattattatgctagccatttcgtaaaagcttatattggtgaatctactatccatcacaacggtacgggagaaaaaggaagtagtcgttttgcattgaaaggggttggagaaagagtcaataaccctgaagttccaacaacagactgggattggccaatttatccgcaagggctagaggatatgttggtctttatcaaggaacggtatccaaactataaaaaaatctatgtaacagaaaatggaatgggcgaaaaagatgtgttatgtgacaagcaagtgcaagatgattctcgaatcgcttatattttcgtacacttgaaagccattttaaaagctattgagcgcggggtaaatgtagaaggttactttgtatggtcattgatggacgtgttttcatggacaaatggctataagaaacgctatggtttattttatgtcgattttaaaaatcaaaatcgatatgcgaaaaaaagtgcctattggtataagaaaatcagcaacagcaaattgcttgaataaggaagagaggtaagaagatgcgtatagtaatcggttcggataaagatggaatgcaactgaaagaagtgatcaagaaagatctaatcgaaaaaggatttatgatagcagataaaagtgagacaccttctgaagattttgtagcatctgctttagccgtcgcgaatgatctaatgaataatgaaggaagtttaggtattacagtagacagttacggagtaggaagcttcatctcagcaacaaaagtcaaagggatgattgcagcagtagtttcagacgaacgtagcgcttatatgactagagagcacaataattctcgcatgattgctcttgggtcgaagatcgtaggagaagagttagcgttatcaatcgtaaaggaatttttacaagcaacttacgcaggtggtagacatcaagttcgtgtagatatgttgaataaaatggcataaaaaaggagaaagtatgaaaatcgcaattggttgtgaccacatcgtcacagatactaaaatggctctatcaggttttttgaaagcaaaaggacatgaagtattagacatgggaacctatgatttcacacggactcattatcctatttatggaaaaaaagtaggagaagcagtagtgatgggaaaagcagatctaggggtctgtttatgtgggaccggggtaggaatcaataatgcagtaaacaaagttccaggtattcggagcgcattagtgcgtgatatgacaacagctatctatgcaaaagaacaattggatgcaaatgtgatcgggtttggcgctcggattactggagaatttttgatttgtgatattcttgatgctttcattcaggcaaaatatcaagaaacggatgagaaccagcaactgattgctaaaatcaaacaaatcgaaaaagctaatgagtatcaaattgatccgaatttttttgatgaatttatcgaaaaatggaatcgcgatgaataccaagattgtgaggctaatcaatgattctaacgattacgatgaatccttcaatcgatgtttcttatccattaacagaatttagtttagatgcagtcaatcgtgtgaaaaatgtgaaaaaaacagtcggtgggaaaggattgaatgtcacacgcattttgaaacaattagatgcagaagtgatggcgagtggattaattgggggggttttaggggaagaaatcaaagagaggttaacacaagataatatccttcatgaatttttgtccatcaaaagcgaaacacgaaattgcatcgctattttacatgaaggtcagcagacggaaatcttagaaagtggaccaattgtttctacacaagaggcttctgactttctcaatcatttaggaaaattggcagtaaaagctgatgttatttgtttttctggtagtttgcctcaaggacttccgatagatttttaccagcaaatgatacaagtctgcagacccaagccggtcatgttagattgttctggcgaagcattgatgacagtacttaaaggagagtctaaaccgtatttgattaagccaaacatacaagaactagcggagttattagatcagcctatcactacagatgtgaagaaactgaaagtagctttatcggatccgttatttgctggtattgactgggttgtagtctcgatgggtagaaaaggtgcatttgctaaacattcgaatcgattctatcatgtgatgattccttcaatcaaagccgtaaaccctgtaggttctggtgatgcaatgttagctggtttagcggttgctattgaaaaagaaaaatcagttgatgtggtgctgaagcaaggaaatgctctgggaatactaaatgcacaaaaagaaaccacgggttatattgagttagtaaattatcatacattaattaagcagatacaaataaaagaagtctaggaggatatcaatttgaatgaagaaaaacgacgatttatcaatcgcttatgtagtagcgaggggataattggtgctttagcaatcgaccaacgtggtgcattgaagaaaatgattgctcaattcaagggaagtgaagcagaagacacagagattgtagaatttaagaaaatcgttgcctctgaattaacggaatatgcatcatctattttattagatccagactacgggctacctgctgctgatgtaaagaacgaaaattcaggattattgttagcttatgagaaaaccggctatgatacctccactcctggacgcctcccagatttgttagcttcttggtcagtcaagcgcttgaaagaagctggtgcggatgcatgtaaaaccctgctatattatgatattgatgaatctgaagaaatcaatcatcaaaagcacgcctttattgaacgaattggtttggagtgccaagcagagaagttaccattctttctagaattgctgtcttatgatgcaaccattcctgattcaacatcgaaaaaatatgcacgcgaaaaaccccataaagtgattgaaatgatgaaagaattctctaaaacacgttacggggtggatgcactaaaagtagaagtgccagtcaatatgaaatatgtcgaagggtatgggatagatgaagctatttatacaaaatcagaagcagcagcttttttcaaagaacaagctgaatctactcctctgccttacgtttttttgagtgctggtgtaacctctggattgttccaagaaaccttacattttgcaaaacatgccggttctactttcaacggtgttctttgtggtcgtgccacttgggctgatggaatcaaacattatgtccttgatggaaaagaggcagcaattgaatggatgaatacacaaggacgagcaaatatcgaaagcttaaataccgtattgaaggaaaccgcgacacctattgattttaataggttctaatattttttctgttattactacgggagtgatggaatatcatcaacgacaaagaaaatccctgttaattataaggataagtaagagcagtagatccatttattgtggatatgctgcttttttgctgtgaagaatagttggcgaatgtttatttgatcgatcgattcataacatagggagtactagatgcaagcgtttattctttttttatctgatactgtcaaaaaataatataatatgtattttttatttacttataataactattgattgcagtcttgacagtcaagtcatatttgatggatgggggtgtgagatgtacaaatgattttaaagactatgacagctacagttctaattttaattgcatcaagcggcaatagaaaaataagaatcaaaacggactgataatcatctaacaactaatcgacatatatgagcagatacggaacgatattcttctctctcataagttccgtaaagcaaacatgtgctatggatcgattgtatatttattaaaaaaagaaagaggaatggcaatgatgaaaaaagaaactatattagtggcaacgatgttattcagtatggcagtaagtacgactttcgtctctgcagctgaagtatacccaaaggaatataacacagacggaacaatcacatttgaagcaggagatgagggaataactcctccagttgatccggaagatcctgatcccaacgtccctgtcgatccagtagaccctccaagtcctggaacaggaggagcattatcgattgactatggatcaaaattcaaatttgggactcaaaaaatttctactgcagataaaacgtattatgcatctgctgatgaaatgactgatggttctaaaaaaccgacatatgtccaagtgacagataaaagaggaacactatctgggtggaaattaagtgtagcccaaccagaacaatttaaaactgccagtggggacgaactagttggagcacagctgaagtttacgaaagggcaagctgtttctttggttgatccaacatatacacctgaaacggtcaattctgaattaacgctgacaccaggaggaaataatacgttagcaatcaatgctaaatcaggaacaggtgtggggacttgggtctatcgatttggtgcgaatgaaaatgaaaataaagatgcggtacagctttcggtacctggtacatctgtcaagttagcgcaacaatattctactaaattaatttggacattagaagatacacccaataactagtttacttacaagaacagttgaaaataagcatgtagtcaaacggttttgtgaagacaatctaaacaaaggttggtaaaggccaagctatattagtttggacaggaacagttcatctgggaattcaacgatcaggaggaaaagatatagtgaaaaagagaaggatcgtgctcattttaagcagtctattagcgactaatatctttccgattatagggtattctttggaatcgaatcagttggtcagtgataatagaagagtcgaagaaagcaaagaggcttcgacactcgatcgtttaacagaatccagccagatccaagaaagcagtgagaatttaagtactactgacagtaaagagaccactgacaaagaagaatctgaagagttaatcaaacagccattggagaatgccccgacttatcgagtggggctgcctaatgatcccaatattatttctattgataagatttttcaacaacctatcggtaccagcacgtccatattggaaaacgggaagctattgcaactgaatccagcagagaggtctcaaagaggagctatttggtcaaacaataaaatcgatttacgctcagattttacatttaaatgttatttatatttaggaaatcaacgagataaagcaggagatggtatgacttttacattgactggtgattctagaatggctaatgatcccagtcaagttatcggttccccaggtatgggaattggttcttattcgactcgatcaggacagccttatgtcgcaaatgcactctcgattgagttcgacacatataaaaatagtggttcttctgatcgaatggatcgtgaaataactgccgataataagggacatgggcatgtcgcctttgtcactcctaaaccaaataacaacaattattccggagagcatactggcgtaacagtagcacctacctttctctctgatggtacatggcgtacattaatcattcaatgggacgcgtctcaaagaagtctcacctatgatctggaaggtgtcggacgctcttctcacattgtacctgatctcatcagtcaattcggttctacacaagtaaattggggatttacttcttcaacaggtacattttttcaagaaaacgctattgctatgacgcaacttccatctaatgtgtcatcaacagctgatgtaaaagtcaatgatagtgattatggggccatcgctgaagttgaaagaaacgataagataactatcagaaatacattgaaagttactgggaattttcttgaagataagaaattggagactagtatagacctagcacaagaattaaatattcctgagcgtatcttgatcaacggaaatcaagttgataccaaagatatcctgataacaggaaaccgagtcacactcaatctaggagattattttgttcttggagatacattgattattgagttggaaacagatttgcgagaagtcattcccgaaaaggtactcactatgcactttgaatatcttgaggatgcaaagttaattgagcagtcaaatgatataagtctgacgattgcgaagctgaaggaaatagatgtccatgtttactataaagagaaagagagtcaaaatgatctcgcagaaatgaaaacaatcactggaaaaatcggagagaattataaagaatttcctattgatattgagggatatgtttttgactctgattcagcgaatacagaaggtgtcttttccgaaaatacagcggatatctatttttattacagaaaaggaaagctttatctttcagcggctcctcagtatgttgattttgggcaacacaaaatatccaataaaccattaagtgtatttgggcagttctcaggtggattgaaaatcatggatgaacgggcttctggaggttggacattacaattgaaacaagaaaaagttcttacaaatggaacgtttgaactcccggaagctctttcgtttgttacttctgaagagacaacggttatagggtcatctgctgttacgatttttgaaagtgaccaaaaaggcgaaagtgatttgtctgctattttagattctacatctcaacatggaatcagaatagatattcctgtagaaaatcaaaggattggaacatttgaggggaaactatcctggattcttgcagatgttccagaaaattaataaaaagagaagatgaggacaaaagcatggtgcaccaagaacaacaggaaccataaatacttatttcctgcacagcttaaaatggcagagacacgcttttgttcccatcttttcttacatatgatgaaaggagcgatttacttgaaaccaaaacagcaattatttgtaacactcctagttattatagggacactttttaaccatttaccagtgacagctagtgcattcaatttttcggtgacgccaataacttcggagaatcaaatcgataaaagaaaaacttatttcgatctccaacttgttccagatcaggaagtagaattaaaagcagaattgagaaatgatacggaaaaagaagtgaaaatcgacatttctgtgaatagcgcaacgactaattcaaacgtgatggttgaatatggaaaaaatgagattgaaaaagacgaaagtctaatctttgatctgatcgactatgtgagttatccagagacagtgacactggaacctaaaagcgttcaaaccgtggtttttcatgctaagatgccaaaagatcgattcgatggtgtattggccggtgggatcacattcaaagaaattgtgacggaaaaggatcaaacagaaaacaaggatcaaagcttatcgattgagaatgaatacgcctatactgttgccttgttaatgcgacagacactgaatgaagttgctcctaacttagttctccatgaagttaaacctgatcaaatcaatgcaagaaatgtcattttagcaaacgttcaaaatgatcaaaaaacctatatcaatcaggtagttattgaaacaaaaattacaaaaaaagggcattctgaagttttatatcaggaggaaaaagaaggattgcagattgcgccgaatacaaacttttcttttccaacagctttgaatggtcagccactaactccaggcgaatatcatctcacaatgaccattctaggaaatgaaaatgaaaacggaaaattctcaagaaaaaaagaaaataccatcatcaactataccgaccaatggatatttgaaaaagcgtttatgatagacgagaaagaagccaaggaattgaatacgaaggatgtgacgattaaaaaggccaataattggatctacatcttagaagcgctgattttcttgttgttcgttttaatacttatcctttggtttattttgagaaagaaagaagagaaagaaaagtaagatcaaaataataaatattttccttattgcgtgatatttacgttctttttcgatagtataaaacgcttttgtattagcgtagatgcctataagtaaatgatataatcattataataggtctaacagcaagaatggtcaataaacggatcctccagtttgtgtagcgtacagttgggacgatgtaggaaatacgaataagaagggatagtagcagtgaaggaatggaaacagcaatatacgtagaaagagctgatcgctaatgaattatgagttttttttaagcaaggaagattatagaagttattcattacttaaatatttagaagcaagctcaaatttatcagaatcaatctcggatattcaagagaaactatcgttatcgacatttctcttgaaaaaaactatcgataagctaaaacatgatttacaaatgttcgatttagagaaaaactttcgtctaactgttagtgaattggtgatatgtttggaaatcaatggtaaaagttctagtaatgccctattatctcgctatataacagattctttatccatgaaaatggtattggctttctttcaggaaaaatatatctcaatagaaaattttgctgaacagcatcatgtgagttattctgtggcttataaagtattgcaagggctgaaaagaaatctaaaaaagtatcaaattttttttgagaagagaaagttgacaggaaatcctaaaaacatccgcctttttttatataatctttttaactcaacagaaataagtgttgaaaagttgtattcgctacctataattataaaaacagaaaaaatggtaaaaaatttaaatcggtattatcctctttccgcttatgaaaaaaagaaattattccactttttagcaatcaatctattgtctgaacaagaagattctttagatattgccaacaatcagccgctgtttttctcagatataggatttttctatctaaaaggagtactggagacagaatcagttgtttttatctgtaagacactctcgtggctttatctccatgataatttagatcaaaagtatttgaggaaaaaagaagatgaaacaatcgaatggttgaatgagcggttcattgaaagttttgaaaaacggtttaaacggttaccgaaagaaacgagaaaatcgatccaaaacgagttaaccaaaatacattttaaacttttgcattatacccttaataaatcggatgaatttccactagatatttctttttttaatcaaaactatcctacattttattgctatctgttagagtatatgaatgatctaatgtcaaaacacaaagagttgcttcaagataaattttttctttttttcagttatttattgttattgatcaatcacatacccgttcaactggtttctgagccagtaaaaatcatcatcgatttttcttatggtgctgcttataatcgatttatcaagaaaaatttaagtttgtatattaatctgaatacggaagtgatagaggctggaaagtctgattttccggatgttataatcacgaatagaaacaatttatatgaagaaagtgtgtctcaagtagtagtttggcttgatccgccaagagcagtagactgggggaaccttacaaagattttgttgactatccaagaagagaaatacaaagacagcaaaattgacaagcgaatagacgattttcctgaagaaatcatcgacaggatcgaatagagaatttcttttagaaagtccgtctgctttttctaaaaataaaaaaacttggtacgcaatcgctgtaccaagtttttttatttagcttttaattaagccataaataataatttatataagaatactgctacgacaccagcacagataggtgcaacaacgggtacccatgcatatccccattgagaagaacctttatgtttcaatggaagtagtgcgtgtacaagacgtggtgcaaagtcacgagctgggttcaggccaggacctgtaggaccaccaagtgaagcaactaatgtccatacaaggaaaccaagtgctaagtgagctgtaccaaggttatcttggaagaatggtgcttttgtaatacctaaagctccaaagaataaaacgaatgaaccaaagaattcattgacgaaaccattgaatttagaaccaacactgttgattgttgagaatgtacctaacacatggtttacatcttctgtttggtcgtagtaaggtttgtaacaagccactacgatcaattgtccgatcgctgcaccaatcaattgtgcaatgatataaggaacaacttcagcccaagggaacaatccgttagacgctaaggcgatcgtaaatgctgggttgatgtggttaccgctgattccgccaaagatcattgccggcatcataaccccaaatccatatccgacagcaatcagcatccagtcgctgccatatccttttgtaccttttaaatctacgtttgctacagcaccgttacctagcacgattagtaatgctgtaccaatcatttccgccgcaagacgggtcattagtgagtaatccataaatacctccaaatgttataaaaatgcaaaaaaaaagaaacatcaacacgaaaagcctcggtgcagtgtttcgtgtcggaaggatttctgcagtcttaacaaatgtgaataaaaaaatgatttccattacgtataagaaaccagaccaacagcaaaactccaactctttttaaaagttctccacaaatcaccaagcttaactataaatataccaaaaaaaaaacgttttttttctcaaaaattgtatcttagaaatagcatgttttgaaactttcagaaaaggtttgttagtaaaatgaaagctatacgtaaggagtgttgtttgatgaaattttttcaagagtttttcattattattttcttttctgtattaggagaaggtatccgaatttttgctcatttacctattcctgggagtatcttaggtattctttttttatttttagcatttgaaatgcatcttgttgatcctgaaaaaatcggagcaactggtgattttttattgaataatctagctattttatttgttccagctggtgtaggtttattggaatatttcgatgatatcgcttcgatatggcctattttactgggggcagtcgtcgtgtgttccatcgtcacgatggtcgcagcgggaaaaacggcagaaggggtagaagctttgctaggctatgtccgtaagaaaaaagcaagcagggtatctgtaaacgaaatggaggagaatcaaattgactgagttttttgtgaatccattatttggcttaagtttgactttaggagtgtacgtattatctgacaaatttttgcggaaatataaactgcctgttttgaatcctctcgtattatcgattgttgttattatcttatttttgcatttttctggcgtcagctataaagagtataatatcggcggcaattttttgactatgctgattactcctgcgacagtggcacttgccattccgctttataaaaacttccgtttgctgaaagaaaatttttatcctgtaatggctgcgattttagcaggaatagtcgcaaattgcttggttagtgtagggatcggttattttttctctcttcataaagagatggtcatctctttactaccgaaatctgtaacgacggctatttctgtcgatttgtctcatacgatgggcggggtgaatgccgtgactcttgcaattgttgtctctacaggtatttttggctcgctgatcgctactcatattttccgcttattcaagattgaaagtcccgttgctcgcggtgtggcgttaggaagtacttctcatgctatcggtacagcaaaagcaatcgagattggcgaagtagaagggatcatttcagggcttgcgatatgcgtaaatggaatattgaccgttttgttgctaccgttattctttcagccttttgctggcttgttttgatgcgaaaaccactattttatgctacaataaccaaaacgttctagcataaaaaaggagggaaagacgtgtatttgtcttccgagtatcttaaacaatttgataaagatctatattataagattctcctcctagaaagttttgaggatcaagcttggcatactgctgcacaattagcgcaagttgttcagctggatgcccgcagtgtgtcgaaatacctaaacgagctgtctaaaaactatcagcagtttagcggtaagacgcaccctttgtttacaaaaaatcaccgttctggttataacttttatgatgcgctcgattcgattgaacatgagcgttttttgatctatctcgtgcaaagtacgctgaaattccagctgctgcacgacattttttttgaagaattccacacgatgtaccaatttgcgcaaaagcattacattagtgaatccactgctcatcgaaaaatcaatgaatggaaacagcaactgcaaacttatggcattcgtctgcaacgaggtacatatatcgcgcaaggcgaagaagaaatcattcgactttacttgcatatgacattctggcagttgtttcgagggaaaatctggccgtttgaaacgatttctcaaatggacgtaaagaatatggcagaacatatcatggcttttttcaatgttcgtttgaatgaaatcaaaaaaagacgtttggaatacatgctaggtgccttttttttaagaaaatcacagaagcattatgtggtattgaatgagaaaaaaagacggctgatcgcagacaatctgttgttccagcgattctgccaagtcatggagccggtatttcctaattattttcaagtagaagacgaattaggcgcattatttcttgttctgatgacgcgtgaagaatattatagtgatcctaagatacggaagaaaatttttgatttccatcaacaagcagaaacaccgccttttgcagctctttctgaagcaaaagcagctctttctatttatcaagaagaacaggagctaccagcggaagatctgacctttgaggcagaaaactatttgttcagtagtcattttttcgcctatctttttcctaacgcaaaagaaacgattgatggaaacagtagtgacttcattaatcatttagtcattgaaaacaaggaattaaaacaatggttagtacgcttttttgaaagcagacacaaacagcctaatcatctggcgtttaaaaatcatgcgtttttgatgggacggtatctgactgtgtttaaaacattaggagcctttactccacagcttccaaagatcacgatcctcttgatgacagattttccattatttgaagagcaactgttagaggaggggttacggacgtttttccgtaatgattatcagctgatttttctaccaacggattatcggggaagagaagtagatcttctgatttcaacaagtaaagttcatcgaaaaccgtgggcggatcttgactattttattgtgaccgaagaattaaaattgatagattacattcagctatctcaaaaatttgaaatgattcaaaaacaaaaacaatcaaaacaataacaaaaaaaggagaataaagatgacatttgaagaaattttaccagaattgaaaaaaggtgcaaagattattcgtaaaggatggagtggatttgagctttatgttgttctcgtatccgatgatgaatttgatggctgtccggtgacgccttacttattgatcaaaacaagtgatgaaggtttttctagctttgctcctacagtttgcgatattttagcagatgattgggcgatcgtagaatgaaaaaccgttatccagatttagccaaacaggtcgtatttattacaggagctgcttctggtattggtgccgcgcaagcccaagcttttctggaacaagatgcctttgtttttggattagatcaaaaatttggaaaaatggaagaactttcttttcgatttcctgaaacttttgcctacgcactaggggatgtccgacagaggaaggaactccaacaagcggcatcgaaatgccagaatcattttggtgaagttacgattttattgaatactgcgggggtactagatgcatacaaatccttgatggaaactgacgaatcgctgtgggatctgatttatgaaacgaatgtgaaaagcatgtatcatctaacaaacatcatccttcctgatatgatccgccgaaaaagcggaacaatcatcaacatggcttcgattgcgggtttggttgctggcggaggtgggattgcttatacaagtgcgaaacatgcaatcgtcggttttaccaaacaactcgctctggattacgcagagcaggggatccgagtaaaaggaattgctccaggagccatccaaacgccgatgaatgcggctgattttgaagggaaaggtgagatggcagagtgggtggcaaatgaaacaccagtcaagcgatgggcacagccggaagaagtagcggagctgacattatttcttgcctctcctcaagcaagctatatacaaggaacgattattccaatcgatggtggctggttgctaaaataaccttgtgtttttttcaagcttctgtatgataagaaataaagagagaaccaaatggttgatgataaaagaaagtcgatgattgttcccggcatttgatgtcagacagctttttcacaaccttctaatataaacagtgttcaaaagcttgcaactgcggtaataagtccaaccaaatggaaaataggaggagctatttttatttgactgttcttattacttgttgcagggcagctttttcacaaccttctgcggcacttcagttggaattttcttcccatcctttggtcgcagtcattaccaagataaaattatcttgcaaaggagaaatagaacatggaaaaaaataatacccgttcagccaaacgctggacaacgacagatgtgacttggatggcgctagtcactggtttatatgtggcagtgacgctggttttgtctgtttttagctttggagtgattcagattcgtctctcggagatgttcaactatctgtccttgtataacaaaagatacatcgttgcggtaacagcaggagtagctttggctaatattgcttctcctcttggactgatagatgttgtagtaggaagcgtcagcacgctgattgtattgcttatcaactataaaatcactagtcgcatcaaaaacatgaaaatcaaaatggctgtgacagcatgcgtattcgctttttccatgtttacagtagctggtcagctaacgattttatatcaactaccttttttcttgaattggtgggtgattgctttaggagaattggcatcaatgattgtcggtgggataattatttattggatcagtaaaaaagtagatttgacaaaataaagatctgtttaaattaaaatatggcagcgtggaagagaccggatgttgagtcttcttccatgctgcttttttgttcaattcgttcgaagaaatcgatttagccgtttcttcaacaagacaccgatataggctgctccagttgctttgattgcttccggcagtaaaaaaggcagcagcccactggcaaatgcagttgtaaaagtaaggtcgccacttatcttcagccagatcgtcccacagactaatgcggcaagagaacccattagattggcaaagattgcgtacaagtaatgagcgtctgttttttcgatcatccagccagttagccatgtttgaaagagaaatccaatcaaatatccgccagttggaccaaataaaacagctatgccgccagtcatccctgaaaatacaggaagaccgatcaaacccagtaaaagataaaccgtaacagatatcaatcccagttttcttccgagaaaagtggctgtcagtccaatagcaaatgtttgccctgtcaaaggaaccaaaccaaaaggaatggtcatctgagaaaggacagaaataatcgcggcaaattccgcagcaagtatcaattctttcaatgttcggttcataataccctcttttcgttaacttaatattttttcttggttaacgaaattgtaaaacaaagtgattgctttgtaaatagaaaataaaaaaaagaccagctatccaatagatagcggcctttttcaagaaagcttttgaaattataagctttggttgtagtattcaacgacaagagcttcgtcgatttctggatatagttcgtcacgttctggtaaacgagttaatgaaccttccaatttttcagcgtcaaagcttacgaatgctggacgtccaacagttgcttctacagcttcttttactgttacgatgttttgtgatttttcacgaactgagatcacttgacccacttctacgtggtatgaagggataccaacgcgtttgccatcaactaaaatgtgaccatggttaactaattgacgtgcttgacgacgagtcgttgcaagtcctaaacggtaaacaacattgtctaaacgttgttctagtaagatcatgaagttaacaccgtgtttaccttctttgattttgctagcttttacgaacaagttacggaattgacgttcgttcattccgtacatgtgacgaagtttttgtttttcagttaattgcatgccgtattctgattgtttgccacggctgttaggtccgtgttgacctggtgcgtaagggcgacgtgctaattcttttcctgtgcctgacaatgagatgcctaagcgacgagaaattttccatgatggtcctgtataacgagacattaaaatttcctccaatgaatataagtttttggagtaaaataatccgttgaaaaattcataatcatatagtttgttcttcaatcttcacctttgcagccgcggttacacaatcgaacccgagacggggcaacaaactagggatgagttattatttttctgctgcattattttacacaaactacagtatatgatagatcatccatgaatgtcaagataattagtatgtaaaaacgctttacaaacctaggctctctttataaaatgagaaggtatgtgcaaatggaaaaaagtgaaggaagtttaaggagaaaatcaatgaatccggtatcaccattatttgagaaaatcgatgcttcaattgaaaagaaggcgaacctttttgaaaacagcttttcacgttacgctgttcgagcggttcttgcctgtttgtttttgactttaggaacggctgtggcatttgcgattgcgatgaagggggaagatatcgcgcacggtctaggaaagattttatacgcatttatgttcagctgggggctggtcatgattctatacatgaacgccgaattaggaacatcgaatatgctttatatgaccgtgggtgtttttcggcagagacttgctttaagtaaggcagccaagattctatttgcttgtatttttttcaatatgattggcggtatgttatgtggatttcttatttctatgactacgccatttcaagatttaacgttggacaactttatgttagaatcaatagcggtaaaactagcaaaacctgcaacaacgattttggtggaagggatgtttgcgaatatcgttgtcaataccgctgtactgattagcatgcggatgaaagaagatgctgggaaagtaatcacggtcgtattcattattttcatttttgcttttttaggatatgaacacgtgatagcgaattttcctgcctttacgcttgcttactttgcttctcatggtcagatggatggaatgacagccagtaatgtgttacataatttgttttttgctttggcagggaattatattggtggcggtttagtgatgggactgggttatgcttggctgaatcaatcaaaatcatcctatgtggactaaaaagtcgttcattaagggaggaaatactatggaagtgttagtttttccaaaaaatgaagaaaaagcgttacaaatggaaaagtacatgaaaaatctctttccttttgctggagtacctaagccggaacgcgctcttttgcaacagccgttattggatgaaagcaaacatttatctgtttctgaagttttagcttttgttcattactattatgaacaaatcgaaagagaatatcagtatgtggcgatcgatttagtccaaaaaaacatcaaacggtttacctttgaagagctagttacattgttaccactagtccagaaaaaagaatggtgggacagcatcgattcttggagaaaagtatacagtacatggtgtaaatcccatccagagcaacgtaaagaagtctttcagttgttcgaaaaaaaggaagatttctggttgcgtcgaatagcaatcacgttgcaattaggttataaacagcaaacagacacagcactattgattcgagcaatagacgaagaccgtcaaacaaaggaattctttatccaaaaagcaatcggttgggcattgcgtgattatagtaagaccgatgccgcttgggtaaaaagtcagctgacaacagatttgagcaagttagctgttcgagaggcaagcaagtatttataagaaagcgagacgacaagagatgagacgcaaattatttgcttttgatattgatggaacgttgttagattcaaataaacaagctttagatagcacgagagaagcattggaaaaattacgcaaagccggtcatctggtcacgattgctacagggcggagtcgattccatgcgcaagaagtcattcgagatctggattttacgaactacattttatgtaatggagcggccggttttttagaccatgaacaagtatataagaatttactagatcgcgaacagttagatgcattcgtccaggaagcgcatcatgaacagatcgacacagcttttgtcagcttagacaatatcaaacgttcttcttccaatgatgtaacggtgatggaagaggcgatgcattctttcggcgctgtcttgcctgaactagatcagttttttgcagaggaacaagaaatctatcaagcgttagcatttttcgatcaaacctatgatggaaaattctcttcatatgataagatccgatttgtccgttggcatgagaacagtgtagatgtcgttccccaaaacggttctaaagcggcgacgatcctacacttagcagaacaagtaggtatcccgcatgaagatattatcagctttggtgacggacaaaatgaccgtgaaatgttgcgtatgtcaggaatcggaatagctatggggaatgctgtgccagaagtacaagcagaagccaagatggtcactgatacaaatgatcaagatggcatctggaaggcattgaaagagttaagtgtgatttaaaagaggttgtgaaaaagctgtcctgcatcaagtaataagaacagatttatgaaaattgtttctcaaatttttgaaaaatttcggcttatttctgaagaagcagcagatggaacaacgtttattcgggaaatgggactgtgacaagatttttgccacagtcccatttatttattttatttttcaaatctaagaaatatcaggaaagtgttccttttgtttgaccttttctttcttattgaaaacaactataatatagagtgatgttaaaagagaagaggaatttagtgtgcgggtattgtttattggtgatgtagtaggttcaatgggacgagagatgattactgaatatcttcctaggttgaagaagaagtatcgtccgcaagtaacgatcgtaaatggtgagaatgccgcttctggacgtggaatcacagaaaaaatctataaaaaatttttgcaagacggtgtagatgttgtgacgatgggaaatcatacgtgggacaaccgcgggatttttgagtttgtaaatgaagccaaaaagatggttcggccggcaaattttccggaagggacgcctggacaagggatggtctttgtcaaagtgaatcagatcgaattggcagtaatcaacatgcaagctcgttctttcatggtggacttggatgatccttttcgtaaaatgaaggaactagtagaagaagctaggaaacgtacgccaatcatttttgtagattttcatggagaaacaacaagtgaaaaacaagcgatgggctggtttttagatgggaaagtttcagcagtggtcggtacacatacacatgtccagacaaatgatgcgcgaattttgccaaaaggtacagcgtatctgacagacgttgggatgacaggaccctacgatggtattttgggtatgcgcagagaacctgtgatcgaaaagtttctgaccgcattaccaaaacgttttgaagttgtcgaacaaggccgatcgattttaagcggctgtatcttagaattggatgatacgacaggtcatgcaaaagaaatccagctgattcaaatcaatgaggatcgaccgttcatggagtagaaagagaggcagttttttgcagcaggagccggaaattcaaaaagaagtaaggaaactgacaaaacttttaagagaaaatgaaacgatcattcgctacaaagtacttgaagaaaagatccagcaaaaccagtatttagctgagttgagagagaaaatcaaacaagcgcaaaaagaagctgttcattttgcccactatgacaaaccagcagcagaacaagaagcaatcaagcgagcggatcaattcatgaaagaatttgatcagcatccgcttgttatagcttatagaaaacagctgttggaagcagatgatctgcttcatcatttaacaacgatgatacaagaagaaatcaatggacaaatagaggaggaaaaacatgcctcaaaaaactaaaaacactcctatgatggaacaatatctaagcatcaaggcacaataccaagatgcttttttgttctatcgtttaggagacttttatgaattattttatgaagatgcgatcaaggcatcacagcttttggaattaacgttgacgagcagaaatcgaaatgcagaagaacctattcctatgtgcggtgtacctcaccatgcagcacaaggatatatcgataccttgattgaaaaaggctataaagtagcaatttgcgagcaggtagaagatccaaagacgactaaagggatggtcaagcgcgaagtgattcagctagtcactcctggtacagtcatggacagcaaaggattgtcggcaaaagacaacaattttttaacagctgtagttagtcaaggaaatgaatttggctttgcttatgccgatctaagtacgggagaattgaagacggctcggttgcatgatgaagaagctgttttaaatgaagcctctgcattgcagacaaaagaactcgtattaggtagtgagatcactgatacccttcgtgaacagctaagcgggcgtttagggctagtcttttctcaacaaaatgaaatggaagaaaatgccgaatttagctttttgacaagtgaactagtcgatccgctggaaaaagaagcaactggtaaactattgacttatttagcggtgacacaaaagcggagtttagctcatatccaaaaagcagtagaataccaaccagatcattttttgaaaatggattattattcaaaattcaacctagaattaagccaatctattcggactgggaaaaagcacggcacccttctatggttattagatgaaacaaaaacagcaatgggtggccgcttactaaaacaatggctagaccgtccgcttatccaggcaaaacaaattaaagcaagacaagaaatggtcgcttctttgctagacagttattttgaacgtatcgatttgcagtcagcattaacgaaagtctatgatctggaacgcctagcaggtcgagtagctttcggtaatgtcaatgggcgagacttgatccagttgaaaacttctttagaacaagtgccaatgatcagagggttgattgaaggaattgatcaaggtcaatggcaaagtctgctttcagaaatgcaaccgatggaccatctcgtccaattgattgaccaagctatccaagatgatccgccgttacaaataacggaaggaaacatcatcaaagatggattcaatgagcagctcgatacgtaccgttctgctatgagaaacggaaagaagtggctagcagaacttgaagcaaaagagcgtcaagaaacaggaatcaagaacttaaaaatcggatttaaccgcgttttcggttattatatagaaatcacaaaagcaaatcttgggaatgcagaactggagaagtatgaacgaaaacaaaccttagcaaatgcagagcgtttcatcacaccagaactaaaagaattggagacacaaatcctcgaagcagaagaaaaatctgttgatttagaatatcagttgtttttagctgtgagagaagaagtcaaaaaggctatccaaccgctacaagtacttgcaaaagcaatcagcgcagtagatgtgctacaaagttttgcaacaatcagcgaacgctatcagtatgttcggccagaacttgtcagtgacaagcatcagcttctgatcaaagacggacgacatcctgtagtagaaaaagtattaggacatcaggaatatatccctaacagcgtagaaatggcagaagacgaaatgattttgctgatcacaggaccgaatatgtctggtaaaagtacgtatatgcgccagttggcattaactgttctgatggcgcaaatgggctgtttcgttccggcaaaacaagcagttttacctatttttgatcggatttttacccgaattggtgcaagtgacgacttaattgctggacaaagtacttttatggtagagatgatggaagccaatcaagccctacgttatgcgacgccaaacagtttaattttgtttgacgaactcgggcgaggaacagcaacctatgacggaatggcgttggcccaagcaatcatcgaatatatccatcgtcatgtacaagcaaaaacactcttttctacccattatcatgaactgacggtacttgaaaaagaacttccgcagcttaaaaatgtccatgttggagctgttgaaaaagacggagaagttgtcttcttgcataaaatgatggatggacctgcggatagaagctatggtatacatgtggcaaaaatcgcaggattgcctgccaatctacttgagcgagcagcagatatcctgcatacgctagaaaatggcgataacggacaccatactgttccagctgaaataggagagaagactaaaacagccaaacaggagcaaataaaaccacctgcagaaaaagtaaaccaagaccctatacaagacagtgtcaaagaagaaacccaacaactttctttattcggtgaattatccgaaaatgaaacagaagtcattgaatcactgaagcaaataaatttactagaaatgacgccaatggatgcactaaacacattatatgaattacaaaaacaactgtaggaagaaggcggatatcgatggccaaaatccaagaattatctgaacgtttagctaatcagatcgctgcgggagaagtagtggaacgaccagcttctgtcgtgaaagaattagtggaaaatgcaattgacgccggtagtactcagattgatatcttagttgaagaagcgggactgcggacgatccaagtgattgataacggagaaggcattttggcagacgacgtagagaatgccttcaagcggcacgcgacaagtaagatccataatcgtgacgatctttttcgcatacgaacgctgggctttcgaggggaagctttgccaagtattgcctctgtttctgagatgattctggaaacggcgaatcaggaagaaaaacaaggtacttatcttttgctcaaaggtggcgaggtcatggagcatcggccagcacctctgcgtcaaggaacgaagattaccgtcagcaacctgttcttcaatacgccagcccgcttgaaatacgtgaaaacactgcatacagaattagcgaacatcggggacatcgtcaatcgtctggcattaagtcatccaacaattgcttttcgtttagtacatgatggaaacaaaatgttggcaactgctggaaatggcgatctgaaacaaacgattgcgggaatctacggattatctaccgctaaaaaaatgttgaaaatcgaaggaaaagatctagattttgagttatttggttatgtttcattgccagaggtgactcgtgccagtcggaattacttatcgacgatcatcaatggacgttttatcaagaatttttccttaaataaagcaatcgttgcaggttatggatcaaaattaatggtcggccgttttcctattgctatattggaaatcaagatggacccgcttttagtcgatgtaaatgtccatccgacgaagcaggaagtccggttgtcgaaggaaaaagaactaacagagctaattagtaacgctattcaaaaagcattgtcacaagaaaacctgattccaagtgccgcggataatctacggttcaagaaaaaagtaccagatcagcctaaaacggaacaaatcgaaatcgatttgtcctatgcttttgaagaagaaaaacctaaaaagccaagtagtttgaattttgaccgagagacaggaaccttttttgtagaagaaccaaagagcacatttgttgacagatctgttgataagtctgtggaaaatgttgaaaacttttctggcttttctgaaggaaacactagttatccagaaaaaacagcgaaaacggtggataagtttggtgaaaatgttgataactttgtagaaaaaacagtggaaaaatctgaaaagaaagaaattcctactgtggataacacgaaagaaacaaataaagaacagatagatatatccttagaagagaatgaacagatttacgaggaagaattgacactgcatcctgaatttgatttcactcacggaaacgacaaaacattagaacaagcgatcaagaaactagaaacggaaacaccagttcaacgttttcctcaattggaatattttggacagatgcacggaacgtatctttttgcccaaagtagcgacggattgtacatcatcgatcagcatgctgctcaagagcgtatcaaatatgaatatttccgggaaaaaattggggaagtatctgatgatctacaagaattacttgttccatttgtgttggactatccaaacagtgatgctttgaaactaaaagagcaaaagcatttgctagaagatgcagggatttatttagaagaatttggtcaaaacagctttattgtacgggcccatcctacttggtatcccaatggtgaagaagaatcgattattcgcgagatgatcgacatgctattgacgacaggaagtgtgagcgtaaaaaaattccgtgaagcaacagcaatcatgatgagctgtaaacgatcgatcaaagccaaccattatttgaatgaagcacaagcacgtgtgctgctgaaagatttagcacaatgcgaaaatccattcaattgcccccatggccgcccagtattgattcactttaccaactcggatatggaaagaatgttcaaacggatccaagatccgcattaagtcagagagaagagggaaacatgaagattatactagcgtcccaatcaccaagaagaaaagagttattggctcacatcgtttcagaattcgagatcgaacctgctgatattgatgaaacgccatttccagacgaactgccagtcgattatgtacgcagaatggctgaagaaaaagcacgaactgtttgggaacaaaaagaaaagaaagacagcttagtgattgctagcgacacgactgttgttctcaaccaggagatcatgggtaaaccagaagatatggctgaggctgaagtcatgttgaaaaaattaagcggggaaacacatactgtatacacagcagttgttttaaaaacaaaggagcgagaagaacgaatactagcagaagcacatgtcactttttatccactgacagatgaagaaatcaatcgttacttggagacgggagactatgcggataaagcaggggcatacggcatccaaaatgctgccagtgtattcgtcaaagaaatttctggagattactacagtatcgtagggtttccgattggtgctgtcaatcaggcactgaaaacattcaattaaacaaaaaaagcggactatctgattttcgattgaaatccatgatagcccgtcttttttattgaaaagattacttatctactctgactaagattttacttcagcgttaccgactgcttcgcctgggcgaacaagtcctgattggtcaagggatagaccagcaactttttcgttattagttaaagcaacaataatgtcagttttcttaccagcttgttctatttctggcaattccatttcagcaatcagagtttctggtgtgacaagatctccttctttcacgagtacagtgaaaggaacgccttttagttcaacggtatctaatcccatgtgaacgagtacttccagcccctcatcagaaagaataccaatggcatgttttgtttcaaaaacactcgtcactttaccatttactggtgcatagactttgccgtttgacggttcgacagcataaccgtcacccatcattttttgtgagaaaactgggtcatttacttcagtaatttccttgatgtttccagcagccactgcgaataatgtttcttttgttgcaactgctgtaccagttgctgaaacaggttcgaaagactgtggcattgctgttgcaccattcgctgtttgaagctgtacatcagcagcattttcaggaacagcaggatcaatcttattcaagattccctggcgtctaaagacgatcgtcaagccaaatggaatgatgatagcgatgatcattgcgatgatgaaaggtacccatgtttctgcttggatagctagtattcctggtaacccacctactccgatcgcgtttgctcgaacatccatcaagttggcaaacatgccagctaatccagaaccgaccattgctgcgacgaaaggatagacgtatttcaaattgatcccgaacatagcaggttcagttacgcctaagtaacaagaaatcattgctggaatcgagatttgttcttcttttttgtttccacgatgcaagaagacgatggctaagactgcagagccttgggcgatatttgataaagcaatcatcggccataaattcgttgatccgaaatctgcaatcagctgcatatcaatcgcattggtcatatggtggagaccagtaattactaaaggtgcatacaggaacccgaatacagcactaaacaaccagctgatagaagacgtcaacccggtatttacgatagttgaaatccagcttccgactgtccaaccgataggacctaaaataacgtgagcagctaaaacagttggtaacaatgaaaacaatggaacaaagatcattgaaatcgactgagggatatatttgcggaagaagatctctagatacgctaacataaaccctgccagcatagctggaataacttgtgcttgataaccgatcatttggacttgagcaaaaccaaaatcccaaaatggaatatctgctgcagctgtggaagctacactataagcatttaataattgcggagaaactaatgtaattcctaaaacgattcctaatatttgtgtagtacccatctttttcgcaatactccaagtgatacctactggaagaaaatggaaaattgcttcacctggcagccataaaaaggcattgacgccattccaaaattgcgagtgttcaacgatcgttccaccaagactttcaaactggataccctcaagtacatttctgaaaccaaggatcaatccgccgacgataattgcaggaatcagtggtgtaaagatttctgccaagacggcaatggcgcgttgtacgggatgaaggttttgttttgctgctgcttttccttgttctttagaaaccccttcaactccggatactgcaacgaagtcgttataaaaagtagaaacatcatttcctatgatgacttggaactgcccagcattcgtgaacatccctttcacgctaggaatatcttcgattgctttttgatctgcttttccaagatcatttaggacaaaacgcatacgagttgcacaatgactaactgcagcaatattttcttttccgccgatatcatgtagcagtttctcggcatctgcttgatactttgccatatcaataaacccctttcttttaacttgtctatgcaagttgcttctttgtttactatactttttttcgggaagaattgcaagcgttttattcaaaaacgtccagaaaaatgatatcgttttaaaaagcataaaataagcttttcttaaaaagaggaacattgaaatacaaaaagagctgtagtatagtgaagaaatgatggaagaacgagtgagggaaaaaacatgaacaagttcaatgaaatttttttagatttggaacagaaaattttagcgaaagaatatcctccgcattcgcttttgcctagtgagaaccaattgatcaaaatctacggtgtttcacgagaaacaattagaaaagcactgaatcttttgacgacggaaggatatattcaaaaaaaacaaggaaaaggatcgatcgtactagatcgaaaccgctttgattttcctatttctgggctgacaagctataaagagctacaggaaacccaacgtataccaagtgaaacgatcgttcatacgttagaagaaacagaagtaacaaaatcactgaatgagattactggctgggagattggtgcacctgtctggcatttgatacgcgaaagaaaaatcgatggtgaagtggttatattagatactgattatctattaaaggagattgttcctcatttaaccccagtacaagcacaagggtcgatctatgaatattttgaaaatgagctttctttaacgattgcttacgcacaaaaggaaatcacagtagaagaagtaacagatatcatgaaaacaacgatggatcttcacgatgacacttacgcagtagtcgtcagaagtcttgttcatttggaagatacccgctgttttgagtattctgagtcggtacaccgattagataaattccgtttcgttgagtttgcccggcgccgaaaagtgtaaatgattcgaaagaaagcaaattgttggcatctgtctgctttggcgctatgataggaacacaaagggggcatttttaatggataaaccaacaagaccagaaaaagaagaactgaaagaaaaattatcaccgatggcttatgcagtcacacaagaaaatgcaacagaacgtccatttaccggaaaatacgatgatttttacgaaaaagggatctacgtcgatatcgtcagcggcgaaccgttatttagctctgcggaaaaatatgacgctggttgtggctggccatcattcagcaaaccaatagcgaaaagacaagtacgtgaaaaagccgatttttctcatggcatgcatcgaatagaagtccgaagcaaagaagcaaactctcatctcggacatgtatttaccgatggcccagtagataaaggcggtctacgttactgcatcaattctgcctcactaaaattcattccctatgaaaagatggatgaactcggttatggcgaatacaaatcactggtagaataatgaaaatacaaaaagagcggtacaatacggggattcactcgatcgtccgctcttttttattcaagcgattgctatttgaaagaaacgctccccagactccttttttcacaaggtgaaatgtgctacaataaagggaacgtatgtgtgcaaaagaaagaggactagaatatgtatgaatatctgacaggtgtggttacctttatcaacccctattacatagtagtagaaaccaatggtatcggctaccagatcgcactaggaaatccttaccgctacagcagcaaactaaatcaaaaaataaaaatttatgtccatcaggtgatccgcgaagatgcacatcttttgtatggatttgattctttagaagaaaaacaactgtttttgcgattagtcagtgtttcaggaatcggtccaaaaagtgctcttgcgatcatggcaagtgaagaccactccggtttgatccaagcagtggaatccagtgatgtcacttatttgacaaaatttccaggggtagggaagaagacggcgcaacaaatgatcttggatctaaaaggaaaatttggtgagctgagtatcgatacgcccttcagtctattcgatgaagcaactacaaaagacgctaccgctctatctgaagcaatggaggctctctccgctcttggttacagtgatagagaaatcaaacgtgtagaaaaacaattaaaagaagtcgataatcagacaacggatgagtatttacgccaagcactcaagctgatgatgaaaaaataaggaggagaccaaatgacagatgaatacttgttatcaccagaaactggcgaaaatgaactgagtttggaaaaatctcttcgtccgcagttgctttctcagtatatcgggcagagaaaagtcaaacaagagcttcagatctacatcgaagctgccagaaatcgggaagaaccattagatcatgttctgttgtatgggcctcctggattagggaaaacgacgatggctatggtcattgctaatgagatgaacgtgaacattcgtacgacaagcggccccgctatcgaacgtccgggtgatttagtagcgatcttaaatgaactggaagcaggggatgtcctatttatcgatgagatccatcgattgcctagagtagtagaagagatgctttattcggccatggaagatttttatgtagacatcatggtaggacaaggaccaaccgcacatccggtccattttcctcttcctccctttactttgattggggcgacgacgcgagcaggtatgctttctgcacctttacgcgatcgatttggcatcatttcacatatggaatattatgacgaacaggatctgcaggagatcgttttacgttcttcggatatttttcaaacagagatcattgaagaaggggcattggaaattgctcgccgatcgcgaggaacgcctagaatcgcgaatcgcttactcaaacgggttcgtgattttgcgcaagttcaaggagacgggaaaatcgatcgtcctatagcagatcaggctcttactttgctacaagtcgatcaagctggtttggattatgttgaccagaaattgttacggacgatgatcgaattatatggcggcggacccgtaggattaagcacgctttccgtaaatataggagaagaacgagaaacagtcgaagatatgtatgaaccgtacttgatccaaaaaggatttttaaagcgtacacctagagggcgaatggctacggcttatgcttatgaacatttcggatacgactatcatatgtgatttttgcttttagattggaggaaaatgaatgagtgatacaacacgtacgaaacaattgatcaaaaacgtattgattgatttgtgccaaacacaatcttttcgaaaaatcagcgtccaaaaaatcgcaaatgaagcaaaaatcaatcgtcaaacattttattatcattttacagataaatacgatttgcttcgttgggtctattgtgaggatgccttgcattatttagacccgcaatgtcttactcttgataattgggaagagcaagcattgaaaatgctgaaagcaattgctgaaaagaaagagttttacgcaaatactgtgctttctgaccaagaaattttacaaaaagaattctctcaactaatccaaaaatcttttatcaagatttttgagcaaatggatgaagaaagacagctttctgcaaaagataaactattttatgctcgttttttttcttacggttgcagcggcgtgttagtcaattggatcacgaatgaatatgaagaaacaccgatggaaatcgctatgcagcttttccgtttagctaaggatacggaattatactcttatcgtctttatgcaaaagaagagttggaagaacagtaatagaaataatctttcgttgaaaaagccatgatcgttaaaaggagatgggaaaatgacaaaaattttatttgtttgtttgggaaatatttgccgttcaccaatggcagaaggcttgttgaagaaacgagtagcatcagaaggaaaggaagcagagttttttgtggattctgctgctacaagtacgtatgaagttggaaagacaccgtactctggaacgaaaaaaatattaaaccaagaaaatgtagatatgacgaatatggttgctcgtcaaatcacaccccacgattttgaaacttttgattggatcattggcatggatcaagaaaatgtagaagaactgaaaagaagagcaccacgctcagcacaggaaaaaatccatttgtttttaagtagcatccctggaaaagaaaaagaaaatgttcctgatccatactataccaataactttgatgagacatatcaattgatcacagaagggttagatcattggtggaacatttggatggatgaaaataaaataacaaacaatttctaagattagcgctttctttttttagagatgttagagcatttccttgtttttttgtaaaatgttaggtaaaataagattaattaagtaacactttcttagctaaaggaggagtgcattcgatgaacgaagagacagtatcaccaatgaagaagcttacgaagttagttactcatacctcgtatcaactttttgattcttttgtaaatgacactgaagaacatgctaagaatgtacgattgcaaggaaagtttattcttgagctgcaaaaagctgcgactgaacatagtttagttatcttacaagtaagagcgaatcgtttgagtagcaagtatgaaacgatctcaggttgggtggcgacaaaaacggtcgaaaaagaccgagtaatgatccgcctacaaaacgaagagcagcagatccgcatggttcccgtagaacaaattgaaaaaataacaatcctttcgccagcaggagaacaggaacggttatcaaaataatttataccagatagaaaagcacgtatgagcttgtaccatcaatcattactaatcaaaaataaccgaatgctttaagcggatatcgataaaacgaaacgttttacgatgagtatcacagcatgagagcattcggttgattagttgaatcgattgtatgggacaagtttttttgataaaaaaaggtcctgctagccggggagctagcaggataaggagttaaaaatgaaaaagtgttgttagggttgtttgttagtatgcttatataatagtcattagttgtgaatattttgtgacgaaagttttcgaaagttgttaagtttttttgcgaaatttatttttatatcatgtatttgtctaaaattttatactataaaaagatacgttgtgcaatcagctaccctttggtattagtgaaaaaaacggtaaaatagctccttatattttgctgttttgcttttctaatacttaagccaaggcgctgatttcacaacctttttttacaaatcaagcgattcccatgagtcaagaactatcttttcttcaaaaagaaataataggaatagaagccttgatagttgcgataaaataaaaatggatagataaaattcgagagaaacatgtattgacgtagcagatgaaagggtcagatttgttagtgtatcaggagtgccgttagaagaacaaaaggagagagaagatggaattattagaaaaagaaactgttagtttatacttaagacatgattggactccattccattatgtttttttaaaagaggaaaagtatagtgggataaacagtcatcaggaagcagttttagaatttcttaattgctcaaacaggtttcgagagtgtctgcgtctgatgtggagtgatagaaatcctatgaaaatagatcatgaagcatatgctcgtaaatttcatgagcttaacgaagaaaaaatcaactatacggatatccgattttttgacaagatgaaagagtaccctatttatgtgaataaagaaatgatgaaggcgaaaagagtcacccctaaagcattatgggctgaggatggtatctatcggacttcttttcttaatgcacctcaaggagcggcaggaacggaagaagaatttaaccagttgaatgatcgtcttttcccagataaagatcatctgcacatttacctttggaataatgaatttacgaattattataataatggtcgttattgggatggcgcttatgtgtggtcagtgtatgacgaaaaaagaaagcgatttactgttttcgatgctacactggtattggattgaattacttcatataaatttttgaattaccatgtgatttctttcgtcagtgtaattttcaaataactgttcaatcgttagctcattttctaaatttactacgagtattgtgccctgattaatttgatttattaataaaatttagttaatagagtgatagaaaaaagcttcttacaaaccgatttctcccttaaatcctcattatacaatgattctttctaatcgacttgaggaactatatccattggaatagaataaactacatcaaatatactgataaattttcttgatagaaatatattagtgatgttagtatcatatcttaaacatcttttcgtaaagacagaaataaattaaacttatctacgagaagatgttgtaaacggccaagttaaaatgtagaaaagggggtgcggacgttttcttgcacctttattctataaaatacctaactgtttacgataatctatcgagctaagtccaaccagcgagcatttgatttgtttctgattgtaccaaagaatatactcgtctaactcagcgatgaattgatcaatagagaccaatttccaatcatgaccataaaaaaattcatttttaagacgacccaaaaatccttcacaggctgaattgtctggagaatattctttctttgacattgaacgaattaaattgccttgtttcattcgttcaatccatcctggccagcgataatgtgctgccccacgatcagaatgaacaataggagagttccctggactcaaagtagccacggcgttgtctaacatagaattgaccatttcagcattcggttttgtacttatagtccaactgataaccgcaccgtcaaaacagtcgattataggtgacagatacacttttcctgaaggaatgtattgtttatttttctctgtagataatttatttctagctaagtaatataatgaataaaaaatagagatcaaaaacttaaaagtttttgacccaataaatttttcaagcgactctatcttgcacagtctaattgacctttaatacagtctatatttgtagagaatcaaaaagcccaacaaggcatgctccgttgacctttaaaaaagtaactttctgacctaattaattgtgctactaaaagagctgtgaaatgagaaataaaaaagggggcaaaaacttttaagtttctgacccttttgatttatttcttttacttacttcttaaaactatctaaaatcattttttttacttagatgtcgctcatttaatgtgaacccaataacagcaactaatagcgctataactgaaagtataacatcgtaagaagttatatcatgaaatctaagtataggtgaaactaatgtaacaagactgcacaaaaatattcgttcgctcctatgagattgcggatcatacgtcatacttttccatgttacatttacgatatttttgcgtagcaaatatgtccacaaaacaatcactaataggatagttacgacaattagaatccacgcaatcaaaccataatacttaatttgctgtattagagaagatgctattaccaaaagaacatatagtccaatcaaccctatatatctctttttcttattattagccatcgctaaacaccctctctttaaatgcaccgattaattaggaagctttccaagttacatgatctaaatacatataaattgcaccacctgaaggatgcgcctgaacagctgtaatggattctttacaacgacttctaaagccattgaagccaagtcctacaaaaccgccaacaatactaccaggtattccacctagagcgcttgaaaagattgctattgcatctccaattgctcccattccataagttttattaaacattgcaattaaatttttaccatctgctgttgatgtatatcttattttaacaccaatatagataattgacgaagtatatcgaagattaggactgtttggatcaagaatatgttcatttccattctcgtcaattcctataatttcaaaattttgaaaatcattttgatctaaaatagaagatgctcccaatgtttggttcaatgttaccggtaatgtagttgaatttgtagtcgtagcagtggatgttggaacctctgccgctgaagcagttacagttggaacaactgtcgatccaataatagaaacacccagtgtagcaacaacaattttcgacacagtttttaacataagtacacctcttcattatataatttttaactaaatctcaggactagaaatttctttttcattcctcttttcacctcagtattatcctaaaaaatagtatttgataaagaataaatatttaataaaatagaacacaagctcagaaaacaacctagttttttaacagattatctttgcttctgataaattgtcgtttaacctatgtctatttaactatctcttttaactcgtcaggcatatcaggttcataagtcgctaaaaaacagcaattttgaattgaatgactgaaaatacttagtgctagagttgctaaacatcctaaaagaactctattcaactttaaaacttttaccaacacgatacctcctctttaattcattaagtaataccaataagttactgataaaaactccccaaaccatgaataccgttaggtctgtaaaaggtgataaaacacaaagaattagaatattgatagttgttaagagaggttttatgcgactgtgatttcctacatccttaccaacgtatttagtatatgaaggagcaaaccgccatgtcacagcgatgaaagtaatcgacacaataaccaaccccaataaagagaacctaaaattcatccagtttaaaagaacagctgagatagggaaactaaaaatcccaaagagagtacatatcaagctgttttcaaaatgaaatccatagttattatgtctcaaaatgcaaaaagtaacatgagataaaagcgtttccaaaaacaccccgaaaataatagcacttagatatatggcgagcgctttagataaattaacaattagaattgtcaatccataattaattttgagagaatcttctctagagaattcaaaatagtttaccattttttttaaaagcaaatcagataatctctcttcgatactatttcccattggattgctcctctcttacaaaaacaatgataatacagaaattgaatcgacaacgaaactttcaaaagaaacggttttcatttcataagtgttaagataatgttttttgcttctcttttaatttaaatagtaacccttttagataacgtactgatacattacatttttgtccatcaatcatttgaattaattttgttttagtattgactacttcaatattgttaatattaaccacagtagactggtgacaacgataaaatgcactgttgtaagcagaaatgtccttgatatttgcataaaattctaattgccgattaagcaaatgaacactcaatttatgagctacaggtgttgtttcaaaaaataaaatgtcatctattacaagcttgatgtctgtgtaattactgcgtatcaggataaattctcgtttatcaggagaaaacttactaatccgatcaacggtagtatttattacttcgattatctttggtttaagttcctcttcactctttttctgaatgaagtctaaagcttcaactttatgcaaaaaagaaagaaacgccatctcagtatggctagtgatgaaaacaatttttgcatgcggataactttctcttaactgagatgctaagattatcccattcatttcatgatttagttcaatatctagtaaaaataaataatcatgttgttcctgcgttctccactttagaatatcgtttggaagatcagtagaaagttctaatcgagcatctaaatctaccatcatcaaataattctttacaatacgttcaattgattgccgttgatccttattatcctcgcaaataaatatctttagcatttgtattctccttcttaattaacagttaaaatttgacaaaacttattgtcctgaatagatgtttctagggataaatgggcttcgtgtgcaacaatagaatcaaggttagataaacccaaacctctattcgatccttttgttgaataccctgaaaccttcaactggtgaagaggtggtaaattttcagataccgagtttgagataataaaacttacacttcccatatcttttaaaatggcacattcaataaacccttcagatttcgccattcgggttgcttctacagcattatctaaaataatgccaagagagcgaactaaaactaattcatcaactgcaacagaatcgacttcattaaaaacaaaaatttataccttagttctttttgtatccactgaattgagtttagataaaaaaatgctctttaaagaaactacctttagatttcctaactccgatagttctaatgaattatcaaaaattgtttttgatgtttccaaaatattctgtttaaagtatttcgtaagttcttcaagattacctcgctcgatataatttcccattgaaattaacatattcttataatcgtgtttaaatgctcgaaggtcactatactttttttcaatgtcagtcgcatattgtttaagatagtgtaaataattctcaatttccttatttttataatactttcttgcactgaaaacaaaaattgaagcagaaaaaagagataaaagagaatacacgatgacgaagtaactattgatcatttccatttctcgttgatttgtaacatggcgctccatcgtaattacgataaagtgtatgagaaacgttcctgttgcaattaatgaaatcatcggcatgtacaaatcattctcaaacaaagaagtcgtatttacaagctttctaaaagcaaaagaaagtaataaagctacaataaccgtataaaaaaatcgggtatattctcctacatttacattgaacataggattgataaataaagttagatagtcagaaaatataacaatgagaattgcagaactacttgaaatcaaagatttatgtaccgttgatttggcaacaaaaaagttcattgcaattaaatagacccacaaaagaccagttgcaaataattcgaactgtaagtacacaagtgaaaaaattacagcactaatcacacttaaaacaataaattttctatttttttctcgaagtattctaaaacttaaactacacatcaaaaaatattggacagataataagataatagttatcaacacgatccaccttccctaacataaaatatgcacccatttattactaccactttaaacagtcaaaaaataataatgttatttaactctattgcatttcttttcttcactttttctataaatattcgttttcattacaaataatgcagtatatttaattatattgcgacataaattaaatacactgtagttttttttagggattatattgttatctaatagacttaccatttggtcctgtataagagtaccaaccgataccttcatacttccatccgtatttcgtgatattgtcacgttcagcggcattcagcgtgtagaaatgttcgccgttgtaacgattgtataaacgataaactggatcgtcacttgttggagcttgccaaccaataccttcgtaattccaaccaattcttcttagattatctcgttctccagtatcttgagtgtagaagtgttctccgctatttggattatacatgcgatacataggtattgttcttactgcactacgagcaaaccgactcatttgatcttgttgtaactcttcttttggtgcttgagtcgcttcagcttcagactgtccttctttcactggcgcttctaattttacttcttctccatttacaattgctgtttgctcttcgctagaactattgctagttactgtttgttgcgtagtgtcataagttgcattattccctgcttcttccgcgagggcattttgtgtaggaatcgtccaagttgataaaatagttgcacaaatcaacactgtccatttatttttcatttgatttaatcctccgtcttttcattaaaaaattatatgatcagaaccttaaaaaataaaaccgcattatcgcttgctttttttagtatatcttctataactgactaaaaaggcatgcataacatgccatcagactgtagacaaaccttgacacgaaccatttccagtaagaagaattgatcttcgatgaacattcgatcagctaccgaggcatcacgtccgattacgccagttcgagcgctttcagtaaaaagagaaccataagagatcagtttacgaaaagccggatggttattgatcgaaaagcgataagcaccatgatccgttgttcctgtcaaatattcccgcatcaatgcatgactggtcacatcttgcgcgtatcttttttgcagaccttgcgagaaattataggtactagtagtagaatcaattcccgaagtggcaaaagcggccaattcttgttgcagggcaggattattggaagataattcatacaagctcgcattcgttttgagtaagtctgcagtggcgacgcctaaggaggaacctaattggtaaaaactataaccaagtcctgctcctaggatagcagaaactactgcagcagaagcagggagggaaaccaatgcagaacttaatgtagcaccaacagcagaaaaaggagagagaaaagaggagaaactgacgccaccggttaaaggaaccaatgctgcgttgtgcggatctggttcttgggtagtgacagggatacgagagatagacgggagttcaggaacaacttcggtcgtcgcatgttgttctgctttaatcgtatacgtttcttgggcgtgcgtttggacaggcgtggcagcaaatggcagaagtgtcaacacaacaaaaaacaaatgagtgagttttttcatgttttctcctttcaagaacacgtgcggctgatcgacaagggggtcttttgcacctccgttcattcatattcgcttacacatttaattattcttgaaaaaacaaaagaatacaaggcgtaatagaaaaatcaatttaaaaaaatgtttttatattattggtgtttccttcgtgtattctcatggaagatagtagttatgtcaaataatcgtttgttttggacgcataatcgttcgcataactgataaagaaaaagaagggaggaatttatttgttttggaattaaagttatttaatgtttgcttttttattatgtaaaaataactttatttataaaaaagaggttgtgactgaagtggtcagcttcaagaaataagaaggaattgacgaaaattgcttctcaaatttttgtaaaatatcggcttatttttcgaagaagctacttctggaacaccgtttattcggaaaaaaaggtctgtgacaagacttttgtcacagaccttttgctttttattgatcctgcgattactcgtcgcaatttttgtgagagctttttcgcaaactctttcttaaaaagtgttcaagagacaatctcttttatcaatccgctacttcttctttcttagcgaaactccaaatcagtccgataacaaaaccgataactgctggtacgatccaccccatccccaatttgaaaaacggcaagtagctttccgcaacatgtaaaagattttgaacgataggggtttgcttgatagattctgggcaggcattcaacccatcaaaaatcgaagcaatcaacgtaaaataggtagtcatccgataaacagctgtacgctgcttaaacaaaggaccaaccaacactaacagaatcaatgtcattgctaatggatagatgaacatcaaaacaggcaatgaaaattgaatgatattcgtcaagccaacatttgccgctaaacagggaaggatactggcaagtgcaacaaaaaaggcgtaatttctttgcgggaacaaatctgtgaatgtttctgcaaaagctgtaatcaaaccaataccagtcttcaaacaagctaatataacgatgaatgctaataagatactaccataagtgcctaaataatgatcagcaatctgagccagcgtgattccgccattttcacttagagcaaagctacctaagctcatagcacctaaataagcgagcaaagtataaatgattcccatcaatataatgctgatcgcaccagatttgatcgtgtctttagcaatttcagcaggttttgttacacccatgttttggatcgtcgtaacgatgatgattccaaatgctaaagcagcaagcgcatctaatgtgttatatccttgagtaaatcctgtgaaaaaagcatggtcttggtaatttggctgaataggcgcttgattgacagagcctagtggattcaaaaaagcaaggagaagcaatgcccctaataaagccaaaaatgcaggattcaggaattttccaacataatctaatatctttgtcggttttcttgaaaaccaccaagccagcacaaaaaatacaatactgaaaattgctagatatagcgtctgtctgctaggatcgataaatggtgctaaaccaatctcgaaagatgtggttgcaaggcgaggtaaagcaaaaaacggtccgataactaagtaaagcaagatggtaaaaaccatcgcatatgtttgatttatccgttttgctaattcatatacacctgagcttttcgatacaccaatggcaatcactcctaagaagggaagaccgataccggtaaccaagaaacctagattcgcccaaaaggtagcagcacctgcttcttgacccaaatgaacgggaaagataagatttccagcaccaaaaaatagaccgaaaagcatggagcctataaaaagatagtctttaaatgataatttttttgtcatacataactcctttacggtttttttaaaagtaacaaaatttcgaaaaatatgcaacaattttcagaaaatttcctatataaaacgatggttatttaataacacaagtgataaaataaaagcgctgaatcatctgaggaggaaacatcgtgacaaagtcgagattagaagcatttactgatggagtagtggccatcgttttgacagttcttgtattagacatcaagattcctgatccatctggtatccattctttatgggccatccgaaatacattattagcttatgcaatcagttttatatttgttgcggtaatctgggtgaaccatcatcgtatattccagatggcagaacgcatcaattaccgagtggtctggtcgaatatcttttggctcttctggctgactttatgtccttccgttactagttgggtcgggcgtaaccctgaagctttttggcctgagatggcttatgtcttagtatacacgatgtggagtttttcttttggtatattgatgaggcaaatcatgaaagcaaataaaccagattcccatgtcgtgagagttttgtcaaaggaccatcgaagttttatctccatgtttattaacttatgtttgattgccggtatcttttttgtaccgatgattgggttattcggacgttttttcgtatctggtatttggattttttcctataaaaaagcagatgcctattatcagcggttgtttccggggaaataaaaagagctgtgacaaaaatattgtcacagccctttttccgaataaacggtgttctcctgccacctcctcggtcacaagtcacaatattcaacaaacatgagaagctgtttttttgaaattgatccttgtgactcatagtgaaacggcaggctcacaacctctttcttacttcttacgttcatatttcatatgatagatcagtaagagaagcaagaaccacacaggtgtcagtaataaagcgattctcgtatcttttcctaggaacaagacgacacacacaaaggccatataaagaaagaccaaataattactcaatgggtacagcggcattttaaatgaatgagcttttttgccgatgatacttttacgatatttcatatgcgtgtagacaagcatactccaaataaacaagaaacaagtagtggcaatactgcttacgagtgtgaatacttcactaggcatcacgtaattcaagataaccgaaatgaaaatgacgatcgtagaaaatgtcaaagcattccctggaacatgatgtgttgttaactttttgaattttttaggagcacttccttcttgtgctaaagaacgaagcatacgtcctgtactgtatatggcgctgttgcaggcagaagctgctgcacttaatacgactagattgatcaaggatgcagcaatcgtgatcccaatttccgaaaatacctctacaaatggactattatctggattcaagctattccatggatagatggccataatgacaaaaagagagcctaagtaaaataagatgatccggataggaatattattgatagcttccggcaatactttttcaggattttctgtttccccagcgactaatccaactaattcgatcccagcaaaagcaaaggtcaccatttggaaagccaagatgaatcctttagcaccagtcggaaagaatccgccatgagaccatagattcgtgatgctggctgtgccaatatctgtcgtatagtgggtgaggatcatataagcacctacgaggataaaggcaatgatcgctacaaccttgatcaaggcaaaccaaaactctaactcaccaaacaatgatacagccaccatattcaagcaaagaagaagacctaatgcaatcagttcaggaagccactgaggaacaccaggtgcccagtagcgtacatacatcccaatggctgttaaatctgccattgcaatcgatacccagcagaaccaatacgtccaaccagtgatgaaagccgcttttttgccaagatattctgcaacaaaatccagaaaagaatggttattagtgtttgataacagaagttcgcctaacgcacgcataatgaaaaaacagatacatccagtgatgagataggcgagcaatatcgaagggccagctagctggatagactttccggagcctaaaaacagccccgttccaatcgctccgccaatagaaatcagttggacatgtctatttttcagtccacgctgcagttcttgctcttcattcatttttaaatcatcctaactaaaaaagtttatattacttccatattaagagagttttctgaaaaacacaactaagattccaaaattttcagaaatttactatttatgagtaggcgcaaaaaaagaactgcggtaaacgccgcagctctctgtcccaatcagcgattgatcctaagcatttaaaatacgtgaaaggaattcttttgtacgttcttctttcggatggacaaagatatcttctggtgtaccttcttctgcaatcacacctttatccataaaaatgacacggtcagatacatcttttgcaaattccatctcatgcgtcacgataagcatcgtcaagccagtatgtgctaagtctttgatcgtattaagcacttcaccaaccatttcagggtctaacgccgaagtaggttcatcgaataacaatacatctggattcatcgataatgcccgagcaattgcgacacgctgcttctgcccgccagacaattgtgctggtttagcttcgacataacgatccataccaactttttccagattttcgattgctacttttttggcagtttctttatctcgtttcaggacagttgtttgtccagacatacagttttccaagacgttcatattattgaagagattgaaggattggaaaaccatacctagatttgttcgatatttaggtaaattatatttaggagctaatacattttctccattataaatgatctcgccgcctgttggtttttctagcaaattgatacagcgcaagaaagtagatttaccagaaccagaagaaccgatgatcgtcacaacttcacctttgttgactgtcacgctgatatctttcaatacttcattttcaccgaagctttttcttagatggttgatttcaataattttttcactcatgattcttcctccttattcctgcaaatttgaattgtcgatttcttcaagctttgtgtaagcagaaggtccatcgattttcttttctaccgcacgcaggattctggtgatcgtaaaggtcatgactaagtagatgatcccgacgatcgtaaatgtttggaagaattggaaattcgcaccggaagcagagttcccctggaagaacaagtcagctacgccgattacacttaaaacggctgtatctttgatattgataacaaattcattccccgttgccggcaaaatattccgtaaaacttgtggaataacaacttttctcatcgtttggccatgggtcataccaatggcttgcgcagcttcgaactgtccttcatctactgcaaaaattcccccacggacgatttctgtcatgtaagctccagtattgagagagacgataaacaaagcggcaatcgttcgattcaacgaaataccaaaagcgagtgccaggccgtagaagatgaccattgcttgtaccatcatcggtgttccgcggaatatttcgacatagatagatagaagtgcatttccgattttttggaagaagcgagtcagtgcatttcctgattcaggtaccgaacggaagacaccaatcagtaatccaagtgtggtaccgacaactgtcccgatcaatgcgatgaacaaggtaagtccagcacctcgtaagaacatattgccgtattgtttccaaatcgtagtgaagtcagaaatgatgccgggtttttcttcactatcagttgcagcaggctgatctttgactgcttggtccatgatttttgttcgttcatcgttagagatgccagaaagaatctggtttactttttggatatctgggtcgcctttacgcataccaacagaaatctgaacatcttccgggtttgtctggaagccatctgcaccactgaattcgagcatttccaagtctttgttcacactagttgccgttacaccttccggacgttcgctgacataaccatcgatcattccagaagctaacgctgttctcatggctgagaaattatccattgcttgttgtttctgcacatccggtatctgatcgatcacagtataatggaaggtatttaactgagcagtaatctttgctccagaaagatctgctaaactttttgcttttgcgtatttgccatctttctggactactactactaattgtgattcataatatggatcggtaaaatcaatttcttttcgtcgttcagcagtagggctcattccggcgatgatcgcatcgatcttgcctgattgaagggcaggagccagaccatcccattttgtttggacgatgactaattttttccctaaaccatctgctacttttttagcgatttgaacatcataaccgccggcgtaactattttggccttggattggcaaggcgttattctcgtctgtttgttgagaccagttgaagggtgcatacccagcctccatacctacgcgaaactcatcgctcggtgttttttcatctgcatttgccagagatcccacactgaatagtgagaagacaaaagcaaatagtacggcaactgaaaccatattttttttcatttttttctccctttctgattatatgatacacgagcggtctagatgaaatgcggtaaagctttatctgaaaaaataaaaagcgaccgatttatagatataaaaaggccgctaaaattccataaggtgataaacctctcacaaaacatagcgcaacttagcatcactgctaagacagtccgcaagctcttaacttgcgtcccaacatacacttcaagcaaaaaagtgtacatttcggcgatcctccctattcctgcttctccatgtttgcttcactccacagggttaatgattctcgcgacctctacctcattgattgaggcatctcgtattcagttatttatacaaaaaaagtttacgatactcgagaggctttgtcaatctataactgctgttttttgaaaaatactgataaatatagaaatctttacttttaccgaaaaaacaatcaaaatgtgaatcatctatccattgcaaacgatagtataattatacacaaaaatgtatgtaacacaataaaaaaagaactgaaacagaaaatttcctgcatccagttccacctcgattatttaagcagccgctttctttggctcacgtcctaggatcgcttgcaaaagaacaacgacaccgtaaatggctaatattagataaatcaaacttgagtattgggtgattccccagccccatgttcgataaacggctaatgtaatggctaaaacaattgcggcaatcacgttgaataaagcaaaagcccaaagatttccgttttctttgcgtacaaggtaaaaaacagagaaataaacacttaacgctaaccaggcgatgcaagccagaataacgccccagtaaataaagaatggtaacatatcgattcacctcacttttatacagcagtattgtaacacgttttcattcttttgtcagtgaggattgtgataaattgttcaaatgtccctcacacttttttattcctatttttcacacttttcaacaataaatttgtttgagtatgggctataatggaaagtgaggtgacaaaacatgaaacaaggaacagtagacgaagcagcaaaagagatattgactcatcagaaaatcacgtttttgaccggtgctggggtatccacaccttctggagtgccagattatcgatcactgacaggaatctaccacggaatggaacagccggaatacttgctgagtcatcaagcaatggtgaatgaaccggataaattctatcaatttgtcaaaaagatctatcatcctgaagcaaaaccaaatattattcatttagaaatggcacatctagcgaaagaaaaaaatatctgggtcgtttcgcaaaatatcgacggattgcacgcaaaagctaagagcccgcaactcgtcaattttcatggaagtttgtatcaatgtcattgtcgaaaatgtaaacaaacagtagactggaaagaatatcttcacagcgacaaacatcaagcatgcggcggacaaatacgcccaaacattgtgttatatggtgaaggatttcaagatgaagtcattgagcaggcggcttacgccgtcagccaagcagagctggtcgtcattgttggaacgagttttcaagttcatccattttgtgatctggtacaatttcgccaaccgtcagccaaaattttagtaatcaatcaaacgcctgtttatttagcggaaccttatacgtttattcaggaagacggagcggttgttttcaaaaaaatacaagaattaggagtagactatgactgaattcaaaacagaaaaagaaaagatgattgcaggcgagctttattttgccaatgaccctgagttggtttccgaccgtatgtttgcaagaagtcaaagccaaatcatcaaccaagccgaatcagcggaattgcgatcccaattgttgaaagaaacatttggtcgtacagggaaaaaaatctatatggagccagttatcaattttgattacggatataatatatttgtcggtgagaatttttatgcaaatttcaactgtacatttttagatgtcagcacgatcgaaatcggtgataactgcatgtttgctcccaatgtccagctgtatacggcaacacatccattacatccagtgaaacgtaacagtggtttggagtacgcaaaacccataaaaatcggtgataatgtttggttaggcggaggcgtgatcgtcacgccgggtgtcacgctaggaaacaatgtagtggtcggcgcaggttcggttgtgaccaaatctttccccgacaatgtagtgattgcaggaaatcctgctcgtatcatcaagacagtagaggaagaaccgttagaagagtctcttgaaacattacgtcaaaagattgatacgattgatcgagaattagttgctttattagaaaaaagaatggatacagtaactaaaataggacaagtaaaaaaagaaggaaaccaagcagtttatgatgaaaaaagagagcagcaagtattggataaagttgctaaactgctgaaaaataagggatacaaggaaacaataacaaacacatatgttgatttgatgaaacactcgcgcgaataccaaaacaaaatgaaggaggaataagtgtgatcgaaggagaggcacgacgaaaacaaatcatgcaaaccttggcaaatacagaaaaaccagtgagtgctagcaagtttgcgaaaacttttggagtcagccgtcagattattgtcggtgatattgctttactacgagcggcaggtaaaagtatcgtggcaacagcaagaggttatatccttgaaacagaagaaaccaatactggacatatcagtaaaatcgcggtccagcacggaaaagatcaaacagacgaagagttgagactcatcgttgaaaatggcggcgaaatcattgatgtaatcgtagaacatccgctttacggtgaattaacaggtacgttgcacattaaaacgccacaagacatcgattcatttatgagacgttatcaaaagagcaatgcttctttattatccgaactcacaggaggaatccatctgcatacgatccgatacccagaaaagcatatgctgaaaacaatcaagcaaaaactagctgaagcaggtatcttgtacgaaggatgactagctccataaaaaaacagtaccgaagaactggcgaaatttaaacgccagtttttttattttcaagaaaaaggtgttcgctttgtctgcacaaagtattgtacgctttttttgtaacataactagcaagataatgggggcggatatgagatggatccaaataagcaagatcaaggagcgttggaagcacaaaaaatcaagctgtattataacgaggttggtgaggaaaaattagatcaatacatagagacgctcgcgcacagcctaattaaattcatccgaaactttgaggactctgaatacgtatctgaaagattaaaaaaattttctaaaaatttttctgagaatatttacacttacaatcgaaagtggccattatggaatgacctttacaaagcaactcgctcttctgaagcactccatctagaaacaatttttagagatgtaggatttaacaaaccttccttcggttcgcaagacttatcagtaatatataagcaagcagaagagcttttaaatgaaaaaaaagaagcactgatagtagagatactaaagggaaatccaaacgttgaactgtatatctcttatgatcctaaggctgaacaaggaaagctattaaataagaagctgaaaaatggcgagtataaaacaaaagaagaacggatagaagctttagcagatgggtatgaacatcgagatgaaaaagcgaaagatattgagaaggatatcattcaaggagtagatgaaacggaaataggagctatgatacggctgatatatcctcttgaaaaaacagtgagagatagagtgaatttttataaaaacgaccacataattatagcaccatgggctaaaaacaaggaacttactgatctatggagcggtgtgatttcaccaaatgaagaaaaattcgtgggattaaaagaaagcctgatccataagagtgaacaagaaaaaattttattgacttatggaaacggaaaagaattcaacgctacttttcatgatttagaagagaagaattacaaatgggaaagctgtgagaagtatatagaaataattgcagaaatgttagaggagaaaaataggatacaaggaaagctaaaccaagatgtttttgaaaatttcgaccagtatatcccttctacaaaaagacaaggacaactatggggagaatttcaacgagtcagtcgtaagtttgaagaattccatttagagaatatagtaggatgggatgagttcatgaaaaaagcgtatcctgaacaaggatttaagcattccttgaatcaatggtttgggaaaatgtcagtagaactagcaaaagaaaacccgaaaatagaactcggtgttttttatgatccagcttgggaaagcgtaaaaaatttagaattttatacgccaatttcaaaaacaaaatggaaaaagcgtgtagaatcgacagagaatgctattgctcaaaaattgcatctggctgaaacttcagatacgttacaccatttatatcataatgagagctcattaggtggtcggatttattattatgacagaaaaaatgtgttgactaatgtagctccttgggccaagtcaaaagagcttggtacagtttggtcaagaagtagtagagaagagactttgacatttctacttccacagatgaatggacaaagtgatttatctgcttcaattaaaccgcaagagcaccggaaaatcagtttatttgtgtcagaaactggaaaatatgcagatgaggataattttcgacagaaaaaccctacaaaagcagagcatacgatagagtctattgatgactatatttctgctacgataggtgcaatcttcaaaaaccaaaggaaattttatgatccagatttcagacaacatttttatgagaattttacaaaatatatcccatcagataaaaaacattgggagctatgggacgatttccaaaaagtcagtagaagctttgaggaattcaaattagaaaacatatataaaaaattagatatcaattttgaaataccaatgacgtggtctaaggaaaccctcatatcctacttgtataagattaaaggggagatagcggtagaaatagtaaaaagaaatcccatgactgaattgacacttttttatgatccgatacaaatttatgcagcatacgatgttgtcggttggactaattctgattattctgattattatgatagtgatactagcaattctagtgatagtagcaggcgtagcatagatatcgatcaatatgctgataagatagaacggcgtggcactgatagagctggtatattagatattgaagaagaatttgcaaaaggaacggaaagtgagaatgaaaaatgtcttggtaggatactcagatatgcatttcacaataaatcagagttagaaggaagaattgttctgtttgatcgtcataaacaaattgccgatagattaccatgggaaaaagaagagattgcagaagcgtggagaaatgcatgcaaaagtgtcgttcttacacctagcattgataatgaaaataaacttcatgaaaagaaggaaagcgaaacaagtttacaccaatcaatagacactcaggtaaaacatcgaaagagtccagaacagttgataaaaaaacagccacagcagttatcgagtcttttaaaaacagtgggtataaggaatgaacagccatcaacaagcaccgatcaactaataagtgcttccacatcccaagttggacaacaaagaatggcacaaatcagacagcaagaagagagagaaacttcggctaataaaaagccatgtgtacgagaaataataagattctatgaacgttaaaaagagatagacttgaaaaaaatgctaaaaacaatcaagtaaaaactagctgaagcagttatcttgtacgaagaatgacaagcaccataaaaaaacaccgaagaactggcgaaatttaaacgccagtttttttgttttcaagaaaaaggtgttcgctttgtctgtatgaaagtaatgtatacttttttataacaaaataatgggggcggatatgaaatgaatcctgaaaaacaagaagaacaaagaattggcttatgtattgataaggaatctgggcgtaagagatttgaaggagtatactgtactgattatctaactgctataacaaatactatgttcgaccatgcgaaacagctttctgataagaagttccagcagcacttttttcaaaacttcacggagtatctttcccctgagatcaaaggatgggttttatgggacgatttccagaaggtcagcaggaagtttgaagaactaaaactagagaatatctataataatctaaatctaactgttgatggtacatcacagctttctgaggaggaaagagtcgaaagagtcgacgattatttgtacgacttgagaggacagatagccgtagaagtagcaaaaacgaatccaagaatcgatttatacctttactatgatcctgaacatacacatgcatttgatgtgcggacttcagattctatttttgttaatcacttaatgactatagtagcagaatggagcgatggagtagcatttgaagaaagacaagttgctaatggaggtgaagagagttatcccagtcacacgctccgttatgtttatcataacaaagaagaactggcagggagggtgtatttatatggagaagggtatgataacagtattgttatgtacgatttaaaaggtaagctgactaatataatgccttgggaaagagataaggatcttgctgtgacatggaaagaagaatgtaggattacgaatcttacgttggatccagcctatgcagccaatcatttacagcaaagcagtacagtaagacaaaacagtggagaagaaaaagatataaaagaatttgctgataaaaatccagtgtttgaaaatgaacttagagaaggagaggaaaagaatattccttccactcctgacgcttctgcttctgatcttaagattgtaaacgaacaagccaaaaatttagagagtactaccccaagcagtacagtaaggcaaaacagtggagaagaaaaagacataaaagaatttgccgataagaatccagtgtttgaaaaagaacttagagaaggagagggaaaaaatattcctttcatttcttactcttatagttttggtcttaagtctctagctgaacaagaacattacaaaagaattgccagaattgccccaagcagtacagtaaggcaaagtgataatcaaaggatgtatatgatttatggagaagaaaaagatataaaaaaatttctcgataagcacccgatgtttgaaaaagaacttagagaaggagagaaaaaaaatattcctttcactccttacgcctatgcttctgaatttaagtctaaaaacaaaaagcttattttgtggaacgaaatcaattcaattataaattctcgtagggaatttcaaccagaaaaccttacaataagaaaaaatatagatgcctgttttgaaaagataatgttagaagtcgcaaaagaacgatctgatataacgatcgtgatgtgtaacgattacagcattgataaagatgtgagaattgtcaatggaagccggatagactcacgtgctgcagctcttcgttatatttatcatacgccagagcttagggagaaagtagttttctacaatggagcacaaaacagaatggcaccatgggaggcaaatcccgaattatggaaagcatgtgtcaaagactttggcatggatctaagaccaaatgaacagttgactcagccaaaaagtacggcaaaacaagacaatagtacgaggacagagacgctagtagaaataaatcctttggaaaatagagaggaatcaaagcaaaagacagatcaaacgattcagccaaaaaatacacatcaagacaagccgtcacaactaaaggatttagcttctcgacataaccatcaatccttatcagatatcatgcaagcagctgatatacagcataaagaaaataatcaatcaaacaactggaaacaagatagtccaacaaagcaaaatgtaagtacaaatacacaaaaagaaatatcgttgataaaagcagaatcttgggcagacagcaatgaatcgaagcgagtgggacagttaataaagacgtgggaaactccctcccaaacgacgagtgcaaccacattagattcaagaaaacaggggttagggcaacttctagaagacgtaacgacacgtaaaagttatccttctggagagaaaaaacaggtaattcccaataaagctttatctctatccaagacacagccacatcttgaattttgatttcaggaaatttcattttaaatttagtagcgaaacataaaaaaggggctgtgacaaacgacgtgtcacagcccctttattccgaatatgttcaaaagcttgcatctgaggtaataagcctaactaaacgaaaaataggaagagctatttttgtttggctgttcttattacttgatgcaggacagctttttcacaacctctttataaagctttcttatgccattagaatcgaaggatcaatccaaatctctattcgatcaccaatacgccttcttttaatgcaaatggattttgatcgttgatgtggtcatagaacatcacaccgttgatatggtcgatttcatgttgaacgacgatcgattcataattcttcaaacgaatcttgtgtttttcaccattcatatcataataagacacagtgattttggcgtggcgaacgacatatcctggtacttctcggtcaacagataaacagccttcgccttctcctaaacaagcatcttgaacagaatggctcaaaattttaggattatacataacagtacttagagaaggttcatctacctctgggtctgcacttggtacgtgaacagcaatgattcttttagaaatatctaattgaggcgcagctaagccaacaccgcctcgtaagtgcaattcttcagctttgattggatcttggctgttttttaagaactcaagcatctcttttcctaaagagagatcttcttcgcttaatggaagagaaacttcttctgcaacttcgcgtaaggtcggatttccttcacgaataatatcatccattgtaatcatggaatatgtacccctttcttagaagactatattcaagtctattttcgcattatagtttaccacaaaaatggaaaagtagtagtaagattgtttgaaaactactttttcttaatgattaaccacttgatttccagcccggtttcaggtaaagtatagctgtgtgctctaggcgcacggcctgccacttggttaagcgaatcaccaacgttttactcagtcgcaggggaataatcgaaagaggtgaaagaaatggcaatttcaaaagaacgcaagaatgaaatcatcaacgaatatgctcgccatgaaggggatactggttctccagaagtacaaatcgctgtattaactgaagaaatcaaccacttgaatgaacatgcacgcgtgcacaaaaaagaccatcattcataccgcggcctaatgaaaaaagttggtcaccgtcgtaacttgttagcttacttacgtaaaactgacgttcaacgttaccgcgaattgatcaaacgtttaggcttgcgtcgttaattttagtcaaaaagagtgggattcacatgaatctcactttttttactcgtatatcaattaagcaaaattccgtgatcaagctagatggactcctactaaccaaatgaaagctgctcaaaaaacggctttcggcagttttcatttgtttagtagcgtcttgctttcacgagaaggaaaaggagaagttatgtcagaaaaacaagtattcaaaacgacatggggcggccgtcccttacaaatcgaagtcggtcagctagcaaaacaagcaaacggagccgttttagtccgttatggagatacagtggtcttaagtgcagctgtggcctctaaagaagcaaaagatacagactttttcccattaacgatcaattatgaagaaaaaatgtatgcagcagggaaaatccctggaggtttcatcaaacgagagggtcgtccaagtacagaagcaacattgactgcccgtttgatcgaccgtccgatccgcccgatgtttgcggaaggcttccgtaatgaagtccaagtaacgaacatcgtgatgagtgtagaaactgactgttcaccagctatggcagcgatgttaggttcttctttagcactatcaatctcagatatcccatttgatggtccaatcgcgggtgtagaagttggtcgtgtaaatggtgagtatgtcttgaatccaacggtagagcaagcagaacaaacagatatcgaattaactgttgctggtacgaaacaagcgatcaacatggttgaaagtggcgcgaaagaagtttcagaagaagacatgcttggtgcattgctgtttggttttgacgctatcaaagaattagttgctttccaagaagaaatcgttcaagcagtaggaaaagaaaaaatggaagtcactttactgcaagttgatgaagtattgaaaaaagaaatttttgatgcttcttacgctacaatgaaagcagcagtaatgaccgaagaaaaacttgctcgcgaagagaacattgagcaagtgaaactcgatattcgtgaagcttacgctgagaaatttgcaggtcacgaagatgaagatcacttattgaaagaagtcaaacaaatcacggaagatttagaaaaagatgtcgtacgtgaattgattaccatcgataaaatccgtcctgacgggcgtaaattggatgaaatccgtccattgtcatcagaagtcagcttattgccacgtgtacatggatcaggattgttcacacgaggacaaacacaagctttatctgcttgtacactcgcacctttaggagagcaccaaatcattgacggtttaggggttgaagtcagcaaacgattcatccaccactacaatttccctcagttttctgttggttctacaggacgtgcaggatctccaggacgtcgggaaatcggacatggcgcattaggagaacgagcattggcacaagtaatcccttcagaagaagaatttccttatacgatccgcttggtagcagaagtattggaatcaaatggttcttcttcccaagcaagtatctgtgctggcacgttagcattgatggacgcaggggtaccaatcaaagcacctgttgccggtattgcgatgggacttgtttctgatggtgagaactatacgatcttaacagatatccaagggctggaagatcatcttggcgatatggactttaaggttgccggtacaaaagatggtatcactgctttgcagatggatatcaagatccaaggaatcacagaacaaatcctaactgaagcattgactcaagcaaaacaagcacgtatggaaatcttagaagaattgacttcaacgattgctgctccacgtgaagaattaagccaatatgcaccaaaaatcgaaatgatccagatcgaacctgctaaaatcaaagatgtcatcggtaaaggcggagacacgatcaatggaatcatcgatgaaacgggtgtaaaaatcgatatcgatcaagatggaaaagtaagtattgcttctgctgatgcagaaatgatcaaaaaagccatcaagatcatcgaagatctgacaaaagaagtcaaagtcggtgaagtttatctagggaaagttgtccgtatcgaaaaattcggtgcattcatcaacttgatcaaaggaaaagatggacttgtccatatttctcaattggcaaacgatcgtgtcaataaagtcgaagatgttgttaaactaggtgatgagatccttgtgaaagtaacggaaatcgataaacaaggacgcgtaaatctgtcaagaaaagcaatgttgaatgaagatggttcaacgaaaaacgaagcaaaataattttaattcttatgaatattgtgttttgtgatcaagaagttgacaggagaacaacaattattcgaaaaaaagggaggtgacgatttttgtcatctctctttttttactgaagtttcttggtgcatatttttggagtccttctaaataaagcgtaaaataaaagtgagataaaaggacgaaggaggggaaggctatgctgaactttttatggtcgttgtttatcggcggtgtgttaggtttgatagctggtgccattttgggaaaggaggtcccaggtggtgtatctggaaatatcattatcggctttttaggcagctggcttggcgaatttttactaggaccgctaggaccggaacttggcggtttttatttgatcccagcactattgggtgcaattttttgccttgcgctttattcatttgtggcaagacgtatcagggaacgaccaaagaaagaataattttattcaaataagttgacacttcagtgtgttacttggataattagaagcaatttaggaaagcgggtgtcatggataagaatatcgtctatcattcaagcttacctaaaggatatccatataacaagaaatgaggggaaaacgtggcaacaacgcacaataccaaaaaaatatcaatggctggcctgcttgtagcgatgggagtcgtctacggtgacatcgggacaagtccgctttacgtgatgaaatcgattgttgaagataatggcggattgacaggaattaatcctgattttgttatcggatcagtctcattgattttttggacattgactctactgacaacgatcaaatatgtcgtgattgcactaaatgcagataaccatggggaaggcggaattttctcactctacacacttgtccgaaaaggtgggaaatatttgattattcctgcaatgatcggaggagctgccttactagcagatggggtattgacccctgctgtgacggtaacgactgcgattgaaggattgcggggaattccgcagttttttgaccggttcggtaataaccagaacgtgatcgtcattatcactttagttattatttttgtcttattcatggtccaacgctttggtacagatattgtcggaaaagcattcggaccaatcatgttcgcttggtttacttttttaggagtaatggggttgctgaattttagccaggattggacagttatccgtgcattgaacccttattacgcaatccagctgctttttagtgcagataacaaattaggcttgttcattcttggaaatattttcttggctacgacaggtgcagaggcgctttattccgatcttggacatgtcggcaaacgaaatattcgtttgagctggccttacgtcaaaatttgtttggtcatcaattattttgggcaggctgcatggttattgaatgtttatcaaaaccctgaagcacagcaaatcaagaacttgaatccattcttccaaatgatgcctcaaagttggatcgtgattggcgttgcttttgcaacagttgctgcggtgattgcttcgcaagcattgattacaggctcgtttacgctggtttcggaagccatcaagttgaaactgctgcctcgattaaagatcatgtatcctgggaacagtatcgggcaaatgtatatcccagcagtcaatctgattctatggatcgcctgttctctagtagtcgtcacattccgaacttcccatcatatggaagctgcttatggtctgtcgatcacggtgaccatgttgatgacgacggcattgctttacttttatcttatccaaaatgggcattctcgttggtttgcatatttagttacctttttctttggtgcaatagaagtcgttttctttatctcaagtgtcgtcaaattcttccgtggcggttttgtagccgttctgattggtttgatcatcttagtcgtgatgttcatttgggaacaagggaacattatccgcgaatcgtcaacagaggatgtgtctttgagggattatatcccacagcttaaagaattacgtgatgatgcttctttaccaatctatcagacgaatgttgtcttcctagttcctgatatggctgaagataaagtgggacgacagttcatctattcgattttagataagcgacctaaaagagcaagagtctattggtttgttcatgtggaagtgacggatgagccatatacgaaagaatatcaagtagatatgatgggcaccgactttattgtccaagtgaatctgttcttaggtttcagggtccaacaggaaattaacgtatatgttcgccaagtcatccatgatttgatgaaacaaggtcgtttgccaaaacagccacaaagatactctttgacaccaggacgggaagttggcgatttccaatttgttctgattgatgaagtagtctcaaatgtgacaactctaggaaaatggcaacgtcaaatcatgcaggcaaaactggcaatcaaaaaaatcgctacctcgccagaaacatggtttgggctagagtacagcgaagtaaaacatgaaactgttccgcttatcattggaaatactcggaaaacatggttgaaagagcggttgtgaaagtagcgctttgatctaaattcagcttttgaataccgtttttatcagagatcatgaaaaagctgtttagcaacaagtaacgcaatgcttttaataggaaggagatgtggcatttttcagccacatctctttttttactcctaatataaatacgcattattttcaatttttttgtagaaaaagggtacaatagaaaaagagaaaggcgggagaatatggttatcaatttcattattttatttttgatgatcgcaattacttcattttttgtagcaagtgaatttgctttagtgaaaatcagacgatcaaaattggaacaattagaaaaggaaaacgtgaagaacgccaagctagctcttcatgttacacaccatttagataattatttatcagctagtcaattaggaattacgctaaccgggttgatcatcgggtgggtcggtgaaggctctgtcgcggctctactggaaccagtgatcggtaaactacctttcagttcggctatcagcagtacaatctctgtggcgctaggatttattttagtgacgtatatcgatgtggttattggcgaactgcttcctaagagctatagtatcgtcaatacggagaaggtcgtcttgttcgtagtcaaaccgcttcattatttttataaagtaatgtttccttttatttgggtattgaatcattcagcagcgggtctaggaaagcttttaggtgtgcgcctcgtatctgaaggagaagaaaccttgtctcaagaagagctgacactagtcgcattgaattcttatgaaaaaggtgagttaaccaaagaagaatatcattatttggaaaacgtgtttgaatttgatgataccttggcaaaagatatacaagtagatcgtacgtctatgcaagtattcgaagcttcagaaacagtaaaagaagcgataaaagcttcgattgagcaaggacatactcgctatccggtgattttagaatccaaagacaatgttctaggttatgttaccttaccagatttgatcaagcaatcttataaagatgaccaactgacagtagaacatttgattgaagagccaatcgtaacaactgaaacaatccctataaaaaaattattgacgatcatgcgaaaaaaaggaaaacatattgctatcttaaaagatgaatatggagggacaagcggcttagtaacgattgaagatattttagaagaaatcgtcggggaaatccgggatgagacagatttggacgaagcgttgatagcggaacagtcagatggctcttatatcatctccggcaaactaacattagatgattttcaacgttattttcatgtagagattccagagtttgaagaaacgaattttactacacttgcgggatttgcttctagccgatataaagaaataaaagcaggaacgatcattgagattgcctcattccgtttcacggtattagaataccagcatgcacatatcgattatttcaaagtagagaccatggaaagagatgcagaataaaagaaaaaatgctgtgacaaaaaatgtcacagcattttgttatctaaaaaaactgttttcggtaaacgaagaagatattttcaataaaagttttcatttttagccgcaccgatttcttttaatcaaggttaccttgcttcggcatgttctaacgtgaaatgttcctcttcacccatatgtttcaattgtttcatcgaacgcatgtaagagtaaagcaacactgcaacagagccgatccaagctagaggagaagctgctgcggctcctggatacccccacattcctgtaagaacgatagctgcaaaagaacgcataagcaattccatcataccggcgatcgtaggaatcttgctttgtccaagaccttgaagcgtgtagcgtaaaatgaacaggactgctaagatccagtaaagagacccattgatattgaagtaggtttgtgctaattcaaatacatgtgtttctgatgggctaacaaacagttgaacaaagaaatgtccaaagaaaatgacgatagcacctgctaaaagactaaatccgacactcatcaataaagtttgtcgtacaccttgcaagattcgaccatattcttttgcaccatagttttgtgcagtgaaagtcgccattgcgataccaaatgacatcatcggttgattggcaaattgatcaatacgaccagcagcggcttgagcagccacaacatctgtccctaagctatttagtgccgcttgtaatacgatagcaccgacagcgatgattgaagactggaacgccattggcaaagctgcatttagatgtacacgaaactcttctttatcaaaattgaaatcttttttgcgtaactgtaacaaaggcatctttttcttgatatacacaagacacagtacgctagaagaaacttgtgcgattacggtagcaatagctgcaccttccacacccataccaaaatagataataaaaatcaaatcaagtacgacattgatgatgaccgcaatgatcagaaagaataatggtgtgcggctgtcaccaagtgcgcgaatgacattagaaagcaaattgaaactgacggatgcaaagattcctaacaaaataattgaaataaacgtttgtgcttgatcaattatttcaggaggagtttgcatcaactgaagcatcggacgaataaacaggagactcagtacggttaaaatcacagtgacgacaagactaataacaacactagcagcaaaacttttcttcagaccccgataatcttttgcaccgtaacgttgtgcagtaataatggctaaaccagctgttaacccttgggcaaaaccaatgatcaaaaatgtcaggcttccagttgcaccaaccgctgctagcgcatttttacctagtgtctgacccacgatgatcatatcgatcatattataaaactgctgaaaaacgtttccgatcagtaaaggaacagtgaacagcaaaatcagtttagcggggcttccttttgttaaatcgcgcatcttttaaactccttatatctttaaaatttagttagtagtatatagcgtttatcctgagaataccaattagaaatcaatgataattgatgaaattccataaaaagaagccaagaattgagtcaaagaatcaacaacttggcctggtctgtaaaataagggacatccacgtttatctatcaccttaatattgtctgatctcacttggtaaaaggatcgtttctctcgtaccgtcatcataggcgtatacttgagcaggaaattggttcgaataggcaaacggtaaatcaatatccatttccacattgcttcctgcttgagaaaaatgcatcgtcacttttccacgattttcgatcaaatcaaaggttaatatattttctaatggaatgactcccttaagatctaggtcaataataaaccatatactgtcaatcaattcatctggcaaacttgatactacaccaactgaagcgtaacggttgcggctgctatcaaaactttcaaacatctggttaacctccttcgaatcaacgaatgtttttatttttataatcaatcataggataaactagaaatacttactttaacgagggttcattctaataaagaatcaggaaaaatgcaacaataattgaatactttttttcaaagtataaatttttataaaggtacgataaaaatatgcgagggaaagcttggtaaatcaggatttttcgtttgcaaagctatttacaaaagtggaagccccatatgaaaataaacgattagaaataaaaaaggcgtgttaaaagctgctgacccgccacttctaacaccacctgattgtttcagtattattcttcttttgaaccgattacttctggttcgtcgccttcacctgtgctttcttcttcttcactttgagcgactacagcagcaatttgttcttcactgtcggtcacgaacttgtaatcgtcgttttttggaagatcggctactgtaatagaatcgcctaattccaagtttgtcacgtcgacttcaattcgttcaggcaatttgtctggtgtagcagatacgactactgtatacaagttttgagctaacactccacccgatttaacaccaattgattcgccaacaagaacgacttctgtttcgacttctgtttcttccgacatgttgacagatagaaattctgcatgttcgaaatgattagtaaaagtgttcgtttgaatcttatgaaccaatgtattgactttttgtccgtcaatgtccatcgtgataactgtgtttgctccatgttcacgcaacaatttgcttagtgtcaaaccatcgaatgagataggggtactttctattttatacccataaacaacagctggaactttcccttcgtgacgaagtttatttcttaatgaacggggacgtacttctcttttacttacttctaatgatactgacataaccaaaattcctccttaaaatgtgactgtctgctttggtaacggacagattttatttaagtgaattctaaaggctaatctcgtgcacatcatcgaaggcagggcgcttaaaaaaacgcaaaaggagagatgtgcgcatctccccttagaaagtcaggattcaacttttctccaccaggtcattacgctgtgtatgagaaatccaattcactttactctttaaccgtaacgcgaactactggttaagtcaaggaataacgctgctgatttatttgcaagcaaacatattcaaggtataattcttattagtaataagaaaggaaacggtatgcgcttagataaattaatagaagaaaaattagaaacgacacgtaaggaaatgaagcggctgtttgctttgaagcaagtgatggtcgatggcacagtcgaatttcgacaaaatcgaaatgtagacagtttgctgcatcggattgaagtagcaggtgaacatttagaaacaaatgagtcctattatcttctcaacaagcctaaaaaagctgtgactgccgtgtcagatccagaaaagacgacggtaatcgatctgattgcaagtgccgatcgttttcagccgctctatccggtgggaagactggatagagatacaacaggactattgctgattacttcgaatggccaattgggatatgaaatgctccttcctgaaaaaaaggtctcaaagacttatcaagcagtggtgaacgaaagggtgacatcagcagacgtagcagcatttgaaaaaggaatcgtattcgctgatgggtaccagtgccagccggctaatctaaaaatactcaaagcagacaagcaccaaagtactgttttattgacgatccaagaaggaaaattccatcaagtcaaaaagatgtttttagcccaaggaaagaaagtgatcgcattgaagcggttaagcatgggaccattggaattagatgaacggttggcagtaggcgagtaccgatcgttgacgctagcagagatgaaaaagttaagtatttattttaaataggagatcaaaaagatgagatataacactttattgtttgatgttgatgatacattactagactttcaacaaactgaagcaaatgctttaagtgctttgttcgcagagcaaggaatcacgttgacatcagaaatcaaaacgagttataaggctttgaatcatcatttatggcaggaatttgaaaagggcagactatcacgagaagaagtaacaggcagtcgttttggattactcttccaacaatttgggaaaacagtagatagtcgccaaatggagaaacgctatcgtcactacttgaaccaaggacatgaccttgttccagggagtctagaacttctgaaaaaggtccaccctcacgccgaactttatattgtaacgaacggtgtgtcgcatactcaatatcagcgtttaacagatgcaggaatgcttgattattttaaggatatatttgtctcagaagctgttggagcgcaaaagccgatgaaagaattttttgatcatgtattttcccgcattcctgatcttgataaaaagcagacggtgatcattggcgattcactgacttctgatatcaaaggagggaacatggcagggatcgatacgatttggttcaataaaaacaaattgccggaaatcgaagagatccaacccacttatcgaatcgattctttagaagaactttactcattattggaaattgaaaaggattaattttcagaaaaatatagcattttcgtgttttttcgctataatagattagaatgaaaaaacggatacgaaagaggttttagtcaatgacaaaaagcaagccaattatcattggtgtgacgggtgggtcaggaagcggaaagacaagtgtcagccgtgcgattttcaacaacttcccggaccattccatcatgatgcttgaacaagattcttattataaggatcagagccatttgagttttgaagaacgattgaacacaaattacgatcacccttttgcctttgataatgatctgctgattcagcatgtaggcgacttactgaactataaagccattgaaaaacccgtgtatgactatgtagcgcatacaagaagtcaggcaacgatcattcaggaaccaaaagaagtgatcattctagaaggaatcctgatcttagaagatgaacgtctgcgtgacttgatggatatcaaggtatacgtagatacagacgatgatattcgtattattcgtcgtatcaaacgggatatggaagaacggggacgcacattggactccgtgatcgagcaatatttgacagttgttaaaccgatgtatcatcaatttatcgaaccaacgaagcgctatgcggatatcattgttccagaaggcggagaaaaccacgttgctattgatttgattacaacaaaagtggctagtttcttaaaccataaatagtgcgcagtgaaacagttgaacggactgcgaccgtttgaaaagcaaggatcctgctttttgaacagtcaccagtcaactgtttttttatttataacaagaggttgtgaaatcagcgtcttgacttgagtattagagagaaaaaacggaaaaatagctacttatattttaccgttttttgagctaataccgaaggtcagctgattgagcaccgtgaatcagaggttgtgacagaagtagtcagcttcaataaataagaaggaattttccgaagaagctacttttgcatcaccccctaaggaggcagttttagcaaatgaaaaaagatatgaggaagaaagatgtctaaaaaagcatcagttttacaaaaatgtcttcagatcatgccaatcatcggtctgttgtttttctttgtgttgattctctatgcttatcatcatgggatttttcgttcaagcacctctttgcaagcgtttatccaggaattcggcaagtatgcagtgatagtatttgttctgctgcaagtggtccaagtgatcattcctattttgccgggagggatctcttcggtagctggcatgctgatgtttggcaatggatttgggcttttatatagttgtattggtctagtgattggggaagcaatcggatttttgcttgtccgttactatggtgtagcctttgtccagcttattttatcgccaaaaaagtatcaaaaatttgatgaattgctgacaagaaaaacgaaagatatcaaaaaagtattagtcgttaccttgctgcttccctttgcgccagacgacttgatctgtctagtagctggtttgacgaaattatcttttagagagtttatgcagatcgtgattttcttgaagccgtggtcggtaggtgtgtacagtatgatcatgctctttttattccatcaagcgcaaggtcatttataatgtaaaaaaggacgtgggtgtatggaaaaaataaaagtaacagaaaatgaactggatgagctgatggcagtcattcaagaagtatggccggaagcttttgtaccaattattggtcaaaaacaagtcgattatatgctgaaaacttatcagtcaaaaaagcagatccaaaaagaactggcagaaggcgtttcttattttttattaaaaagtgaaggaaagactgtcggttacactgcttatgaagagataaaaggtaaaatctatttaagtaaattatatttgctgaataaagcccgtggccaaggattgacttcttcggtttttcgctggtatgaagaacttgctgcgcaaacaaaggaaaaagagatttttttacgagtgaaccagggaaatcaccaagcaatcgaggtttataagcatgaagggtttgagattacagaagaacttgtttcagatatcggtcaaggatttcaaatggtcgattataaaatgaaaaaagctctcgcataatcttaggaactgtgttaaagtaacttcatgcgacgggtcgagaaggactctggtttacagagctcctaattgattttggaggcacaggataattgatttctatctttatcacctgccggatgcaggggtgtcgggcaagacttttgtggagaagggcttgtctgcttgagtaatcaagtaccgtaaaaatgcggaaagaagcttatgcttctttctgcatttttttttttttacaagaatatattctgtaaaattggtttatttcccctttaatgctaaaatcgaagagcagattagttataagactgtttaagggagccattgtcatgttcgaaaaactcaaacgatttgggcgcaattttacgcaaacaacgccctttattttaagcaatacggttattttgattccttatcttttatttttgggaataacagattcgcataattggctgacgattttgccatttacgctgttttatgcctttcggatgactgggctgtttttagtcaatagtctacgatttggtctagatagttacacgttgctgatgatcgctctgctgatgggtggtactggttcattacttggaatactaggcgtattttattttcctttgttttatttttcaagtgttcttctagggctaagtgcagcatggcttgtacctgctaatatcacggtcaatttccatgagaagatgcaaggctttatcaatatggatgggaaaaagtacttatttgcagctatctggctattcctcctgtatcaagcaatcggactgcctgcaccgactcagattgcagcaagctttacgatttatacacttttttacgtcatggcctaccacacggtcagtcattatccgcgttacgaactggatttcaaagatatgaaaagaaatctagtggctacgcgggagcttgttttatttttggtgttctttggcttattgtttcttttgagaaatgcccgattgttattcgatgaaaggctttttgatcttgctgtttatggtttcttggtgttgttcattgtgttcgtgttcgtcttaggccaccagaagaaggaatggaagttgccaagttggctgaatctgtttacttttctaaatggaatgttagggaattttctttttttgtttagcagtttttatgttggcatactgtacggattagagaaacttccgttttatatgtattttccttatgctgccggtttgattgcagcaaaaatagtcggaccattgattttgaaacgtttatcatggtctccattggctacgcaattgcttggactgagttcttctttgttggtcctcttgattccaaatggttttgcgataggtgtctttttgcttagtttctggcacgtagtaacaggcagttggctaaataaggaatactatcaaaccgatgtagctattccaatggatcgtcggattattgccaagtacactactcaaaataaaggaagtgtgatccaccagtttttattgatgacgcttttgtttattttatcaaaagaaatgggagagccaatccatctactactgatcatgctgaaccatggagcagtgccgatagcaagtgcgcaactgcttattttagccaaatggatcaatgtcggtctcttaatgagcggattggtgactgtatatcatttatggaagaaggcgaaaaagaatgaggctattcattgatggggatggttctccagtaaaagacgatgtcataaagttaggagaatcctatggtctcgacgtgattatcgtaaccagtgtagatcattatacgaccaaagaatacgctaatcatgtccaaatcgtctacgtagaccgtggagctgatagtgcagattataaaatcgtcggtatggttaagaagaatgactttttgatcacgcaagattatggtttagcttcacttgtattgccgaagggtgtgcgagtgttccatcactctggaaaagaatttgatgaagcgaatatcggcacgcttctcgaacaacgttaccatagtgggaagttaagaaaagctggcataaggacaaagggtccaaaaccctttacagataaagatcatacggcttttcgtcaagcgttgaaaaaggcaattgaccaaggtttaccaagtacagaagatagtaggtaacgaaggtagtttacttgtgcgcgaatacaccaaaaaaggaacagggaaacaggataaatggattccttgttcctttttttgttgttcggtactagctcaaaaaacggtaaaataggaggagttatttttatttggtcattcttattgcttgagacagaacagctttctcccaactttttttctactttttcctcttcttatacatttggatcaatgcatcgattgttaaaaaaataatgacaaatgctgcaatagcatacgtaaatatccctaataaggaaacgacctctgcgttttctacaggtgcagcttggacaagcagggaagatcctacgatcaatgcagctaaaatcataccgaaaacaagtcgattgatcatactttcgatcctgttcaataatttgtcttgcttttttaattccaaattgacttttccttgtcccgaagtccacatttctaatagatgatgaagttgttgtggaatcttaggcacagccttcattccttctaataggtctaatccactttgtttcaatgtatcttctacatccaaatgggtgagaaagtaatgttgggcaaaaggcgaagcaacttccatgagggaaacttcagggtcaaggacacggatcaccccttctaatgtcccgaatgctttcagcaaaagcgtgatatcacggtcgaactgcagattattttgatgacagatcatcacgacttgtgcgaatacttcttgcaagttgatttcatcaataggggaatcataatattgttcaagaaaacttgtcagttcttggtgaaaccgactttcatcaaataagccttcttgctgacaaagtcgaaggaccgctttttcgattcgataagcatctttcgtatacagcgctaaaacggcttgtgtgagcttttgcctaagacctgcagaaagatgccccatcatgccaaaatcaatgtagttgaccgtatatggcgcaacagggtcttctatagaagtagaggctcgaaaagcaaagggaccgaactctttttcatgaactgtttcagttgttcggcgagctcgtgtctgttcttcttttgttagcacatggaacagcaaattccccggatgaggatcagcatggaaaaaaccatcatcaaacacctgcttcataaagttctcaactaaaagctttgcaacttcttgtttcagctgcttgttttgaataccggtgataaaagtttctgttctgttttcggcattcatcaaatgattcaagtttttaccagacatttcttccatcacgatcacttttttcgaacaaaaagcgtcataaattttggggctgcggatctctttccagccattgttcttttgatagaattgttcgccattttgactttcttttaagaagttcatttcattgatcaaggaacgttttacttcttggagtaccccttttagatcaactacgctagtttcaggaatgtatttgatcaaagggattgcacgttcaaatagttgaagatcaaggcgaatctcttcggcaatgttagggtgttggatcttaacaactaccgcgtcaccgcttttcagcttggcacggtgagcctgtcccatagaagcggaggcaaaaggcgatttggaaaaatcatcgaatatatctgataccgaaagagaaagttccgtttcgatcgtctttttgaccgttgaaaatgtgtcgctaggtacactgtcttgtaatgttttaaatgtctgagtgaaggcagaggaaagcaagtcctctcgaacagaaagcatctgtcctatcttgatgaaggtggggcctaattcttcaaaggctttttttacctgttcgggatttttttgctgtacaaagtttggcactacattgtagttgatgaacactcgaatgatttctgccaagcggctgcgtggatttgtttgcgccatcatcatccctccttttctttatcataactttttataaaaaatgggacaaataatctagctggcaaaaaataaatgacgtttgttcttttagaaaccaactcgtttttttataaataagttattcgtttatttttgttttgtgctaaaatatgagagtaaatcactgaacgatttagaatacaggaggacaatcttttgaagattactttactatatggcggacgcagcgcagagcatgaagtgtccattctttccgcattttcagttttaaatgccatttattataattattaccaagttcaactcgtatttattacaaaagaaggacaatgggtcaaaggtccattactaacagaaaaacctgcaagcaaagatgtcttgcacctttcatgggacccaagtggacagacagaggaaggctttacaggaaaagtgatcaatccgggcgaaatcaaagaagaaggagccatcgtttttccagttttacatgggccaaacggggaagatggaacgatccaaggcttcttagagacattgaatatgccttatgtcggcgcaggcgtattgaccagtgcatgtgccatggataaaatcatgaccaaatatattttacaagctgctggtgtgccacaagttccttatgtaccagtacttaagaatcaatggaaagaaaatcctaaaaaagtatttgatcaatgtgaaggttctttgctttatccgatgtttgtcaaaccggcgaatatgggttctagtgtcggcattacaaaagcagaaaaccgagaagaattgcaaaatgctttagcaacagcctatcagtatgattctcgagcaatcgttgaacaaggaattgaagctcgcgaaatcgaagttgctgtattaggaaatgaagatgttcggacgactttgcctggcgaagtcgtaaaagacgtagcattctatgactatgaagccaaatatatcaataataaaatcgaaatgcagattccagccgaagtgccggaagaagtttatcaaaaagcgcaagagtacgcgaagttagcttacacgatgttaggcggaagcggattgagccggtgtgatttctttttgacaaataaaaatgaattattcctgaatgaattaaactctatgccaggatttacggagttcagtatgtacccgctcttatgggaaaacatgggcttgaaatacggtgatttgattgaagaactgattcaattaggaatgaatcgataccgtcagcgtcaatctttttttgaaaaaaatgaataaagagaaataaagaagaagctggagtgattgcgtaaccgcgttcattctagcttctaaatacgaatagagaaatttacttggaagtgagagtcatgcgaacccgccgtttaggccaaacgcttttttcacaaccttttttaggagagatctcaatgaatctaacaatacaagaaattgcacaagccgtgggcagcgaatgctctgaactgacaaagattaccaatgtcgaatttgacagccggaagataaccgaaggaagtttattcgttcctcttgctggtacgcgagatggacatgaatttatccagcaagcaatcacaaacggcgcatctgcttcattttggagcttgcctgttgaacaagcaccaaaagattttccagttatccctgtagcagatcctttgaaagccatgcagcaattggcaacctattacttggaaaaagtaggtgcagaagtcgttgcaattacaggaagcaatggtaaaaccaccacgaaagatctaaccgcgtctgtcttgtctgaaaaatacaaaacatataagacgcaaggaaattacaacaataatattggtcttccttacacgattttgcacatgccgcaagatacagaaaagatcgtcttggaaatgggcatggatcacgccaatgaaatcacggaactttcacttatggctcaaccaaaagctgcagcaatcacaatgatcggtgaagcacacatagaaaatcttgggtcgcgagaaggaatcgctaaagccaaaatggaaatcactgacggacttgtaccagacggattactcgttgtgcccgcagatgaaccgttgttgacacctttaacggcaacattagtacaaacagtcacaacattcggtattggaaatggcgatgttcatgcggaagtgacagcagaaggaaaagcacaaaccgattttgtagtagaaggagaaacatttacgatcccgctgcctggaagttataatgtaacgaatgctttgattgcgtatacgattgggcgcttctttggactgtctatacctgagatacgccaagggctcgctcatgtttctatcacacaaaacagaactgaatggctaacggcaggaaatggtgcagctattttgagcgatgtctacaatgcaaatccaacagccatgggactggtattagatacttttaaaaatctgccaacaaaagggcgtagaatcgctgtgttagcagatatgctggaattagggaaagattctttaaacatgcatgcgcaaatgagtgaacatatcgatcctgagaaatttgccatgattttcttgtacggggaacaaatgcatgcattaaaagaagacttgaatcaaaaatatccgcaactacctgtgttctattttgaaaaagaaaagaataaattgattgaggctgtcaaacaaaatcttgaatcaacagatagtattatgctgaaaggcagcaacagcatgggcttattcgaagtagtagaacagcttcagcaaatgaaatgaaaatctgtaaacttgcagaaaatgaaaagctatgttagaataacctattgccgaaagatgaagagaaattggactggttttgccatggaagcaacttgtcgaaaccagatgtcataatcatgataaagctgaacgcgacccgtttggcttttctaatgcctaaacttcgcaaagtgatttttcggtggtgccacaggggctaagaatgggtaaaaacgtgcgtggccactgtcaaaaagaaacaatacactttgaccgaacaaatcgacggggtagcaaaaaagctacatcctcagttaacaaccatataggaggattcatttgaaatttaaagaactagaattatcaccagaattgttgaaatcagtcgaacgcgctggttttgaagaagcaacacctatccaagcagaaacgattccgctagcattagttggaaaagacgttattggacaagcacagacaggtacagggaaaacagctgcatttggattaccaatgttagaaaaaatcgatccagatcgtcacgaattacaaggtctggttatcgcaccaacacgtgaattagctatccaaacacaagaagaactatatcgtttagggcgcgacaaaaaagtgcgtgtacaagctgtctacggtggagcagatattggccgtcagatccgtggcttgaaagatcgtccacatatcgttgtgggtacaccaggacgtatgcttgaccacatcaaccgccatacattgaaacttggaactgttcaaacattagtcttggatgaagcagatgaaatgttgaatatgggcttcttggaagacatcgaaaaaattatttcccaagttcctgatcaaagacaaacattacttttctcagcaacaatgccgccagccatcaagaacatcggcgttaaattcatgaaaagtccacatcatgtgaagatcaaagcgaaagaaatgacagctgacttgatcgatcaatactatgtccgcgcaaaagaatacgaaaaatttgatatcatgactcgcttgtttgatgttcaaacaccggaactaacaatcgtcttcggacgtacaaaacgccgtgtagatgaattggcacgcggattggaagcacgtggttatcgtgcagaaggaatccatggcgatttgtctcaacaaaaacggatgagcgtattgcgttcattcaagagcggtcacttagatatccttgtagcgacagacgttgccgcacgtggattagatatctcaggtgtcactcatgtgtacaactatgatatccctcaagatccagaaagctacgttcaccgtatcggacgtacaggccgtgccggaaaaggcggtatgtctgtgactttcgttacaccaaatgaaatggactacttgcatgtgatcgaaaacttgacgaaaaaacggatgacgactttacgtccgccaaccgaaaaagaagcattcaaaggtcaattaggtgctgcagttgaacaaatcgaaacaaaacttgcagaaaacggtctagataaatatctgcaaacagcagataaattattagaagaatattctgcacaagatttggttgcattactgctgaaaacgacagcaaaagacccagctgatgcagtaccagtgaagatcacaccagaacgcccattgccaatgcagaaaaaaggatacaacaaaaatggcaaacgtggcggcggaaacaaccgtaatcgtcgtgacggcgggaattatcgtggaaacaaatcaaaaggcggttatagcaaaaacaataacagccaaaaagatggcggtaaacgtcacaatgataaaaaacgcggatttgtgatccgttcaaataacgattaaacctaaaatgaaagtttctctgttttaagagaaactttcatttttgttatttgtggacttatttgtggcaaaatggttataatttggtagaatgagagtgttctaaatttattgaaaagagaaaagcatatgataaaaggaattgggatcgatgcagtcgaattgtctaggatcactcggctgatcgaagaaaaaccaaaattcattgcacgaatcttgacctctgaagaaacgaaactgttccaatccttgccttttcatcgccaagtagaatttttaggcggacgttacgcttgtaaagaagctttctctaaagcttggggaacgggaatcgggaaagttacctttcaagatatcgagattttaaaaaatgaaaacggtcagcccgttgttacgcgctcaccccatgaaggcaatgtatgggtcagtattactcacacaaatgaaacagcttttgcacaaattattttggaagactagaaagaaggaaaaatgatggttgtcgcttggcaccgcccaacgaaagcagtgatacataaaaaagctataactgaaaatgtagcaaatgaagtggcaagacttccgcaagggaaagaattgtttgcagtagtaaaagcaaacggatacggtcatggagctgtagagacagctgaagcagcagttgctggtggagcttcgggcttttgtgtttcaaatttagatgaaggagtcgagttgagagaagctggatttactcagcctatccttatcttgaacatggttccttacgacgcactggctttagctgttgctcatgatttgtcagtaactgcaggtacacgggaatggttgcaggtagcagctgctattttagaggaaggtaagctagaaatgcctctttcgatccatttaaaagcagatactgggatgggacgtatcggtttttgtacacctgaagaagtaaaagaggcagctgcattcatcagagaaagtcgtgtattagaatgggaaggattatttacccatttttctacagcagatcaaccagatgatacgtattggaacctgcaaaaagaacgctttatggaagtgctaaaaaaacttcctgaacttcctcgatatgtacatgtcagtaacagtgcaacggctttatggcatgatgaaacaatcggcaatatgattcgttatggtgtagcaatgtatggactgaacccatctggacatgcacttccggaagtttatccgttacagccagcacttgaactggtttctgaattgatccaagtcaaaaaactcccagcaggtgaaggaatcggctatggggaaacatatatcactcctgaagcagaatggatcggaacgataccgatcggttatgcagatggctggttacgaaagatgcaaggtttttctttattggtagaaggaaactattgtgaaacgattggacgtgtatgtatggatcaactgatgatccgattgcctcaagaatttccggtcggaacaaaagtgacgcttatcggcaaaaatgcagacaaagaaatcactatgcaagacgtagcagatcaattaggtacgatccactatgaagtggcatgcggattaggacagcggataccaagagaatatcaagaataaggaggatcctatggtaaaaagaggagatatttattttgctgatctttctccagtcgtgggatcggagcaaggcggaacacgcccagttttggttattcaaaataatctaggtaaccatttcagcccgacgatcattgttgcggccataacggcaaaaatggctaagcctaagcttccgactcacattgggatcaaagctactggaacaggaatagaaagagactccgttatcctgttggagcagatcagaacgatcgataaatcaagattgaaagaaaaagtctgtcatttggatcgaccaattatggcagaagttgaccgagcattaaaaattagtgtgggcattgaggcactgactcctgttactaaataagtatagcgaagtaaccatgcagcctttacatataaaaaaaggaccaactgtgcgtaaaaaaagatacgtccgcttctagtaccagcatttctgctagaagaagcgaacgtatcttttttgatgatccaaggagtggtccatgcgccctcctcctttacagccagacttggactaccagctggctttttttactcctggaatcaaacctttatgtgctaactcacggaattttatacgggacatcccgaatttacgcatgtatccgcgaggtcgtccatcgattagatcgcgatttttcaaccgttctggacgagcatctaaaggaagtttacgcaagccttcataatctttttgcgcttttaattcctgacgtaaagcagcatagcgttcaatcgtttcttgctgtttttttgctttggcaatctttgattttttagccatcaacaaattcctccaattttttattagcgtaaatcgtaatctttacgcttttagatgaataatttaacacgatacgcgaaaaaaaacaactattttgttttggattatgttccaaattgaaaagacattttttttgtcaaaataaaggcataaacgtaaacttaaagaaaaagggagatggtaactatgcgaagatttgcaattaatggttacggagaagcgcaagatgtttttgaagaaatcaatgctcatcccagagaagtcgattctggacatattcgtgtagaaataaaaacattcagcgtgaatccgtatgatgttgccttgcgttcaggagagatgaaagagatacgaacattgaaattcccttatgtactaggtaatgttggcgctggtatcgtgacagagattggttcagatgtcacaactgttcatgtaggtgatcgagtagctgtccatgcagtcggcgggacttacggagaagaagtcgtactgccatcaacaaaagcagcaaaaattccagatgaaatgagttgggaagaagcagccggaatggtcacaccagggattacggcgtataatctaatcaatcatttgacggaaatccagccgacagatacagtgatgattctaggtgcatcaggtgcggtcgggtctagtctgatccagcttctccacgaaaagggtatccgagtcttaaccagtgcctctagtaaaaacgaagaaaaagtaaggaaactaggagtttcagcatttgctgcttatgataaaacagacccaggtatgcaatttgctgatcaagcagaccttgtgattgatgccacgaaaggaagcatcaaaggagaaaccggcatccagatcctgaaaccaggtgggagatatgttgcattaaatgacctcccagacctaaatttgcggcaaaaaaaggaaggcttttatgaatcatttgttccaagaaaggaatatcaagatgcagaagcctttgctggcataatcaaatcctatcaaaaaggtgcctttcatatttttatttcaatgaatctgtctgcttcacttgcacatgttatccaagcacatcagcaagttgaagggcatcctcctgccgggaaaatcattttgtcattcgaaaagtaagaaacataggaataaaaaatgaaaaaagctgaaacatttttgtaggggcaaagaccaaaaaagtgttttagcttttttgcgtatacgtataatagataaaaactttggcataaaattatctttcccttttatttcatgataaagtaaaggctgtaatccttaattatttctcaatatgtaagagattacaatgagacaattgccgtgatatgtccaaaaattcgacttttttgaaaaaagccgattgaaaaaagtatgaaatacatggtaaagtaattcagctgaaaaaagaagaagggggagaactatgcagtcaatcaaaaatacacttcgtttatatttgcttgactggaaacggattttcaaaaacccgattgctacacttttgatcattgcgatcatgatcatcccttcgctatatgcgtggtttaacattaaagcactatgggatccatatggaaatactggagagctgccaattgctgtttacagtgcagacaagccagcagagtttcaaggtaaagaagtggccattgggaagcaagtcatcgaatcgcttcataaaaataaacaattaggatggcaattcgttgattcaaaagagcaattagaagacggagtccgttccggaaagtattacgcaggtatttacctgccaaaggatttctcagaagatctgctgagttttactagtggtgacatcaagaaaccgaaaatcgaatatacggtaaatgaaaaaatcaatgcgattgcaccgaaaatcaccgataaaggagcaagttcgatccaatcgcaaatcacaaatgaatttatcaaaacagccagttcgactttattgaaagtattcaatgaaataggttacgacatcgatacgaacctagtaagtatcaataaagtcaaagagatgattttatcaacagatgaaaatctggacacgatcgacggctacacaaagcaagtcctcgaattacaaagtcaattacctgacatcaaggaaaaattgaataaagcaaatgaattcgtggattacatccctaaagtagatgagatgggcgaaaaagtcgttgcattgaatgacaaaatgcctgaattgaaagaccaagcaaaaatcatccttgatttgcaagaaaaaatcccagagatccaaaatgctggtaaacaactagcagagatcgacggcgattttgcttcgatccaagagacaatgaatcaaggaatcgatgaagcaaaacaaggcttgacgatcatccaacaagtacaagatatcttgccagatgtgaaaaatttagaaaaccaggcaagtgatctagcaaaccaaacaaaatcaggtgcctctcagctgaaagatgcgataccaagcatcacaaacagtgtagatgttacattgaagtcaattggacaagtggcaacaacgactagttcgttaatagatactgtaagaatagctattgaagatggtaagctgactgatgatgaaaagaaaaacatcagcaatgtattgaacggctttattgacggaatatctcaacaacaaaatgcaatcgataaactggtcgagttcctgactaaattgcaaacaagtgctggaaatacgaaattgcagccaatcattgatcagctaaatcaattaaaacccttgctaagcaatctgcaaaaccgcctatctgctttgaacacagctgttcaaaatgaagacacgaaggctattgatgaattgctagatcaaattgatgccgttgctaataatatcaatggcatcattgctggtatcaatacaggtcaaatcagctcaaccgtcacttctctactagaccaagtcatcgatacgattgggactgcacaaggcgcactgagcaaagcggaccagatcgactttgattcgcttctcagctcaacgaaagcaactgtaacaaatgcagtggcaatcttagaaaaatatcaaaaagaaatgcctgcaattggacaagaaatccacgatgccaatacaatgttgaatggcaatatggagaccatcgtcaatggcatcaatgaaggggcagacctatacaacaatgaattaccgatccttcagcaaaaattagggttggccgctgattttatccaaaatgattggcccacactaaaaaatgaaatcaccggtacattgacaacagtaaatgaaaaaatgccagaagtcgaaacagctgtgaacgctgctgcggacttgatcaacaatgactggccaaatatcaaagctggtatccaaaaagcagcagatgcgatccgaaaaggcgaacaggaagtcgatctaggagaagtcatcaaattattgaaactagatgcaacaaaagaaagtgacttctttacacaacctgttgagctgcaaaccaatgcgctttatccaatcgcaaataacggttcagctagcactccattttatactgcactatgtctgtgggtcggcgctgttcttctttcaagtgttgctacgacagaatactatttaggaaagaaagaccgaaacaattttacgaaacgagaacaattcgttgctcgtatgctgacattcttgacaatggcaatcgcgcaaagcttgattgttacattagggaatattttcttactaggagtagatgtccaaaatccagtctacagcgtgtcatttgctgtcttgattgccttagcatttatgatgatcgtttacgtcctggctgcattattcgataatgtcggtaaagggatcgctatcatcattttagtactgtcgatctctggtggaggcgggaactatccgatccaagtctcagggaaattcttccaaatgatcaatccgttcttgccatttactcatgcggtaaacttgttacgggaatctgcaggaggaatttattggccaaatgctacgaaagcaatctggatcatgatcggtttgtttgttgtctttggagtcgtaggaacggcagtctatccgttcatcgaagaaaaaatgacgaaattcaaagaagcggcgcatgagagccatatttttcattaaagaaaagaggttgtgaaaaagctgttctgcagtaataagaatgaccaaacaaaaaaacagcttcacatttctcttttaaaagttaagatataaaaaaggatagaacctgattttctaagtcaagttctatccttttattatagaattcaaagaaaaagcccataaaaaaatgttagatttttgctgtattaaagcgtttgaaaaagcgcttgatatttttctgtttttttccaattattttcttaaagtttattgacttttaaggtcagtgagcgtactataacatcttgtttactataaattttcgactatcatacttgaagtaaaattgcgtgtaaaggagtttaaaaattggattacttaaaaaggttgttagtaggtaagcctttaaaatctgctgaaaatgatgagcacaaattaacccgttttgctgctttggcattattgtcgtctgatgcgttatcatctattgcatatggtacggaacaaatcgttgttgttttagtcgctttgtctgctgcagctatctggtattcgctgcccattgccgcttttgttattattttattgatttccttaacgctatcatatcgtcaaatcatccatgcttatcctcatggcggtggagcatatgtcgtcagcagtgagaatcttgggaagaatgcgggcttgatttccggtggctctttattgatcgactacatgttgacggtagcagtatctgtctcagcaggtgctgaagcaatcacatcagcggtcccagcattatacgggcatcaagttgctatttctgtgacaatcgttttactactgatgatgctgaatcttcgtggtctgagagaatctgcatcgttcctgttatttccggtgtacacatttatccttgtaatctcgttgctaatcgttgttgggttatataatatcgtgacaggtgctgtgccattgcaagctactgcgttgccaggggcggttgttccaggggtttctatcgccttgattttacgagcattttcttctggttcctcctctttgactggggttgaggctatcagtaatgccgtaccattcttcaaaaagccaagagccaaaaatgccgctgctacattgacgatgatggccttgatcttaggtttcttcttcgttggaatcacatttatcaattattggtatggaatcgttccagaaaaagaagtcactgttttgtctcaaatcggtaaagctgtctttggacatggtattttgtattacgtccttcaatttgctacagcgctgattttagccgttgctgccaataccggtttttctgcttttccagttcttgcatacaatttggcaaaagataaattcatgccccacatgtatcaagatcgtggggatcgactaggctattccaatgggattatcacactagcgctaggttcaatcgtgttgctgtttattttccatggctcaacagaacgcttgattccgttatactctatcggcgtgttcattccatttgctttatctcaaacagggatggtcgtcaaatggaaaaaagaaggaaaaagatggttaagcaaatcgattgccaatattacaggtgcgttcatctcatatgcaatcattgcgattttgttcgtctatcggttaggggacatttggcctttcttcatcatcatgccaatcgttatgttcattttttataagatccatgatcattataaaaaagtggcagaacagcttcgtttagaaaatgatgcaaaactacatgactatgacggaaataccgttcttgtattagttgggaatgtgacacgggtgaatatcggtgcgttgaattacgcacgttcgatcggtgattatgtcgttgcaatgcatgtttcgctagacgaagatgtcgaaaaagaaaaagaaatcgaagcagaatttaaaaagcatttcccagatgtccgtttctcaatcgtccattcttcttatcgctcgattgaaaatccgattatccggtatgtagatatcgtaagtaaaaatgcagcgaaacaaaactatacaactactgtgctgattcctcaatttgtaccaaacagacgttggcagaatattctccataaccaaacaagtttgcggttaagattgcggttgtcttggcgtgaaaatatcgttatcagcacctatagttaccatttgaagaaataagtccatcaagaatctcggacacaaagtagtttattgaatatcatttaaataaaaaaaggtcgtagcgctcaagcgctacgacctttttttgtcttgattcattctgtctgcgatttttttgaagcaggatctagccgtttttccaaaatacctaaaagccagtctgtgatgatcgccattaatgcagttggcaatgcaccggctaaaataatcgatgtgccatctgttgcattggttcctcggataatgatatctccaagaccaccagcaccgacgaatgcaccaatcgcggttatcccgatggcaacaactagcgcgtttcttatgcctgccatgataacagaaacagagagtggtaactctaccatgaacagccgttgtctagcagtcatccccatgcctttgccgacatccaggatatttttgtctacttggatcatcccggtgtacgtattcttgataatgggtaatagggaatataaaaatacagtaacaatcacgacattgactcctagacctaatccaataatcagaatggagatcatggctaaggaaggaatcgtctggatgatattcgccaaacgaatcacccagtttgctaatttacgtctcctagaaatcatgatcccgaccggaatcccgacaactgctgcaaagaggacaccatagatagaaatcaggaagtgacggataaattgtgcaaagatataggagccattttcctggaaataatagaaaaattgttgaaagacattcattttatccaattgcttcacttcccttcaaaatagtggttttcttgtaagaaacgttgtgccactactgatggttccactagattattatctgcttcgtagttcaattcctgcattttttccgtactgatggtatgacctaacttatttaaggcttcttttaaatgaggcgtatcagctaataccttgttgtctacaactggagcagcatcatatggtgggaagaattgacgatcatcttccaacatgactagatcataactggcgatccgtccatccgtagagtagccaagaacaatatccattttacctgcttcgactgcatcgtaaacaagtccaatctgcataggtaagatcgaattaaaagagaaaccataagtttcctggaagccgtcgtaaccgtctcctttacgattgatccaagaagtatctacaccagctactaattcatccgctacatttttcagatcgctgactttagatagatggtatttttgtgcggtgtcttttcgaacaagaaagacatacgtattttcaaaaccataggatgggaaccacgtttggttatatcttttctcaaattcatctttcacgatttcaaaagcttttttcggatctttttcaggaggaagattcaatgtagtggttaaatctgttcctgtgtagcgagctgctgaaatcgaagcatctccgttcatcatcgcttggtggttgatagttgtagtagcgagattgttgatgatcgctgtgtttttatctgtatagtgttcaaccatcccggcaactaggcttgctaagatctgagcttcagaagtgattccacctgtgatcgagatggtgtcttcatctgtattgctggcaagtccagggaaggaacaacttgcaagtataagaagagagaaaagaaccatagtcatttttagtatacgtttcattcgtcattctcctctctaagtgcgatcggtgtcagccggtgttccaagagacctagaagccaatcagccaacagagctaaaatcgttacagggatcgtacctgccaaaatgagatctggttggtaattattcagtccactaaaaatcaaatcacctaaaccaccagctccgatataagaggcaagggtagcccatgcaatcacgtaaacagcagctaaacgaatgccggccatgattgttggcatagcaataggcagttcgacggaaaaaatggattggaactcagtcattcccatcccttttgccacatcccgataattccaatcgacatttttcatcccgatatacgtatttcgtagaattggcaataatgaataaataaagagagcgatgatcgcaggtaatttacctacgccaaatagcgggatcatcaatgccaataaagcaagagaagggattgtttgcaaggcgctggttaaaccaatcacaatcgtagcagctttcggaaaacgtgtcagtaagacaccaagcggtacagcaatgatgataccaatgatcaaagcaagtcctgaaatataaagatgttcaaaaccttttgagagaatttctgaaccgtgctgatgaaaaaactgctgcataggtcagacctccttagattcttcaggagtagctgactctgcaacatcagtagttgcggggtcttctccccaaatcacatcgtagacgatatccactaatgatgcgcgagtcaagatacctacgactttgttctgttcatcaacgaccggcacgtatttcagcccgcgttttaaaatgcgttgcaaggtatcacgaagataagcggatttttttacgtaaaaaacatgtttattcaaaatgtcgcctacactggatacttttcctcgttttttattcaacgtttctacatcgataaatccttttaatacattcgaattatcggtaactaacaacgtatctacacgtttttccctcatcagtttgattgcttcttgtaatgatttttccggtgtaatcgtgattgctgtatttagcataacttctccgactcttgtcgcatttggttttgcttgtagtaagcgatcttctccaatcaactcttctacgaaatcgtttgcaggatgacgtaaaatattttctggtgtatcgaattggatcacacgaccttcactcatgatggcgatacggcttgctagtttaatcgcttcatccatgtcatgggttacaaatacgatcgtttttcccaagcgctcttgtaaatctttgacaaggtcttgcaaagaatcgcgagtgatggggtcaagcgcaccgaatggctcgtccatcaagatgatatcttgattcgctgcaagggcacgaacgactccaatacgctgctgctgaccaccagataattcatgtgggtagcgatctaacatctcacggggcaattccacaagatcaatcattttttcagctgttttattccgttcttcttgactgactttcaacaatttttggacaagagtgatattttcacggatcgtcatgtgaggcatcaatccaatactttggataacatagcctatctgacgtcgcaattccactggatcaatttcttggatggattttccatcaatcaaaattttcccttgtgttggatcagtcattcggttgatcatccgcattgtcgtcgtttttccgctcccgctcgtaccgataaaacaaatgaactcacccttttcaaatgaaagattgacgtcctctacagcaactttcccacctttataaatctttgacacattttgaaattcaatcatggtgccacctctttttctattttcaatgaagaactatctattactagtatgcctaaaacaataaaaaaatacaaatagggtagtttttttatttagggaaataaaaagctaggataaaaatgtgctgattttgccaacagaacgaaaaacatgatagaatgatgaagcacatgatagaaagtgagtgacgatatgttaacaacagaagattttgattttgacttgccggaagagttgatcgcacaaacaccattaaaagaccgcgatcattctcgtttacttgttttggatcggaaaactggagaaatgaaagacaagcatttccatgaaatcattgaagaattacatcctggtgatgcgctagtcatgaataatacacgagttctgcctgctcgtttatatggagaaaaaccagatactggtgctcatttagaagtccttcttctaacgaatacagaaggagatacgtgggagacattgatcaaacctgcgaaacgtgccaaagttgggacaagaatctcttttggtgatggcagattgcaagcagtagtgaaagaagaattggaacacggcggacggatcattgactttgagtatgaaggaatttttctagagattcttgaatcgttgggagaaatgccattgcctccatatatcaaagaacgtctggaagacccagatcgctatcaaactgtctatgcgaaagaaaatggttctgctgcagcgccaacagcgggtttgcattttacgaaagaactgcttgatgagatcgaagcaaagggtgttgaattagtctatctgacactacacgtagggttaggcacattccgtcctgtcagcgtagataagatcgaagaacaccatatgcatagtgaattctaccgtttgacggaagaagcagctgagcgattgaaccaagtacgtaaaaacggcgggaaaatcgtggctgtcggaacgacttcgattcgaacattagaaacgattggaacgaaattcaatggagaaatcaaagcagacagtggatggaccgatattttcatcacacctggctatgaattcaaagtggtggaagctttttcaaccaattttcatttgccaaaatcaactttagtcatgttagtaagtgcttttgccggaagagaattgacattatctgcttatcagcacgcgattgacgagcgctatcgtttctttagtttcggagatgcgatgttcgtgaaataagactggttagaacgatcgtactctgagtatgaaaaagtcaagaatatctccgtaaaaacaaaaaaaagctgccgattttttaactggcagcttttttcgatgcttctattcgcagataattatacagttgcgtttctgctttgaaacacgtgttattactagaaacttcattaacgagtaataacattgaagaagttaagaactatctttatgatacaccaacttttcagcgacaatcgatcaatttttgtatgaaaaatgtagtaagatgcaagttaaaagataagaaaaatgcgtacaaataagaaaaagccgagctctcgataagctcggctttcttgtatctcggaaggattcaaataaacagaaatgattgtaactttccatcatacatgcaaagcacggtgttgaatttcttcatgttaaacaaaaattttgttttcgttacatcttcaacatttgaaacatctcttgttcctattcaattttcagacgtttacgttattcaattgttacgtatcgcattacttcttgtttcggatacttcgtgatccaaacatccatacgcattcactatttataggtttgtactctacacgcatgtctgggtgaaacctgtacttctaacaactttgtttgcttacactgttctatcgagaaattcttctgtttatttgatggtatcctccttccttacatctatataatagcatcttttggtagcgtttgcaaatataagtgctttggattttatgctttcttaacaaataatcaataagccctttggttgaagtaattaaaaaaaggatgttatagtaaaattagtacctttttttgtacgaagattttaaaggaggaataggatggaagaatacaagcagacaatagaagaagtaaggaaggttacggaagcagatccagatactgggttgtcttcacaagaagtggatgaacgtcgaaaaaagcagggattgaataaattcgatgaggcaccaaaagaatcgataatcaagaaattctttcgaagcttgtcggattttacaacgatcatccttcttatagcagcggtgatttccttttatactgcatttgctacagagcatggagatttatttgaaggactgttgatcatcgctatcgttgtgatcaactcggtattggcgatcgtccaagaaggaaacgcagaaaaagcactggaatccttgcaagatatgaataaacaaacggcaactgtcatacgtgacggcaaagtgaccactgttgagtcagagcaactggtggttggtgatattcttgttttagagtccggtgatgctatttctgccgatgcccgtttgatcgaagcatcacaattacgtgtagaagaatcggcgttgactggggaaagtgaagcagttgaaaaagatgcagcattcgtcgcaaaagaagatgagtcattaggtgaccaactcaatatggtatttaaaggatgtacggttgctgcaggtcgtgggaaagccatcgtcactgctattggtatggctactgaaatgggtaagatcgcggatcttttgaacgaaaacaccatgcaaaaaacacctttacaggtccgattgaatcagctaggcaaacgaatcagtatgatcgctttagcggctgcggctttagtatttgtgattggtgaattacaaggagaaccactccttgaaatgttcatgacttcgatttccttggctgttgcagctgtaccggaaaccttgactgttattgttacgttgacacttgcatacggtgtgcagaagatggcgaggaaacatgcgattatccggcagctaccagcagtagagactctaggaactgctaatgttatctgctcagacaaaacaggaacgctgacacaaaatgaaatgcgcgtccgccgagtctggagcaaagacgatgaagtaacgaatatcgaagactcaatgacgaacagcgcgatggaaatattgaaaatggccgcactatgtacagatgtgacggtcgaacaagaagatgacgaccttgttatcaaaggtaatccaacagaggtagccatcgtcagggctgttgaagagaattatcatacaaaagcagaattagaagaaaaatatccacgagtaaacgagcttccttttgattctgaacgaaaaatgatgacaacggttcatcaaatgggcgaaaaatacatctcaatcaccaagggagcattcgatgttctggctccgcgctttagttcaggcgatgtagaacaagcagcaattgttaatgatcgctttggtaaacgggcactgagagtgattgctgttggttatgctacttatgacgaagaaccgcaagatatttcttctgaagcattggaaaaagacttacgtttgattggcctgatcggaatgatcgatccaccacgtccagaaagtaaaggagcaatcaagcgagcgaaaaaggccggcatcaaaacagtcatgatcactggagatcatgtggtaactgccagtgccatagcgaaagaattaggtatcttgaatgatccgtcagaagcactctcaggatcagaactgcatcaattatcagacgaagaattagatgcgcgtgtcaaagctctctctgtctatgctcgggtaacgccagaagacaagatccggatcgtcaaatcttggcaacgtacgggtgcagtcgtagcgatgactggtgatggtgtgaatgatgcaccagcgttgaaagcaagtaacgtcggatgtgctatggggatcacagggacagacgtggcgcaaagtgccgcagatatgattctgacggatgacaactttgcgacgatcgtcgatgctgtcagtcaaggacgctcggtttatcagaatattcgtaaagcaatcaactttttgctaagttgcaacatttcggagatttttattgttttgattgcgatgctgttaggttggggcgcaccattcacagctgtacagttactgtttgtcaatgtagttgccgatggacttccaggatttgctttaggaagagaaccagcagaacacggcatcatggatcagcctcctattccgaaaaacgaagggatctttgctcgaggcttattgcaaaaaatcgccataaacgcaggggtcttcaccatcgtaactttgtttggttattatttaggtagttatgtcgatactatcagcccatgggtagacgcaagtcaacatgtcggtcaaacagttgcattcttgatcttagcttactcatcaattttgcatgtgttcaatgtacgcagcagtcaatcgatcttcaaagttaatttagcaacaaataaagcgttgtttgaaatggcgttactggcattagctattacaacggctgttgctttgctgccgtttacgcaagaactattcggcctagtacacatcagtttgaatcactggttcttggtagggattttgtctatcgtaccaatcgcggtcaatgaactgatcaagttccaccgattgccggaagcagaagaagaggaatgatcaactgtttctaagttgattttctttttactggaactatacaaaaaaggaggcgtgacatgaatgttgtcacacctccttttttgctaataggctgaatgtttcttttactgcctcttgataaacggtgttctcctgccaacccttcggtcacaagtcacgatattcatcaaacatgagaaactgttttttgtgactcggaattaaacggcaggctcacactctcttttaaatatcttttggcaattgttcataaaatgctgcttttgttgcagaaatgtatgggctgagccatagataaccgataccagcagttgctaatgctaagatatgccagccgataaatgaaagatctaaccagaaaagttttcctttgtaaccatccatcaattttcgacttgcggtgattgtatccagtactttaggcgtttggcctgtttcttggacgatatcataatagataaaatagctttgagaataagaatagcttttaatgattccaggaataactaataacaaaccccataatgttgtaaagattgaaatcaacacagctaaaccgatcactccgccgataaacaaacctttgaatccacgaaatgcatctttgaatggttcaatctgatctttttgaccacgtaaaacatcaagataagtccaagaaataccactcatgaacaaagcgctgataatgctagaaataattccaccaccacctcctgaactaccgcttcctgatgccatcgcatctgagacgttcgctgatccatcatatgtggcaatagcaaacaagataataggaatcataataagaagaatagcaacaataccaatcaatgtagggattagatttaataaaacagcttgaccccaccgaccttttaaactctcttttgcttggcgttttaattctgcagaagattgcatgattttcccctcctttctttcataaaaccaatataccatgtatcaaaaaatatttctgtcataatgtttttttcttttttgttattcatgaaaaaaagataaaaaaaagaatattaaataaagtagaaggaagccgagggaacttgcaaaaagcacttgaaacgattatgatggtgggagttgtcaagatattttatatagaaagtagggaaatgaatgacgcaacctgccattcgctatcgtttaatcaagaaagaaaaacacactggcgcgcgtttaggggaattgatcacgccacacggaacttttcccacaccaatgttcatgccagtaggaacattagctacagtaaaaacaatgtccccagaagagttgaaagaaatgggtgctggcgttattttaagtaatacatatcatttatggctacgccctggtgaagacttagtagaagaagctggcggactgcataaatttatgaactgggatcaaccgattttaacagattcaggcggctttcaagttttttcattaagtgatatgcggaatatcgaagaagaaggcgtgcatttcaaaaaccacttgaacggttcgcgtatgtttttatcaccagaaaaagcaatcaacatacaaaataaattgggctctgatatcatgatgagttttgacgaatgtccaccattcgatgaaagttacgactacgtgaaaaaatcagtagaacgtacgtctcgatgggcagaacgaggattgaaagctcatgctaacccagaccgtcaaggattatttggaatcatccaaggcgcaggatttgaagatcttcgtcgtcaaagcgcgaaagatctagtcggcatggatttccctggttactcaatcggcggattatctgtcggggaacctaaatcagaaatgaatcgtgtattagaattcactacaccgttgattcccgaaaacaaaccacgttacttgatgggtgtcggtgctgctgattcattgattgatggtgttatccgtggagtagacatgtttgactgtgtcttgcctactcgaatcgctcgaaatggcacatgcatgacttctcaaggccgtctagtagtgaaaaatgcgaaatatgcccatgatttccgtccaattgatgagaaatgtgattgttacacatgtaaaaactatacacgtgcctatatccgccatttgatcaaatgtgatgaaacatttggcattcgtttgacttcttaccataatttatacttcttgttgaatttaatgaaacaagtacgtcaagcaatcatggatgataatttgcttgaatttagagaagccttttttgaagaatacgggttcaataaagaaaacgcaaaaagtttctaaaggaaaatcttttaaaaattaagtaaaaaactagtgttagcagcatttttctgctaaagtgttttttgtagatacagaattagtgaggtgaaaaaaatgggatcattaccaatgcttgtgatgtttatcgcgctattagcaatgtggttttttatgtcacgttcgcaaaagaaacaacagcaagaacgtcaaaacttgttagatagcatgaaaccaggtgattcagtcgtaacgattggcggattacacggagttgtttcagaaatcgacaatgataaacggacagtcgttttagactgcgaagggatcttccttgagtacgatcgtgcagcaatcaaaacggtcaaaccagggactgtcgtaacaaatgatgcaacaacgactgttgaaacaacagaagaaccagctgatacagttgaagtaaaaactgaaacaacagaaacgctggaagagacagaagagaagaaagaaaaataagtatcaaagcttatttaaagacgaggtagggcagaaagatgtcctacctcgttttttgttcaaaaaagaaagagataagagcatgggatacattgctcaatattgaataatcgggtgtgtcatataaataataataaataactttatatatttttctatacaaatacttgtaaataaagcaattttgtatttaaaaataactgtgaaaaaaatcacaaaaaagtgtttacatagaaaaacaaatattgtatgatatacatgtgaatgatttaacaaataaccatgacccattaggaggataatgatggctaaagtaatggaaaaagaaaaaacgaagacaattgacgtacaagcaatgattgatggtttggcagaaaaagcaaatgtagcattgaaagaaatggaaagctttgatcaagaaaaagtagaccatatcgtgcatgaaatggcaatggcagctttagatcaacatatgccattagcaaagatggctgtggaagaaacaggtcgcggtgtttacgaagataaagcaatcaaaaatatgtatgcgtccgaatatatttggcataatatcaaacatgataaaacagttggtgtaatcaacgaagatgtccaaaaaggattgattgaaattgctgaaccagtcggtgtggtttgcggagtaactccaacaacgaatccgacttccacaacgattttcaaatcaatgatcgcgttgaaaacaagaaatccaatcgtttttgctttccatccaagtgcccaaaaatcttctgcagaagcagcacgagtggtacgtgatgctgctatcgctgccggagctcctgaaaattgtatccaatggatcgaacatccttcgatcgaagcgacttctatgctaatgaaccatccaggtatcgcgatcgtcctagcgacaggtggagctggaatggtcaagtctgcttactctacaggaaaaccagctttaggtgtaggtccaggtaacgtaccagcttatattgaaaaaacagcaaaaatcaaacgtgcagtgaacgatttgatcgtttcgaaaacatttgataatgggatgatctgtgcttctgaacaagctgtgatcgtggacaaagaaatctatgcagcagtaaaagcggaattccaagcacaccaagtttatatcgtaaaacaagatgaattgcaaaaattggaagatgcagtgatgaacgaaggaaaatatgcggtcaatccatcgatcgttggacattctgcgatggaaatcgctaaattggcaggaatcagtgtaccaaaaggaacgaaaatgctgattgctgaattggaaggcgtaggaccagattatccgctatcaagagaaaaactttctccagttcttgccatgatcaaagctaacaacacggaccatgcgtttgatttgtgtgaaggtatgttgaatcttggaggattaggacatacagcagttatccattcagaaaacgaagagttgcatgtcaaattcggtcttcgaatgaaagcttgtcgtattttagtgaatacaccatctgcagaaggcggtatcggtgatatctataacgaaatgattccgtcattgactttgggatgcggttcttatggtaagaactctgtttctcgtaacgtctctgctgtaaacttaatcaatgtcaaaactgtagcgaaacggagaaataacatgcaatggttcaaattaccgccaaaaatcttctttgaaaagaattctctattgtacttagagaaaatggaaaatgttgaacgtgtcatgatcgtttgtgacccaggtatggtccaatttggttactgcgatacagttcgtgaagtattgtcacgacgcaaaaatgatgtgaaaatcgaagtcttctcagaggttgaaccgaatccatcgacaaataccgtatacgcaggaacgaaattgatggcagacttcaagccggatacagtaattgctctgggaggcggttctgcaatggacgcagctaagggaatgtggatgttctatgaacacccagacacatctttcttcggtgcaaaacaaaaattcttggatatccgtaaacggacatacaagatcgataaaccagaaaagacacaattcgtgtgtatcccgacaacatcaggaactggttctgaagtaacaccatttgcggtcatcactgacagtgaaacacatgtgaaatatccgttggcagattatgcattgacaccggatgtcgcaatcgtcgatcctcaattcgtcatgtcagttccagcatctgtcacagcagatacaggaatggatgtgttgacacatgcaattgaatcttatgtttcagtcatggcttcagactatacacgcggattgagtctgcaagcaatcaaattagtctttgactatttagaaaaatcagtgaaaacacctgatatggaatcacgtgaaaaaatgcacaatgcttctacaatggctggtatggcgtttgctaacgcattcctaggtatttgtcactcagtcgcacataaaatcggtggggaatacgggatccctcatggacggacaaatgcgattcttttaccgcatattatccgctacaatgcaaaagatccacaaaaacatgcgatgttccctaaatatgactatttccgtgcagatacagattacgcagatattgcaaaattcttaggtctgaaaggcgaaacaacagaggaattagtcgaagctttagcaactgctgtttatgaattaggaaaatctgtcggcatcaacatgagtctaaaagctcaaggagtcacacaagaaacactagatacaaccgtagaccgtatggctgaattagcttacgaagaccaatgtacgacagctaatccgaaagaaccattgatctctgaattgaaacagatcatcattgatgcttacaatggataagcaaaagaaagcatagagaagagataaaaaaatagatgaaaaagaacttggaaaacgttgtttctccaagttctttttttgttttctaagtatttgaaagttacttttgttatttaacgtttaggtcaattttagacagtttttgttcaaaaagcgatatttatagtgaacggtattactgctatattaaggatataaaatgaaagcgtttaaaaaggtggcataaagatgattattaaagaagagatttttgtacctaaagaattagtgaaagaaaaaattgacctgctcgttgaaaacctgacaacgatcaaagacgataacggtgaatttttattggactttgatggattgaaagtagatgacaaaagctggacagtatggaattggccacaaggtgtcggattatacggtatttataaaaattaccagatgacaaaaaatcctcgcgcttatcaagtagtcaatgaatggtttgaagatcggatggaagaaggcgctccgccaaaaaacgtcaatacaatggccccattgttgacgatggcttacttgtatgaagacacgaaagattcacgctatttgccttatttagaacaatgggcagaatgggtcatgaatgacatgcctcggacaaatgaagaggggttgcaacatgccacatatggaccggaaaataagaatcagttgtgggacgatacattgatgatgacagtgcttcctttggcaaaaatcgggaaactgttgaatcgcccagaatatttagaagaagctcgttaccagtttatgatccatatcaaatacttgatggataaacgaacagggttgtggtatcacggctggacgtttgaaggaaatcataactatgccgaagcattttgggctcgtggaaactgctggttgacgattgctattccagagatcattgaaatcttagaactatcgaaagaagatgcattgcgcaagttgttgattgaaacacttgaagcacaagtgcgcgcattaaaaacttatcaatctgaaagcggtttatggcatacgttgttggatgatccttcttcttacgtagaatcttctgccactgcaggatttgcttacggtattttgaaagcggtccataaacgttatttgccgcaagaatataaagaagtcgcttatcgtgctatccaaggattgcttgaacaaatcgatgaaaaaggagaagtccaaaacgtttcaatcgggacaggaatgggggatagtttagatttttatcggaatatcggaatcacagcaatgccttatggacagtcgttaacggtgctttgtttgacagaattgctcgtctcttattgttaaaagaaaggaaacccatatgaaaaaaacatcactgctgtttgcagcaagttcgcttagcctaggtctgctaggtctaagcggctgcggaaataattctagtgtggcaactgtcgcagatgcagacgtaaatgggacagttaccttgcgctttgcttatgcaagcaacagccagccggtaattgatgcaatgaatgaatttgggcgtttagtaaaagaaaaaacagacggttccgtacagatccagtatttcccagatggacaactgggtggagaacgtgaactgatcgaattgacacagtcaggagcagtagatttcacaaaagtaagtgcctcagcgttggaaagtttctctaaagattattcgattttttcagtcccctatctattcaatgatgaagaacatttctttaaggtgatggataatgaagaaataatggaaccaatctaccaatcgaccaaagatttaggttttaccggattgacctattatgattctggtcaacgcagtttttatatggtagacggaccaatccatacgccggaagatttgaagggaaagaaaatccgtgtgatgcaaagcgaaacagctattaaaatggtcgagcttttaggcggttcgccagtcccaatgggaagtgatgaagtgtacacgtctcttcaatccaatttgatcaacggatcagaaaacaatgaatttgtcttgtatacagctggacatggcggggtagctaaatactattcttatgatgagcatacacgtgtgcccgatatcatcatcatgaatgatgctatcaaagaacagctaactgctgaacaggaaaaagcgattgaagaagcagcaaaagaatcgacggtttttgaaatcgaagcttttgccagagcaattgaagaagagaaagctttagcacaagaagaacatggagttcaattcaatgatgtagataatacaccgtttcgagaggcagtcgcaccgcttcatgatacattcaaaaacgatcctgcctacaaagacctttatcaaaagatccaagagcaaggagcgtagctgtaatgaaaatgattttaaataaggtgttagagatcctaggagctgttttgcttgttgggatggtcgctgtcgttttatggcaagtattttccagaacggttttaggaaatccgaatacggtgacagaagagcttgtccgattcggacttgtctggtttgctatgttgtcttctgcgtatgttgtgggacaaaaagcacatctagccgtaacggttttaagtgaaaaattatctggtaaaaaaagtaaaattttagaagtcgttgttcaaagtttgtttctggtatttgctacgatgatcatggtgtatggcggatggaatgctgtcacgttgacaatggggcagatctcgccttctttaagcattccgatggggtacgtctatttgtcagtacctgtctcagggatactcatcattatctatagtctgatcaatctaatcgatacattaagcaacaagccagcaattcaagaaaaaatataaaaatggaggaataaaatggcaatagaagccggattagtgttattttttgtatttgtcgtgttgcttgtattagggatgccgattgctataagtattgcattctcatcaatgatgactttattgttagttataccgtttgatgtttctgcttttagttcagctcaaaaaatggtgggaagtatcaacagtttttcgctcatcgctattccgttttttgttctttcaggtattatcgtgaataatggagggatagccaagaaactagtggattttgcgatgttgttcgtcggacgtgtaccgggggctttggctcatacgaatgtgttagggaatgctttatttggttccatctctagctcagccattgccgcttctaccgcgattggcggagtcttgatccctcagcaagtggaagaaggatatgaccggaagtttgcgacagcagtcaacatcgcgtcagctccgacaggtatggtcattcctccaagtactgcttttatcatgtattcacttgttgctggtggtacttcgatttctgctttgtttatgggagggtatctcgtaggtattttttggtcattagggatcatgctagtagcattcatcgttgctaaaaagaataaataccctgttgttgaaaaagggcagatggctcatgctggaaaaataataaaagaggcgattcctagtcttctattgattgtcatcattatcggtggtatcttgaccgggatatttacagcagtagaagcttcagcgatagctgtcatttactccctgttgattgctatgttctactataagacggtaaaactcaaagatatacctaatatgttgtttcaatcggtagcgatgtcagggacaatcatgttcttattagctacttcttccatgatgtcttttgccatggcatttactggtattcctcaggcaatcagttcgttgattatgggggtaacggataataaactagttattctgctgttagtcaatctcgttttgttacttgtggggatgtttatggatgtagcgcctgctatcttaatttttacaccaatatttttaccaatcgtcacaagtgcaggggttgatcctgtacattacgggttgttttcaatcatgaatctgtgtgtaggctcaattacacctcctgtgggtacagggctatatgtcggtgcaagtgtaggaggcgtaaaagcagaggcaatgctgaaaccacttcttccgttttatgggattatcctagtcgtcttgtttttgattacctatttcccgcaaatcgtcatgtggctacccaatatgctgagttaggagaataattatgttgaacattacaattagaggacatgatctttcccaagtccaaacgatagaagatcttgcagaaaaaacaaaagaacaaggaatccatacactgcagctcgccttaggtctttcgtttcctgaaatgtcttctggcgcaaacgaaatcaattctgggatgggaaattatgtcaaacgagtcttagaaaagcaagaagtgtccgtaggaattttaagctgctatatcaatatgattcatccagatttaacgatacgagaagagttgctgacaaagttcgagcagtatcttcactatgcttcttcctttggtgcgtcgatggttgcttcggaaacgggatgtgtcttgccggaaatccaatatacggaagaaaatttcacagatgaagcatttgctgaagcagtgtccgttatccgtcgcttggtaaaagctggagaaaaataccaaatgatggtggggatagaaccaggtttgaatcatccggtgtattctttagcaagagtagagcagctgatccaagcagtggattcggactatctaggaatcattttagatccgacaaatttgatcacaagcactaattatcaagaacaagtccaattggtagaagaagcttttgagcgttttggtgaaaagatatgtgcggttcatttgaaagattttcgtgtcgaacaggaaaaaatcgtgccggtaaatttgggagacggtgtgatcgagtacacaaaaatcaaagaaatcatcaagaagcaccgtccgtatctgtatgtggttcttgaagaaacaaaaaatgatgggattcgttatggaagaagtcttcttgaataatgtaaagaagacattgattaactaatatttagaatggagggggcggggctagaagatgtcacgtctcttctttttttataagagtatataaaagcagctctttttgattacaaaaaacgtgatataatataattgtgcaaaactgaacaaaggaggtgcagcacatgctccaaaagaaaataagcggtgagcaagtcaatacgatggtttctgatcagtatgaaatctatcatgtcaaagatgtcgtcagccaaaataaaacaatctaccatcaccatgatttttatgaaatccatgctacattaaagggtgaagcgactttttatttgaatggacggcaatttacgatcaaagcaggaagtgtgctgctcatccattccaacgatttgcatcgtatcgtccgccagtcttcagatgtattcgagcgtgtctatatctttgttaccccttcttttctggaaagtcgttccacgccatggtctaatctatcggcttgttttcaaccaatgggagagaaaaggagtcgtgtattgcaagtggaacaggaagtattgaagcaaaaattatcatttatcgaccaccctcctgataaaaaaatttacggtgaagacataaaatatgaacaagctctagtagaatacttgatttttctcaatcaagtagtacaaaaagaagagagtgcgcaagaacagaatgctgtagttccaaatgagcgtgtggaacaaatgttacaatatatctcaaaaaatttatctcatccgctttctttagaggaaatggagaagcaattttttgtcagcaaataccatatcacccgagaattcaaaaagtacactggatttacgtttcatcagtatgtaatgaagaaaaagctgatctatgccaagcacttgttgcgagagtaccgtagttctagtgctgtatatagtaaaagtggtttttcgtcttatccacattttctgaaagcattcaagagagagtttggtataacgcctaaagaatttttgaaacgcgatacgcaaaaccagcttattcattatgaacattttgaagatgaaaaatgagaataaccacccccgaataaccgaagtagctgctgttgtttatatagaagcagaaactgcggttattttattattctactatatcttttaaaaaagtgcgtacatattatatgaatcagctaaatttacgaaaatctctcggtgataatccagtttttgctttgaacaagcgactaaagtaagcaaaattctcgattccgatttcttcggaaatcattcgaatagtaaattctgtataccgaagaaggtctttagcgtaagagagttttttgctgattaaataatcaattggcggagaaccgatgaatttggaaaaatctttgctcagctgatatttattcagtaaaaattgctgttctaattgatcaagtgtgatcgtttctttgaagtgttcgtccaagtattgcttaagcttataaacgtaagggggaatatcttcttcttcgaaatccagttgatacttctgcaaaatcagttcattcaacagctcgtggatagctacagaggactggaaatcggtacgggcattcgcaccttgctgcatgtggatcaattctgtgatcagatgatggatcttgttttctgatggatcgcctgtcgaatggaaggtgttatgcccgtcttttgtgaactcttgataaaatgattggacgctctgaccattcaaatgaatccaatccatttcccatggttcttcgctaatcgtttgataacgctgatattcttggcagtcaataaaaaagaggtctccagcttttagctggtgctgattatctttatatgtaagcaaaccttcgccagacaaagtaaattttatcaaataagaaggtaaatatgctcgttcagtatagtaagggaccggcgctttaaagtaaccgatttcttggatataaaaaaataaattcctacttctttgcgtaggtgtcaagatcactctttttgagtcttccgaccatgagtgattggctttttcccagtaatccatgtaaacactcccaacttgtcaagataatgcaattatataccaaaatagtgtgaagcaaaatataagtttatgtaatatgatagcattgttaataaatgataacgctttattaatggagtgttaatcaacaataaagtaaaagaggtggagaaatgaatccgacatttgttgccatcgatatcggtgcgtcaagcggacgactaatgaaaagtacgaggaatgatgaaggttctttagtcttggaagaagtacaccgattcaagaacggctttcggaaaaaagacggtcatgaccgctggaagatcgattatcttatcgaagagattttgattggatttgaaaaattaaagaaaacaggaatcgagcgttgttttgcagggatcgatacatgggcagtcgattactgtttgattgacgaacaaggggaacggatgaatgatccgatcgcttatcgggacgatcgtaccgatgaagcagtaaaacagttttctgaaatctattctctagataagttgtatgagcaaacagggattcagatccagcctttcaataccttatttcaattgtttgtcgaagaaaaagaccatttggcaaaagcacataaattattattgattcctgattatttaggctacgtctttactggcaatatggtgacggagaaaaccaatgcgtctactatgcagctgctgaatgcaggaacaaaagagtgggaaacagaacttcttgaaaaagttggtgtctcgaaagaattatttcctccattgacagagccgggaacgatactaggagatttgcaaaaagaaaaattctcaaaatatgatttgccagatgtgacctttatcacagtagcaagtcatgatacggcgtcagctgtattaggcacaccagggcaaggagaacagtggggctatatcagcagcgggacatggtcgcttttagggatggaaacaaagctcgccaatgtttctcgcgccgctttttctgagaattacacaaatgaatggggcgctcataatacggtgcgtttcttgaaaaacatcatggggatgtggttgatccaggaagttgctcgaatgcaggagtacgaatacagttacgcggaattggcagaacttgctgcaaaagaaaagccgctgcaacaagtgatggaaatcaatgaccctcgatttttgaatcctaaaaatatgatagaagagattcagcaatactgttttgaaacagagcaaccagtccctgtctcaccgggagctatcgctcgttgtgtgtatgataatcttgctctttgttacgcacaagagctgatcaaagtagaacacttgactggaacgaaattggaaaaactgcacatcgtagggggcggatcgaataatcgcttactgaatcaattgacagcagattatgccggaatcattgtagaagcaggtcctagtgaagccacagcaatcgggaatattgccatgcaaatgctcagtacaggtcagttttcgaatatagaacaagcaagaaatgtaatcaaacagtcgtttccatgtgaaactttttacccagatggaaataagcaaaacacgaatgaatggtacgtgaataaaatcaaaggagtaatcgtatgaacacgattgaaagaaattacgaacaagcaaaagaaaaatatgcaactatcggtgtagatacagatgctgtactagaaaagatgcagaacatcaaaatttctatgcattgttggcaaggagacgatgtcaaaggtttcttgacaccggatggcgaattgactggtggaatcatggcaacaggaaatttcccaggagctgcacggacacccgaagagcttagacaagatttggagaaggcatattcgttgataccgggcaaacataaattgaatcttcatgctatctatttggacacagaagaagcggtcgatctcaatgagattgagccgaaacattttgaaaaatgggcagagtgggcaaaaaaagaagaaatcggtcttgatttcaacccgactttcttttcgcatccaatgatgaaagacggctttacattggctcatccagataaagaagttcgtgaatactggatcgaacacgggaaaagaagccgtaaaatcgcagaatactttggaaaagaaactggacaaacatgtatcaataacttttgggtacctgatgggatgaaagacaatccaatcgaccgttttaccccacggaaacgtttgatggaatcgctcgatgaaatttttacagaagagctagatgaacggtatgtacaagatgcagtagaaagcaaactatttggtttaggcgctgaagcttatacagtcggttcccatgaattttatatgggttatgggttgactcgtgacaaacttgtttgtctagatgctggacattttcatccaacagaagtgatttccaataaattgtcttccttagctttatttagcaaaggaatcatgttgcacgtttctcgtccagttcgttgggattcagatcatgtcgttttgatggatgatgaattgcaggaaattgctaaagaattagtccgtaacgaattattggaaaaaacgaatatcggtctggatttctttgatgcaacgatcaatcgtatcgctgcttgggtcattggtacgagaaatacacaaaaagcattgatgaaagctatgctggaaccagttgagcgattgaaagaaatggagctggcttttgactttacttcaagaatggcttacacggaagaattgaaagatttcccgtatgccgatgtatggaattatttctgttacaaaaatcaagttccagttggtttggattggctggaagaagtccaagaatatcaaaaagacgtgttgggattaagaaaataggagtgtggctatattgaaaaaaatagatattttacaagcgccttatgtgaaagaaatgattgaaacgacatcgaatctttatcgcttgggttgggatgaacgaaatggcgggaatatttcttatttactcaaagaagaagaaatcacaccgttcttggatcctgaaaaagtgacccgtcgcatctcgatgatttttgatgccagccgtttagcaggatgttattttattgtaactggttcaggaagatattttaaaaatgtagcgagcgaacctgccgaaaaccttggaatcgttcgagttgccgaagatggcaaaacattagagcttttgtgggggttagaaaatggctgccttcctacaagcgagttgccaagtcattttatgagtcatatcgcccgtttagaagtagacccagataatcggatcgttatgcattgccatgctagccatttattagcgatgagctttacgcatgaattagacgaacgttcctttagtcgtacgctgtggcaaatgtgtacggaatgtttagttgtttttccagaagggatttccatcattccgtggatggttccgggaacaaatgagattggagaagcaacagctgaaaaaatgaaagaaactcgattggttttatggccgcaacatggaatctacgggtcaggaaaagacatggatgaagtctttggtttgatcgagacagcagaaaaggcagcagaagtctatacgtacgtcaaagcgcaaggaccaatcttgcaaacaatcacagatgagaatttgtggcgtttagcagatgcgtttggtgttactccgaaagcaggttatttggaggaagttcatacgaaagtaggtgtctgacatggtgaaaaaagccttttgcatgaaagtttacccagaaaaacaagaagaatacaaaaaaagacatgatgaactttggccagagatgcgcacagcacttcgtgaacatggggtcatcgactattcgatctatcttgatccgagtacaagtttattatttggttacttagtggtcgaggatgaagagttatggggaaaaatggcaaatacaccgatcaatcaaaaatggtggaaatacatggaagatatcatggaaacaaatccagatgcctccccagtcagccgtgaattgacgccagtctttgaactgtagaaacaagcaactgggcaaccggttgcttgaggttctttcgttttaattgtgaaaaataatacaaatcaggaggaatagaaaatgagtaatcgaatgattttaaatgaaacatcgtattttggaaaaggagcgattgagtcaatcgttcccgaatttcagcagcgaggattcagcaaagcagctgtcattactgataaaggattgatcgaacatggcatagcgacaaaagtaacaaagcttttggataatgcagcaatcgattatgctttatacgacgggatcgtacctaacccaacaatccaaaatgtaaaaaacggagtggcttttgttaaagaggcagaggcagactgtttgatcgcaatcggtggaggttcgccaatcgatacggcaaaagccattgggattattttgacgaatccagagttttcagatgttatcagcttagaaggtgttgctgatacaaaaaatccatgtttacctatcttagctgtaccaacgacttctgggacagcagcagaggtaacgatcaactacgtcatcacagatgaagcaaatcaccgaaaattcgtctgtgtcgatcctcatgatatcccaatcgttgcgttcatcgacagtgacatgatgatgggaatgccaaaaaaattggctgcttcaacagggatggatgctatgacgcatgctatcgaagggttgatcacaaaaggcgcttgggaaatgactgatatgctgcatttgaaagcaattgaaatcattggtcattctttggaagcttctgtagagggtgatcaaaatggacgagaaaaaatggcattaggacaatatattgcaggaatgggcttctcaaatgtaggtttaggactggtacatgggatggctcatccgttaagtgcatggtacaacatcccgcatggtgtagcgtgtgcagcgctcttgccaacggtcatgaaatataacaaagaatatactggagaaaaataccgtgaaatcgctcttgtgctagggatcaaaggagcagctgaaatgtctttagaagatgtaagagatgcagcttgcggtgagatcgatcgattgagcaaagcggttggaatcccagcgaccatttctgagttaggtgtaaaagaaacggatatcccagcaattgcagaagatgctttgcgagatgtatgtacaccaggaaatccaagagaaacgacagtagaagaaatcattgccttatatcaaagcttgatgtaaaaacgaagcggatctttaactttgagttgcctataaagagaaatagcagtttgtatccggttctctcttttaaattgatgatatttccgctataatttttcttataaagaaataggagaatattatatggaaaataaaaaaccttatggaactgtattgatcaaagcttctaaaatactagactatttagcagaaaatccagacatctctttgcagacaatcgcaaagggtgtgggaatgacttcttctacagtcttgaaaatactagatactttactgatgatcggctatgtaaataaaaattcagagaaaaattatcgtttaggtgcaaagcttattcgctacgcgaataaaaacattgaacaaatcgatttggtagaactgactttaccatttttagaacagttgcagcaaaagatcgatgagactatccacttaggggtattggacaacaatgagattttgtacgtgaacaaactagatccaaaacatcaaacgatccgtatgtcttcaaaaatcggaatcacccgaccattatacaattctgcgatgggtaaagccgtattagcagaattcagtgaagagcagtacactgattatcttgaaaaacatccgttgattccttacacggagtacacgattaccaatgccttgcgtttgaaaaaggaaatccaaacggtaaaagaaacccacgtcgcatttgacgatgaagaaatcgaacgtgatattttttgtataggagcctcaatcgtgaaaaacgaacaaatcattggtgcatttagtgtaagtatgccgaaatatcgtttgacagatgagacaaaagaacaaataatcagtgccctcaagcaaacaaaaagcgaaatcgagcaaagaattcaaaaataacgaaaaaagcgtttgcattttttcttttctgccgtataatatgggtatagatttccaagttataaaataaaatttctaaataggaaataggtggagaagatgaaaaaaattgatattttatctcgattgaaaaacgccggagtgattgcggtggtacgcggaaaaagtaaagaagaagctttgaatgcttgccacgcaatcatcaaaggtggtctaactggtattgagttgacttttacagtccctcaagcggatcaagtaatcaaagaacttttgtcattctacaaaaatcaaccagaaatagtgattggcgcaggtacagtattagacgctgtcacagctcgcttggctatcttagctggcgcagagtatattgttagcccttcctttgatcaagaaacggcagagatgtgcaatctgtatcaaatcccttacttaccaggatgtatgacgattaccgaaatcaaaacagcgctgaaaagcggggtagatatcgtcaaactatttcctggaagcgcttatggaccaagtatcatttctgccttcaaggcaccgatgcctcaagtcaatatcatgccaactggtggtgtgagtctggacaatatgaaagagtggttcgatgcgggtgtcgtaacagtcggagtaggtgggaaccttttagcacctgcagctacaggagattttgacaaagtaacggaagtcgcgcaacagtatgcagcaaaaatgaaagaaatcaagaggtagctgcttatgggaaaagtagtgacactcggagaaatcatgttgcgattgtccacagaacagggaacccgcatcgattcaagtgaacgattcgctgcccattatggcggaggggaagcaaacgtagcaatttctttagctaattacggacatgacgcggtttttgctaccaaagtacctgataacgcattgggaaaagcagtcaaaaagcacttgcaatgctatgaagtagatacgaaacaagtattatctggcgggccaagactaggtacttattatatggaaactggtagtggcgaacgcgccgcctcagtgatctatgatcgtgccggatcaagctttgctgaaatggatcatttggaatggtcgctagaggagttattccaaggaatagatatatttcatgtttcagggatcaccccagctttgtctaaaaaatggcaaaaaatgacgaaacaagtgatagaagttgcaaaaaaagctggctgcctgatcagcttcgatatcaattatcgcgggaaattatggacacagaaagaagccagcgaagtaatccatcagcttttacctttagtagatatctgttcagctggaaaaatggatgctctttatttgttaggtatcgagaaagcaccagaatcagaagaacaaccgctgatttattattatcaaaaaatgcaggaaaagttcccgaatattcaggtgttttattcgaccaaacgtaccgttcattcagcaagtgaaaatgaattgaaggggacattgtggatgaaccatgaatatgtggaatcccaagtccatagaatcaccccaatcgtggatcgagtaggtggcggagatgcttttgcaggtggcgtgctccatgggattttatccaatatgcccccgcaagaaatcattgattttgctacggcagcttctgccttgaagcatacgatccatggggactgcaaccaattcagtcaagaagaagtcgcacaatttttagcatgcggctctggaaaaatcattcgatagaaggagtagaagaaaatgcaagaaatggaaacacgttatacacacagtccagaagatatccgtcattattcaacggaacaattgagaaaagagtttttagtagaaaaggtattcgaaccaggaaaaatcagtttgacttatacacacaacgatcgaatgatctttggtggcgtgacacctactgaaaaagaattagaaatcacattagacaaagaactaggtgtcgattacttcttagaacgtcgcgaactaggtgtgatcaatatcggtggactaggattcatcgaaatcgatgggcaaaaagaagaaatgaaaaaacaagacggctattatatcggaaaagaaacacgacatgtcgtattttcttctcaagatgctgaaaacccagctaaattctatattagttctgttccagcacatcataaatatccaaatgtaaaaatcagtattgaccaagtaaaaccaatggaaactggtgaaggtctgacattgaatgaacgtaaaatctatcaatacatccatccaaatgtatgcgaaagctgtcaattacaaatgggttatacgattttagaaccaggaagtgcttggaatacgatgccttgtcatacacatgaacgtcgtatggaagcttatgtctactttgattatgccaatgaagatacacgtgtgttccacatgatgggcaaaccagatgaaacaaaacatttagtcgtagacaatgaacaagctattatttcaccaagctggtcgatccattcaggtgtaggtacaagcaattactcattcatctgggcaatgtgcggagaaaacatcacctatacagacatggatatggtgcaaatggatcaattaaaataagcataagggagagaaaatgatggaatttaatatggatatgtttcgtttagatggaaaagtagcattagtcaccggtgccgtctatggtattggatttgagattgcacgctctttagctacagcaggggcaaaaatcgtatttaataatttgaatcaagaatcagttgatgaaggtatagcgcattataaagaagcgggcatcgatgcaaaaggttatgtctgcgatgtaaccgatgaagaagcggttcaagcgatggttcagcaaatcaaagaagatgtgggttcagttgatattttagtcaataatgcagggatcatcaaacggacaccgatgatcgaaatggatgcggctgacttccgtcaagtgatcgacgtggatttaaatgctccatttatcgtttcaaaagcagttattccagatatgatcgaaaaaggcggcggtaaaatcatcaatatctgttctatgatgagtgaattaggacgcgaaacggtcagtgcttatgctgcggcaaaaggcggattaaaaatgctaacgaaaaacatcgcttctgaatacggtcaatacaatatccaatgtaatggaattggaccaggttatattgctacaccacaaactgctccattacgcgaaacacaagaaaacggtgaacgtcatccattcgatcaatttatcgttggacgtacgccagcagcacgttggggcgagccaatcgatttggctggaccatctgtcttcttggcttctagcgcatcggatttcgttaacggccatgttttgtatgtagacggcggcatacttgcctatatcggaaaacaaccttaaacgaggtttagtacactatttagtggagaggttatgaaatcagcagcttgaacgaataccgaaggacagctgattaaatatcatttatccaaaaaaaggagtatgacgtaaaccagtcatactcctttttctgtgcgtcttccatacttcactaagtcgatccctcttgcttcacaccaatccttcactggaccggaaaagatgagagattgttggtggagggacgcggtattcgttgcgccgaccatggtataaagcagacgaagttcctcttgccattgtttcatcagcataatggtttcttccacgccatgattcatcagatgagtcaatacagttcctgaagtgcccactgcttttgcgccgagacaaagggctttaaatatatcataggcattgcggatacctccggaggctaggatttccatagaagtgtctgcttcatttgcttcaagcaatgaggcgactgtcgattgcccccaatcagctagataattcagttctcgcttggagcgacgggcgttttcaatctgggtgaaacttgtcccacttcgaccgctgatatcaactgtatgaacccctaaagaagctaaatcattgatcgtttctcttgtcatgccaaacccgacttcttttacgataaggggaacgtcaatggctgtttgaatctcttggataagtgctttccagttagtaaaatcacggtctccctcaggcatgaccaactcttgaggtgcattcaaatgaatctgtaaggcatctgcgtgaaacaatcggatagcttctcgggctctttcgacagaagttcctgcaccgatgttggcaatgattttcccgtgaggatattcttgtcgcataattgtataagtatcggctaaagaagggtccttcaaggcagcgctgactgaaccagtggcaatcatcaaatctgcttctcttgcgacgattgcaagatcttggttgattttttttgttttttcgcttccgccagtcatcgcattgatataaaacgggctgcttagtgtaaacccagctgcttgtgtacttagatcgacatcagcaactgctgtttgtggcaaagggttatgaatgacccgtacgaaatcaaattcatttttttgcttattatgaaaggctttagctagtgaaacatgttcatcttttcgattcatcggttttcctttctttgatcgctatagacatgtaacggtaggggggtgatttctgctttttcccatgcactcattaaaggaaggatgccagatttctgatcaacgattacgatgccgcaatccccaccacctgcaccggaagactttgcagccccttcatactgttcagctaaattacataatttattcaaagcaggtgtttcgataacaaccccggtgatagccgataaatcatgcagtaattgtcggttttttcgaatcatctgttggatcaacgtaacattatcttctttaaaccctttgatcatttcgttgacgcattctgtactgttttttaagaaaagctgataagccaccattttatcttctctcgaacggtgaacttgatcgaccaaatcagaggtagaggcagggctacccgtccaaccaatcaataaacgtagatcttcaggagcaatcaatggctcaattgagagacctggccaatccatggcaagtaactgactgatggaatgctgagtttcttgttcttggagccaaggatggtcgaaggtcgagaaggcgatccagccaccataacagctagcagcgatgtcgccgcaagaaccattatcttgaactgctaaattagcgagtgctgcgatcttgaaaatctctagctgagataaattcaatgcgtaaaaaacattcaaggctttgaccgttgcaacagtaacggcgccgctagaacctaatccgtatttccgaccatttgaactgtctagctcgcttgttactttcagatcataaaaggataaaagaatgtttttttcttgtgcatacttttcagtcaatcgaatagcagcaaggatataatgaaaaggattttcccgaatatctaaaactaattccccgttacgtcttgtccaacgtacaggcatcccgctatattgtgcagattggatacttccgacttttcgtgcggactctacagtgactgtcacgaattgatcgactgcagcgataactgccggatgacctgtttcaacaactgcatattctccggcaatatagagtttgcctggtgcagatacttcaatcataaaaatctccctttattcaataatcgcaattcctggaccagcgtgggcagtaattacttgttctttgctaaataatttagtaaatgtttcttgtacctcagataaatggctgttttccactaaaactttgacattagggccagcatccatcgtaaagtagcatggaatgccttgctttctcaattgccgcaccgcatccatcgcttttaagctgtcaggagaccagtaagtgaaaggtggttgggcagctaaagtcgttccgtgcatttttagtccgtttctttccatcgtttctccgagaagttggaaatcttttgttttgattgcttgtttcaattgatatagatccccttcaacggaatctaaccagccttgataaaaactggatgtttcgactgtccgacgcatcccatttctgctagacacttcttttttctgatcgttgatcaaaatgaaaaccattgctagatcgtcttcgaaagaatcagaagggactggtttggcataagagcttaagtcatcatgacctttttcccattcgacgaaaccaccaaaaatacttcggcaagctgaaccagacccgcgtcgagcaaatcttgaaagagaaagatcgtctaatccaagcttaagggcagtattacaagcgcctgctaaagcagctagcccgctagcagaggatgctaatccggctgcggtaggaacgaaattctgactgattactgaagcttttagtgagatgccggcttctttacgaaaaaggtcaagaaactgactaactttttttgttgctttttcgtcttgcaaggtgtcatctagatagaattcatctgctatatagctatcagaaaagataacttctgtttcggtataaaatgcatccaatgtcaacgaaagactgttgttcatcggaaggatgagtgcttcatttttcttaccccaatatttgattagggcaatgttggtatatgcgcgtgctttgcctttaaacataggtatgtactcctaatccttgtatccaagtttcagccgcacccacatcttcaagtgcttgactgatttcttgggcttttgtttttgtttgtgctaatgcaatcatgcagccaccgcgtccgccgccagttaatttagcccctaatgcaccggtatctttagctgtttggatcagtaaatcaaggaaatcgttgctgatcgtcagtttttccagaagtgattgtgattcatccattgtttgagctaacattcctggtgaattttcaatgattgcttgcttcgcttgctttgtcaagtatcctaatttttgaatcatttgtccagtttcatgtggttgtctttcaaacaggtgagcgacatctttgacggcttctcttgtttgtcctttgattcctgtatcagcgacaatcaaaaaagcatcaatattcaaagaaaaataatcaaaaggatgcccttttgtaaaataaattggctgcaagctgctagtagcggctgcatcgatcccactaggattaccatgtgcgattttttccgaaagttgtacattctctaatagtatttcacgagacaaagggagtgctaagtaatcataaaaagcacgagtgactgctgtggcgaccgcagcacttgatcccattccacgttcagcaggaatcgtgctttcgatggttagttgcaagtttttatggatatcatgctctttttttaaatggatgaataattttttgatattttttaatgtatgaggagcttcggctaaatttcctgaatagtaggaagaaaccaattgatcgtccattgcatccagctcttcaaggaatgcggtgacttttgttgcataaaaaggaaaggcaatcgccggttctccataaacaaccgcgtgctcgcccatcaagataatctttccgcttgattctccttggccatagtttgccataatctaactccttctcacgtaaaagtgatttttaagcaaaaaataaagcgcccaaaacgagttgcgctgcttcacgaaattttttgtccgctaagggtctcaaaaaacattccttctttattttactaaaatcatcccagaagtaaaactaagaatacgttttctaaaggaaaaacccttttttcttaagaattttttgacctttttacttttttgactagaaaaaaatacgattgacactactagatattgggggtatatttaaaaaggttggagttaaacacaatatttagtgatgaagtgagctggaggtaaatgagcgtgatcgttttagcaggtacaattggtgccggaaaatcaagtttgacagaaatgatggctgaacactttgatagtcaggcattttatgaatcaattgatgataatgaagtcttgcccttattttatgcaaaccctgaacagtatgcttttttgctgcaaatttattttttgaataaacgttttgcaagcatcaaacaagcaatgaaagatgacaataatgtattggaccgttcgatttatgaagattcgctgcttttccatctaaatgcagatctaggaagagcgacggaaacggaagttcgtgtgtatgatgaacttctggaaaacatgatggaagagctgccctatgctgcccataaaaaacacccggatttattagttcatattcgtgtatcatttgatacgatgctagaacggatcgagaaacgtggtcgttcatatgaacaattgtcctttgacccaagtctgtacgattattacaaagaattgaacagacggtatgatcaatggtatgaagaatacaaagaaagtccaaaaatccaaatcgatggagatcgctataattttgtggaagattctcaagcaaaagaagaagtcttgaaaatgatcgaagaaaaattagcagaaatccgccaaactgaattagccatttgatataaagctactcaaaaaaaggatgctcctttatttgagtagcttttttctttatactagaaacaaatatcaggaggatggagtatgcgggaaaaacactattttaatcaagaacgtaatttttggatcaatatacagcaagatgatgtgctagctgttaaaaatttaaaagaagaatatggcatcagcgatgagatgctgacttattctctagataaaaatgagcgggcgcgcgtagaatatgactcttttgatgaagcgttactacttgtatcaaatgtcccacaccaacaaaaagtcgataatcattacgaaactagccctatcgcttttattttaaaagaagatggtttgtttacatttaccacgccgaataccgagtatgtgattcgactgattcgatcacttttggagcgaatgccagacatgagtgtatacagtttattgtttcgtacattatttttaatttctgattccttttttcctttaatcgaggaagtaaatagcgaacgtcaacggctcaacctaaagttaagggaaaaaacaacaaacaagaatctactgcaactttcagatttagagattggtttggtttacttagttacaggaacaaaacaaaatgtagtacttttggaacaaatcaaggcattggccatttatcgcaagttgtcagaaaaggaaaaggaagagttggacgatgcactgatcgaagcacgacaagcagttgaaatgacgaacttagcttcgcagattttagatcagctttctggcacttataataatttgctgaataataatttgaatgacacgatgaagtttttgactgtctggtcgctgatcttgactgtaccgactattgtgacaggatttttcgggatgaatcttaagctaccatttacccattccgttttcggatggggaatcgccttgatcatcagtctggttttatctgtttggatgctcattgcactatgtaggcggattcgttgatctagtctttgacctgcaaaccaagggcttgagcaatcacaagtgcttgctcctggttgacgatcagtcctgccaaataatcttgagataaagcaatggtagtgaagaaattagtcgtaaagtctaatcccttcagagaagttcggaaccaattcgaaccagttaactgattgtcagacaaaaaaagatttttccaagtgacctcataaaattcgctgtcttctaactggcaatgatcgaaggatacggctttcaagtttgtgctgctaaaggaagccatcgaagcaatgcagtcagtgaaagtgcagtctctaagataactttcggcaaaattcgtacctgttaatttacattgatgaaacacgacttggtggaaactgccaccaatccactccagattggaaaaatcacacttttcaaaaatgacattactgcattcaaaatgacgtaaaactgttttttgcatggtcagtttttggacatgactctctcttaataccatatttttagcatcaagatagctttgatcacctccattgatcagaagaccagagaggatttcttcatcttctaaataaaaatctccttttgtcagaggaggaagagaaggtgggataggttcgatttttttcatgtgggttcacctcgtttttctttagtatagcaaagaagtgggagtcactgctagaaagtctgctagaccaatcattttcagaaaaggaagaaaaactgtatgaaaaacattgacataaggattggtttttgctatactatgatggttgagaaataaaagcagaagcacccgcttctcgccttagttgataatgtcactgggctagatagttttcactggttctattaggtgaagtacgcgcgggttctgtaagagaactcgtttttttattgccgtttattcggtaagcttttctttctctcataatatttggaggtgaatgaccatagcaaaggatatgatggttaacgacggcattcgtgcacgagagttacgattgatcggttcagatggtgagcaattaggagttaagacaaaagcagaagcattgaatattgcagaacaagcaaacttggatcttgtgttagttgcccctggtgcgaaaccaccagttgcgcgaatcatggactacggtaaataccgtttcgaacaacaaaagaaagaccgcgaagcgcgtaaaaaacaaaaagtgatcaatgtaaaagaagttcgcttaagtcctacgatcgacttgaatgacttcaatacaaaacttcgtaatgcacgtaagttcttggaaaagggcgataaagtgaaagcttctatccgtttcaaaggccgtgccattacccataaagaaattggtcaaaaagtcttgaatcgcttagctgaagaaactgctgatattgcaacagtggaacaaaaagcgaaaatggacggacgcagcatgttcttgacgctggcaccgaaaaacgacagtaagtaatttgaatgactaactggctgttggacagccgatagtcggataacgaaagattttgaggaggaaatatagtcatgccaaaacaaaaaacacaccgcggatcagcaaaacgtttcaaacgtactggtaaaggcggattgaaacgcttccgcgcgtttacaagtcaccgtttccacggcaaaacaaaaaaacaacgccgtcaattgcgtaaagcaagcatggtttctagtggcgacttcaagcgtattcgccaacaactagcaaaaatgaaataagaagtacaaataacagaatctgaagatttatttttattaggaggaattatacatggcacgtgttaaaggtggaacagtaactcgtaaacgtcgtaaaagagtgctaaaattagcaaaaggttactacggttcaaaacacactttatttaaaacagcaaaagaacaagtaatgaattcatacaactacgcatatcgtgatcgtcgtcaaaagaaacgcgacttccgtaaattgtggattgctcgtatcaacgcagcagctcgtatgaatggcttgagctactcaaaattaatgcacggtttgaaagttgctgaaatcgacatcaaccgtaaaatgttagctgacttggctgtaaacgatgcagcagcatttactgcattggctgaccaagcaaaagacgctttggctaaataagctaaacaattataaagaggaaagaagataacgaaaagttatgttctttcctctttttttgtttccaattcttcaccatagaaaacgggataacaacgtataagtctaaaatagcataattaaggttttttaattgaaatccgaacatttatggtcatcctctaatgaaagcgctaactacataagctagaatgaacttaactgatatattagtttgtttatcagaaaaataaaatggacggaggaataacatgagtgatattattattggtattttgttagttatctcattctttttcatggtctggtactgtgtaaagggctacaacttgatggtcggttttgccatcatggcgactgtatggatgggattagcactagtgggaaacacgttttcgccgaacccggcgatggaagggcaaggagtaatcgatgtattgacgcatatctatacgactggacctgctgagtacgcgaaatcgatcttggtaaatgtcttctttggtgcctttttcggtcgtgttctagtagatagcggaatcgcagccacattgattcgtaaagtagtcgaacttggaggggacaaaccaagaatcacgatgagtttgctgtgtgttgtaaccgctgttatattcatgtcgatgacaggaattggaccagtgatttctatcgcagtcatcgttttgccgatcttgatgtctttaggaatctcagtaccagttgcgttgttctcatttatgggctcgatcatggctggaatctttgctaatatcgtcaacttcaaacagtatcaaacgatttatgctggtttcaacccagcagctgaaagttacacttataacgactatttccaaatcggtatgattgggatggttgtaagtttagttgttgtactaacggtggctaatatatcaatgaataaaaagaaacgctatgcaatggcagcaaacgtaccggctgaaggtggcgacgcaccaatgatctcatggttagccgtattattaccagttttaggggtcgttttgttagatcttccaatcatcttaggttttattctagcaggtatttgggcattgttgtttactggaaaattgcgcggaggttataaagaaatctgtcgtcaatttgcgaaattatttacagatggtgcagtcgacgtcgcaccaatggtcggtttcttgatgaccttagcgatgttcaataactcagctgcgtacgcttctccttatttttcagctattttcggagacttgataccgcaatcaccattagtcttgtcaatcgtatttgctatattgacaccactaggatttttccgcggtccaatgaatctagtcggttcaggatcagctattttagctgttgtattagctgtaaacccaacaatgtcgccagcctttttgttcccattgtttgcaatcacaacgattgcccctcagcatttagatattacacaatcttgggtcgcttggggattagggtatacaaaagtaacgtctcgagagtacatgaagaaatccatcccaactggttggatcgtcggtgcgatcttatgtttgattacattcttcttgtacgggaacgcctagtaaacaaaacgtcgatagaaatgattagatgaatggaggaaaagaaaatgaaacgttttgtgcgaatgggaattgatgtcggtggtacgcatacgaaagcagtggcaattgataatgcgacacatgaaatcatcggaaagtcttcagtgaaaacgacccacgatgatgttcgtggggtagctgcaggagtcgttcaatcttttcaaaattgtttgcgggaaaataatattagtccagaagacgttgtttttgttgcacattctactacgcaagcgacgaatgcgctgattgaaggggacgtagcaaaagtcggtgtaatcggtatggcaaaagggggattagaaggctttttagcaaaacgacaaactagattgaacgatatcgatttagggaataagaaaaaaatagagatcgtcaatgcattcttacctgtcaaacacttaaatgtagaccgtgtttcagaaacgatttcttctctagaaagagaaagagcggaagttttggtttcttctatggcatttggagtagataatggggagccagaacgggtcgtttatgaagcagcatcggtaaaatcgattcctacaacgatggcttctgatatcacaaaattatatggattgacaagaagaactcggacagcagcgatcaatgcgtctattttacccaaaatgctagatacggcaacatcgacagaagactccgtacgagaagcaggagtcaatgtctctttgatgatcatgcgcggagacggcggggtaatggaaatcaatgaaatgaaaaaacgacctgttttaaccatgctttccggtccagcagcatcagtcatgggctctttgatgtacttgagagcgtctaatggggtttattttgaagtaggcggaacaacaaccaatatcggggtcattaaaaatggacgtccagcaatcgattattcaattgtaggtggccacccaacatatatctcttcattagatgttcgggttctaggtgtggcaggcggttcgatggtacgggccaatcagtcaggaatcatcgatgttggtccacgttctgcacatattgccggtttagattatgcagtatttacggagacagaaaaaatcaaaggtcctaaggttgaatttttctctcctaaagaaggagaccctgctgattacgtcaaggtagtgatggaagacggagaagaagtgactattacaaatacatgtgcagccaatgtccttggattagtgcaagaagaacatttttcttatggaaatgtcccatctgcacgaaaagccatacaggcattagcagactattgtcatacgacggttgaagacatcgcagagcagatcatggaaaaatcctatgctaagattgaaccagtgattttagaattggcagacaagtatcatttggagaaagatcagatttctcttgtaggtgtagggggcggcgctgcctctttgattacttacttcagcaataaaatgggtgtgaaatattccatccctgaaaatgctgaagtgatctcttctattggtgtggcacttgcaatggtccgagatgttgtagaacgtatcattccttcaccaagtaaagaagatatccgatcattgaaaaatgaagcgatgaataaggcgattgaatcaggtgctacgccagaatcgatcgaagtccacgtagaaatcgatccacagacttcaaaagtaacggctatcgctactggttctacggaagtgaaagcaaccgatctaaccaaggagatcacaacagaagaagcactagagcttgctgcagaggatatgcgattaaataaaaatgaagtttgcttattggaaaatacacctttcttttatgtatgcggcgaacagcatcgttcaaaaaatgctggaagtcttcggatcatcgaccaaaaaggatttatcaaggtccaacgtggacatgcttcttgtctgaaaacaactgcagccaattatatggcagcagtcgaacaactttgggaagatatggcagtttatcaaacggagttgattgcccgaccagaattttatctctgtttaggagcaagagtctctgattttacagcgacggatctggaacaactacagcttttgatggatctggaagtatctactatggaaccagaggaagaagtgatcgtcgttgccggaaatatcaaacaaacataagttagaagagttactaaacaaattacaacagatccccgaagaaatttggggattctatcagtttcagcgagatttgttttggaaaaagattcctttgtccaagcagaaaatcctcatacaacaatcaatcgattgtggtatcgaaacggcatgtagcatcaaaaaaaagtacccttttgccgatgtaggagaaatttgtgaacaaatggctattccaatcgttccttgtgaatcagagcaaataaacgaacgaatcacttttgcaacttatgcagaagatgaagggatccgattgatgacggagccgttagaaaaattaaaatgttcaggacttacttcgatctctaaagaaacagcgcaagctttgattattggacatgaactatttcaccacattgaagcttctgttaagggaatttatacgcaaaacgaaaaaattgtgctatggcggctgcctttttatacacaccaatcaaccattcgtgcattgagcgagatagcagcgatgagtttttcaaaagagatgaatcaaagccgtttttcgccttatgtattagaggcagtcttgctttggccatataatgaaacccgtagccaagggattttagaagaaataaaagaaatagaaaaaagatgtgcggagtatgatttcgctcacaaataaagaggttgtgacagaagtggtcagcttcaagaaataagaaggaatttacgaaaattgcttcttaaatttttgtgacatttcggcttatttcaaagaagctacttctggaacaccgtgaatcagaggttgtgaaaaagctgtcctgcatcaagtaataagaacagccaaacaaaaatagctcctcatatttttcgtttggttggacttattaccgcagatgcaagcttttgaacaccgtttaaggaagaggttgtgaaatcagcgtttgagctaatacctagggtcagctgattgaacactgtttaagaaagaggtcgtgagcctgccgtttgactatgagtcacaagtcacaatattcaataaacatgagaatctgtttttggaaattgctccttgtgactgaggagttggcaggagaaaactgaaagggactgtgacacgatttttgtcacagtccctttatttgatgggtctttcctgaatatcttcaaaataatcggggtaattatgaatcacgtattcttgctcttcgataatcatatgtaaatgcatcgtacaaagaaacccgacttcatcaaagttatgatcaatcattgtttgaagcattgtctgatgttcatccaatactcgaccccaatctaattctgaaatcgtcaaacgcaaccatctgaaacggttcaagtgcgtactataactttccagccagtcccaaatctctcgttttcctgcaatttcataacaagttcggtggaaatcagtatccaaatcaaaaaaagcttttttattttgagcgatcactgcctgatcggtttgttctaatattttttctagtttagcttgatcttgcgctgtcattttcgcactacattcttgcaggatcggtttttccagcttttcccgcgtataacgggctaatgaagcagatcggatatcgatttttgaaacataggtgccggactgtggaatggtttttacaagctcctgattacgaagctggatcagtgcttcccgaatcggtgtgcgcccgatagctagttgttcttctaacactttatcggagattttacttccaggtgctaactcggaataaatgatctgtttacggatagattcataagcttgctgctgtaaattattgatacccattaaaacttcctttctgtgtaagtataatctattataacataaatcgcttacaaaacgtgtgggtgcaaagacgtattcttgaaaaaaagccctgataggcatgcctattagagcctcgaaaagaaatactgaatcaatctggtcgtacctcttggatcggtttgacacgaccgccaattcttttagcaaaagcttcggattcttttttgtctttgaaaatgagcagattgtctaagtttttttcccgagtgcggcagccagttttatcgatgtaaccgtgcattactttaacgacatacatggggatcacctgcttttttcttttcattatacgaactactcgacacaatacaagaaaaatgcttagacggttttttattaagaaatagcattatccagagaagcgtacgcttggaataactgatctagctccgaattgactttgctcagcttcactaatcgttgcgaatcagaaagtaagaaacagtgtttactgctaccaatagtttttaattttttgtcttcagttcccacaatttcgtagctaaaatccaaacgtgtccccgtatatttttggatagttggatggatgctcactttttctccgtaatggatcatttctttatagctgcaatttacttccagaacgggaatgatgattccagattcttcgatttttttatagggaaaccctagatgtaccaataaggctacccgagcctcttcaaaccagcggatataattgctatggtgaataatccccatttgatctgtttcataataaaaaggttctcgtacataacctgtaaatttctccatgattcatgcctcgttttccattgattttttacaaaaataattcatccacttcggaagtgcttcgctgatctgtgtcggcaaaacgacatattgttcttttgctagctggtctccgatgaaactatgaagataaacagctgccgcaatcgtttggtcattttgagggaattgggccaagaaccctgtgatcatccctgctaaagtgtcacccattccacctgttgccatagcagctgaacctaaaggattggtgtagaagtgttggtgaccataaatttttgtctcatgacttttcaaaacgaccgcagcaccgatttcctgttgcttctttttgttttcttcatctcgctgttcttgtatcggtagagcactcaaccgttgccactccatttgatgaggtgtaagtactgtttgttcgggatagggtagcgaaagatggttagcagctagtaaacttaaagcagagccatcgatcaccagccattgttcttttaattggttttctagtacttgtttgaaacgttccaaactcttggaagaagtgcccaatccgggaccaatcaagagtacatctgcttgctttatcacggaaagaaactggtcagtatccgtccaatctacgatcattgcttctggcagatgactgtgaagggcactccgatttttttcatccgttactactgttgtgagacctgctccactgtgtacggcagctaaagcactcatgatgattgctccgccgtattgttcattgccgccaatcaaaacgacacgtccaaatgttcctttatgtgaaatttttggacgaggtgtgatgactcttttcactagttgttcgtctatcagcatcaaaaaacctccttttactcattataacgtatattttttttagagaaaaacagataagaaaaggaattgtcagattttttgaactatttttttctgtaatttgtggtatcatgaacacgaagacttaaataagtggaggattaactttatgacaattgattggcaaaaagaagtagaagcacgtaaagaagacttgcttgaagacttaaaaaatcttttacgtgtcaacagcgagcgagacgactcaaaagtaacaccagatgcaccatttggacctggacctcgcgacgcattgaaacatatgttagcttatggtgaacgtgatggatttaaagtaaaaaatgtcgataactatgcagggcatattgatcttggcgaaggagacgaaacactagggatatttggacacatggatgtcgttcctgcaggagatggctgggacacagatccttatgaaccagtgatcaaggatggaaagatctttgcacgcggatcaagtgatgacaaaggcccaagtatggcagcttactatgcgatgaaaatcattaaagaacttgacttgaaactatcgaaaaaagtacgtttcgtagtcggtagtgatgaagaaagcggctggggcgatatggcttattatttcgaacatgaagaagaaccagattttggtttctcgccagatgctgaatttccgatcatcaatggtgaaaaaggaaatgtttctttagctttacgattcaaaggcgacaatgcaggagattacgtattgaaatcttttgtttccggacttcgcgaaaacatggtgccaggaacagcaactgcagcacttcaagtaccaagtgcagatgcagctatcgcgatggaagaagcattttaccaattcatcgaagccaatccagtaagcggaacaattgaagcagacaatacgtatgtaaaaatagaattagttggtaaaggcgcacatggtgcaagcccacaatccggtatcaatgctggttctttcttggcattgttcttagataactatgaattcttaggatctgctaaacaatttatccatgtagcagctgcttatgtccatgaagatttctatggagaaaaactaggagtcgcttatgaagatgaaaaaatgggcaaattgacaatgaatgctggactatttgcttttgaagaaaatggtacagaggaagcgaacttcatcaatatgaatttccgttttccaaaaggtgtaacagtagacggattgcaaagtgatatcgaacaaacagtcggccaagaaggtgcaacagttactcgaggtgctcgcgtaatggaaccacattacgtaccgatggatgatccattggtggctacattattgcaagtctatgaagaccacactggagaaaaaggctacgaacaaatcatcggtggcggaacttacggacgtttgttgaaacgtggcgttgcttatggagcgatgttcccaggatatactgatacaatgcaccaagcaaacgaatttatgagtcttgatgacttgttcagagcaacagcaatctatgcagatgccatctatcgtttggcgaaataattaattaaaaaaggatcaagaattgcaaattatctttgcagccttgatcctttttttattttctactatggtattcatgatacacatgatatagattcaactcgtactctttctttgcgttcgtgacgaccgtatccaaaatcagtcctgttactaatgaaagaagggctaaagtcatcaatccagtacttaaaatcgcagaagggatgcgtgtaatgaagcttgtcaacatatattcacgaatcacaggaatccccgtgaccaatccaaataaaaagaagaagatggtccagatcccaaagaaaagcaaaggtttataatctttgcacattttgatgatcatcatgatcactttgaatccgtcagagaatgtattcaattttgatatgctgccttctggtcggtcccgatattcgattgggatctcaacgaacttgaattttttatctagagcatggatcgtcaattccgtttcgatttgaaaaccagaactcataatagggaagcttttgacaaaaattcgattgaaccctcgatagccggtcataacatcaagaatttttgttttatacattctagtaattgtatttctaacaaggttatttccaaaatcatggaaaggacgcttattctcatcaaagtaggttccatttgatagacgatcgccaatgaccatatctgcttcgccagaacgtaatttctcaagcaaaccatgtacagcttcggcgggataagtgtcatcgccatctaccatcaaataataatcggcatcaatatcaaagaacatttgacggatcacattcccttttccttgacgtggttctttctttacgattgctccaccttgaacggccaattcgtatgttcgatcggtcgaattattatcatagacataaatatctgcttctggtaattctcgtttaaagtctgcaatgactgttgaaattgttgcttcctcattgtaacaaggaatcagaacagcaattttttcttgttgttccatttttcactctccttaattatagaaaacaaaagctgaattaaaaatacctcataatcaaagtaaatgctagttttttcccgctaaatatcatttatttaaaaagaaaatactggaatatgtgtttaaaaagacctgtctaaaaaatcacccactataaaagaaggataggatacctctcttttagatagtgggtgcgtattcgttatttcatttttttgacgtattaatctattgcgcccttttttcttgaaatgtctaatacggttcctgtatgagcatctgctaaaaattcataataaacagtttcgccatcttctatccgggaaagcccaccccgataagcactcgaccgaacggcgaatttccgaataggttctttttcaaaagagatccaagcaccttcgattgcgccttcttttaaaaaagatgttttgatattttcaagcacttggtctgctgataacacttttttgcgatgataccaaatcgttgaagctaccccactcaataatcctagaccgatcccaacggctaacccgcctttaaaatagcttaattcgctttcttcatacatgtggatatacctccttcttctcacttgctactccttgtgcttattttaccacactctcataatttctttgaaataaataaccgctaccagaaaaaataagctataataaatacgatcggtctgcagaaaaaatcatattttatccgcagatcaatataagtctgagaggagtttagtctgaaatttagacgaatagcatatggaagaaaaaacatttcaacgaatcaaagagttaacagaattacaaggaacaagcggttttgaacaagacgttcgcgcctatatggaaagtcatatggaaccgctggtagatgagttacagttagatggtttgggtggcatttttgggctgcgccaccatgaagaagcggatgcacctcgtgtaatggtcgcagcacatatggatgaagtcggattcatgctgacacaaatccaagaaaacgggctttttaaagtcgtacctctaggcggatggaacccttacgttgtttctgctcaacgttttacacttaagacctctactggtaagaattatccatgtatttcttcttccgttcccccacatttattgcgaggaacaagcggacaaaaatcagtagaagtaacagatattttgttcgatgctggatttgaatcaagagaagaggcaatgagttacggtgttcttccaggagacacaatcgttccttacgctgaaacgatcaaaacagccaacggaaagaatatcatcagcaaatcgtgggacaaccgctatggctgtacaatggtattagaagctttagaagcattgcaaaatgaaacattaggtcatacattgattgcaggcgcgaatgtccaagaagaagtaggcttgcgtggttctaaagcttctgtcaataaattcaagccagatctgttctttgcagtagactgctctgcagcagatgacacagtgacgaaaaatggcacattcggacatttaggagaaggtacattgatgcgtatccaagatccaggtttgatcatgcttcctcgtttgcgtgagtacttgctagatatcgctgaaacaaacaacatcccttatcaatactttgtttcaaaaggcggtacagatgcaggtgctgctcatacacaaaatgaaggaatcccaagtacagtgattggcgtagtgggacgttatatccatacgcatcaaacgatgttcagtattcgcgattttgaagctgcacgagaaatgttgattcaaacattgaaaggtttagataaatcaacagtgaacacgatcgtatacgggaaataacgcgatagtgaaactataaaatctggcaaaagcaaccttttgtcagattttttttataaaaagaggatcaatgtttgttagttcgaaagaaaggtgtataatttaattgaaaaatacataaagagaaagtagaggaaaaagaatgattatcccaaatagtttagaagaattagcaggctacgtagaaactggaaagagtgtatttttctttactgccggctggtgcggagactgccgttttatcaaaccgcaaatgcctgaaatcgaaaatgacttttctgattggcaatttattgaagtagaccgtgacaagtacatagatgtagccgctgaatggaacatttttggtatcccaagttttgtcgtgatccaagacggaaaagaattaggtcgtctagtgaataaagatcgtaaaacaaaacaggaaatcgaaacgttcctagaaagtgtaataaaaggctgacatctgttaggaggggtcaagatgaatcaagaatataagaacattttagtaggtatcgacggtagtgaacaagcacttgctgctttcaaaaaagcggtagaagtggctcgccgtaataatgggaaagtatatgtagcaaatgtaatcgatcagcaattttataactttatgggctatgctcctattgatcaaaatctagtcgatcagcaaactgaaacagccaagcaaatgatcgaagaatgtaaagaatatggaaaatctgttgattacacaaatatagaaggaattattgcatacggctctgttcgtgaatccatggcagtcaaattgccaaaaaaatatgcaatcgatctaatcatggttgggcagtctggactaaatgcagtcgaacgctttatgacaggaagtgtagccagctacgtcatacgtcattcaccttgtgatgtcttgatcgtttctgacgaagaagaacagccaagtaattaagcaagtggaacttgtataacctttttaatcaaacagtaaagggactgtgacaaaagtcttgtcacagtcccttgttacgaataaatggtgttccagaagaagcttcttcggaaataaagcatgaaaaaaatctcatgcagtgaatgcaattttttgttaagataaatctcagcaaaggataatggaggaaagaacatgatttttgcttataacaaagcacacgtcggagacactttgatggttatcatagccgacgataaaggaacagaaaacactgtcgaacgtaaatggaatgttgctcggatcaaagatgaacaaggtcaagttgttgcttggaactttttccatatctccgatcatctaacaattgaagggaacggccaagtaagcttaacagatgaagaattagcgaaattgaatcgattgattaaagaagcaggattcgaagaacagcttgaagctgatcatgaaccgaagatcgttgtcgggtatgtaaaaacatgcgtcccgcatcctgactctgaccatttatcgattactgagacagaagtggacaatgggacagtattgcaaatcgtttgcggtgcaccaaatatcgaagctggacaaaaagttgtcgttgcaaaaccaggagccatgatgccagatggaatgatgatctggccaggaactttgcgaggggtagacagctatggaatgatttgttctgctcgtgaattgcatttgccaaatgctccagaaaaaaaaggaatcttagtattgcctgaggatgccgtagtcggagaagtatttccaaaataaagaggttgtgacaagtctttgtcacaacctcttttttattaattttcactattttgattttgttttaatgccgattgatcaatcgtcaattcaacagtagttgttttttctttcgagccttcatagtaagtgattttgacagaatctcccacttttttcttatacaaagcagattgaagttctacaccagaagaaacttctttgtcatcgatcttagtaatgacgtcgtattgtttcaatccagctttttcagccggtgtagctgtttggacatttgtcacgatgacaccgttagttacagatgaaggaatcttcaagatttgttcttgttgctgagtagaaacggcagataagtcgaccattgtgatacctagagctggacgtgtcacttttccgtctttttccagttggttgatgatattcactacatcgttacttgggatggcaaatcccattccttctacgcttacattagaagtcgattcagaagtacttgcgatcttacttgagttgataccgataacttgtccttcgatattcactaaaggaccaccagaatttcccgggttgatcgctgcatctgtttggatcgcattgatattgactgtttcgttcgattcattcgtacttgttacttgtcggttcaaggaagaaatgattcctgaagtgacagaattcgcatattcagatcctaatggggaaccaatcgcaatcgcaggttcaccaaccttcaaagcacttgagtccccaaaagaggcaaccgtttcgactttgtctgaattgatcttcaacaccgctaaatctgaataggcatctgttccaactaattcagcttttaccttcgtaccgtctttcatcatgacttccaaaccttgctgtccatctactacgtgattgtttgtgactacataagcagtattcccgtcttttttgtagattacgccgcttccttcactataagcttccaaattactatcatctgagctgctactttcttcttgctgcccgaataatccgccaaaaccgcttgattggttttgactttgtaagttgataacagaaacgacagcgtcttgaactttatctaccgctttggtgatatcagaatctacattgactttgacattttccacaactgtttcaccggcagaattttgattgccgcttgtagcagtagaactattgttgccagtgcccatcgctgcataaaaaatgccagctgtcagtagtcctccaacgatccctccaacaagccccagacccaacttacgccagaggctattatttttattttttttcatctttagtgtcacattttttctatccatgtgttcctcctccaattacattcatttatctactgttagtatagtcttatttgttgactttagtctactttgagactttgaactttttatgaaaaactttaggaaaaatcattgttttcagatgaaaatatttgattttctttttccacagatattgtgtaaaactacgcggataggattggaaaaataagggataaaacatatccacagcctgtgtataaagtggataaattcttataaaacgtatgtttgcctaatgaatgtgatgaaataaggtaaaacaacgctgttttctgtggataaacctgtggatgttgtgcataactgttggggaaatctttttaacaaaaatagtcaaaataaacatatagacgaaaaaattgattataataaacaaagtgagcgtgaagatcaaaggagagaaaacatgaatatcaaaattatttcagtaggaaaattaaaagaaaaatacttgatccaaggtatcaatgagtatgtcaaacggctgaatgcctatgcgaaaatcgaattgatcgaagttcctgacgaaaaagccccggagaatttaagcgaagcgcaaatgagacaagtaaaagaaaaagaaggagaacggatcttagcgaaaatcaaagaacaagaatacgtctatggcttagcaattgaagggaaaaatcccacaagcgaatcttttgctaaacaaatcgaccaattaggtatccaaggaaaaagccaccttgtttttgttatcggcggttctttaggactcagcgaagccgtcatgaaaagaagcaatgctcagatctcttttggcaaaatgacgtatccacatcaattgatgcgcctgatcctcgtcgagcaaatctaccgtgccttccggatcaacgcgggggcgccgtatcataagtgagggtgttttttaagaggaaaaattattagtgaaataggctcatattttcataaatttatttgatacagaggtatataatatttttattggaaatagaaatattatgtacaaagatatgtttatgtaaactgtttataaatgagaggaaggaataaatttggaaaataatgaaagtttggcattaagagtagtaaatgaatcgctgaaattacctgtcgtaaaagtgaatcgttcagaatttttagtgaaagtatttggtgacaaggtagaagatatcaatcaattgattgaagagggaccacaagcatttttatctatagaggacctagatcgagctgcgaataatcgaatctattctatcgttgctcagtctagtacattgtcatttgctacaggattacccggaggattagctatggcagcaacaataccagcagatatcacacagttttacggctattctttaaaattggcacaagaaatttcttatatctatgggtatgaagatatttggaatcaacaaggagaattgactgaagaagctaaggaaacgctaatcttgtacttagggatcatgttaggtgtatcaactgctagctctgctgttagggtattatcaggaaaactttctgtacaggctttgaaaaagatcccacaaaaagcattaacaaaaacgatctattatccagtgataaagaaagtacttgcagtatttggaacaaaactaacaaaagcaacatttgcaaaaggagtttccaaagtggtgcctgttgtaggtggtgtagtatcaggaggattgaactatttttcaatgaaaccgatggctacaaaattaaaaaatgaattgagaaaaggcatcaattattctgaagaaaatttgagacaagatttgaaaattttaaacgttgaagacatcatcatcgatgaatctaatttatcggaaactagcatgaaaggtgaaaatatcatcgaacagatagaaaaggcacatgatttgttgaaacaaaaaattattactgaagaagaatttatatcaattaaacaaaacatactttcgaaataattaactaattacatgtcatagaaaagtacttagcactcaataaaattcagaaaataagagcttcatttttaatttcttagttatagaagtaataaatttgatagattatattcgcaaagcccattcatctatatcaagtgattagctattcttactagaatcaaaagccctaagtcgcacctttattgagaaaatcacctttgatcctaatcagaaggagatattgccgattccgataagattcacacctactgtgatttgacaattaaatgagtaatatcaaatagccgtatccaaaccaaaggatatggctatttttgtgttagggatatacgtcacgtagcttgttatcaagaataagattctttcttttttttgctttttctaaaactgagtatgataaaataagagggtatatagcaactttaaataagagataggagtgtatctttttgggtgcagaattaaatcaaaaattatttagtgcggcagataatctccgtagtaaaatggatgcgtcagaatataaaaattatttattggggctgattttctataaatatttatccgaccgtttgttggaacaagtggttcttttagcagatgaatccttagaggaatatgacacagtaagcaaacaaacaatgttgtatcgtgaattactttcagatgaagaatcaaaagaagacctgattgccacaatcgttgatattttggggtatacgatttcaccagagtatcttttcaacgtcttagcggatcaagcaaaacaagcaacgttccaattgaacgatctaaacaaagcctttgtgcaattggcatctacctacaatcaatttaatgggttatttgatgatgtggatctccaatcaaaaaaactaggaacagatgagcaacaacgaaatgtgacgattaccgaagttatcaagaaattgaatgacgtggaagttttaggtcacgatggggatgtgatcggggatgcgtatgaatttctgatcagtcaatttgcttcagaagcagggaagaaagccggagaattttacacgcctcatatggtttctgatatgatggcacaaatcgtgacgttggatcaaaaagaacgacgattctttagtgtctttgacccaaccatgggttcaggttccttgatgttaaatgtacgtaactacttaactcatccagataacgttaaatatcatgggcaagaactaaatacaacgacatataatctagcaaaaatgaacttgattttacatggggtagatgccgaagaaatgaatctccgcaatggggatacgttgaataaggactggccaacagatgaaccttacacatttgatgcagtagtgatgaatccaccttattcggctaattggtcagcagatacgaccttcttagatgattctcggtttaatcgctacgggaaattagcgccaaaatccaaagcagattttgcgtttcttcttcacggtttctatcatttgaaggaaacagggactatggctatcgtcttgccacacggagttttattccgtggcgctgcagaaggggtcattcgtcaaaaattattagaagacggcagtatttatgctgtgattggtatgcctgcgaacttgttctttggtacatcgattccaacgacggtgattgtattgaagaagaatcgtcaaactcgagatgtgttattcattgacgctagtcgagaatttgtcaaagggaaaaatcaaaataaactatcggaagaaaacattcaaaaaatcctcgaaacctacgctgaaagaaaagatgttgagaaatacgctcatttggcaacctttgatgaaatcaaagaaaatgactataacttaaatattccacgctatgtagatacgttcgaagaagaagaaccaattgatatggttcatgtcggaaatgacatcaagaagatacgacaagaacagcaagtgctagaaaaagaacttttggaagctatctcttccctgcaaacaacacctgaaaatgaagcgtggttacaaggcgcgttggaggtgttcaaacatgagcaataatagacaaccagaaattcggtttccaggatttatggaagattgggaagagcgtaagttagatgaattggtggagcaaattattagagaagttcctaaacctaataaaccttattacagaatgtctgtaaggtctcatgctaaaggcacttttagacaatttgtagataacccagataacgttgctatggataaattatttattgtaaaaaaagatgacctagtcgtaaatattacatttgcatgggaacacgcaatagcagtggtaaaggaagaaaatgatggtttattagtatcgcatagattcccaacctatagagcggatggaaaatcagatataaaatttttaaactatgtagtatctaaagaagattttagaaggaaattagaatttatatctccaggaggcgcgggaagaaatagagttcttaataaaaaagactttttaaaattaaaaatctttgttccaaaaattgaagaacagcaaaaaatcggtaacttcttcaaacaactcgacgatactatcgctcttcatcaacgtaagctagatttattaaaggaaacgaaaaaaggattcttacaaaaaatgttccctaaaaacggagcaaaagtgccagaaattcggtttcctggatttacggaggattgggaagagcgaaggttgcaggaggtagtagatagatatgataatttacgaataccgataactgcatcaaaacgagtagctggtaatactccttattatggggcaaatgggattcaaggttatgttgaaggatacacacatgatggagaatttattttagttgcagaagatggagcgaatgacttgaagaactatccagttcaatatgtagatggaaaagtttgggttaataatcatgctcatgtaattcaagcaaaagaaaatttagctgataatatgtttttgatgaatgccataagaagtattaatatagaaccatttttggtcggtgggggtcgggcaaaacttaatgcagatgttctgatgaaattagaggttattatacctttaaagagtgaacaacaaaaaattggtgccttcttcaagcagctagatgatacgatcgctcttcatcaacgtaagttggatttactaaaagaaacgaaaaaaggcttcttacaaaagatgtttgtctaggagggaagaaaaatgaaaattagtcatcgtgaggaagcggaagtcgaagaacagttgatccgtgtacttggagaagggcataatcagtggacgtatcgtccggatctaaaatcagaagaagatctttgggttaatttacgccaaaaaataatctcaaataatcaagcagaactgaatgattctcctttgaccgataaagagtttgaaacgatcaaaaccgaattattgctacggacgaaaaccccatttgatgctgcaaaatggttaaaaggtgaaaatgggatggctcggatcacgattgaacgggaagattcgcaattgggttctgtctcacttatcctttattccaatcaagacattggtggaggaatctctacttatgaagtggttcatcaaattgcaaaacgtggaagtaacatagaagcacgggatcgacgttttgacgtcaccttattgatcaatggattaccgattgttcaaatcgagttgaaacaagtaaccgcaaaagatggtttttatcaggcgtttaatcaaatcaaaaaatatgcagaagaaggcatgtttcggaacaatatcttttcgaccttacagttgtttgtggtttccaatgaacaaacgacccggtattttgcaaatgccttaccgaaggatttgcattctaagtttttatttagttggcgaacgaaagataataaaaaggtagaaaacttatatgagttttgtaaacaagtgctaaatattccggatgcccatcgcttgattgcggattatacgattgtcagtgaagatcaagacaataaaaccctcatggtgttacatccttatcaagtccatgcgattcaagccttgtttattgccgcaaatcaacatcaatcagggtatgtgtggcatgcgacaggttcaggaaagacgttgactagttttgtatctactaagcttttagcacgaaaatcggggatcgatcgaacgatcatgttagtggaccgcaaagatttagataatcaaaccaccacagagtttacgaaatttgcttcggaatttaatactgggatttcttctggtaacgccaaagcgaatagcttgatcgtgggaacaggaagtgccaaagagttaagtgaaactctgttggcagatgccaatgcgaatgttgtgattattacaacccgtcaaaagctagatgcggcgttgaaatatgcaaagaaacaagaggagaaaaaaggaaccaatcgcttccaaaaattaatggggcaacatatcgtgtttgtagtcgatgagtgtcatcgagcgttaagtgctgaaaatatggaagagatcaaaaaaatgtttccgaagtccacttggtttggctttacaggtacaccgattttccctgagaatcggaaacaagccaaagggcaattggcacgtacaacccatgatcagtatggggaagtcttgcacacctataccattaagaatgcgctagaagatggctctgtcttaggatttcaagtagagcatgaaaacaccgtggagccgacttcattagagaataaaatctatcggaaattaaaagaagtagaaacatatgcagagtattcatcagaacagattaatcgtatgatcgatcaaatggagcctgtcaaaaaagaaagttatttggacccagctgtttttgaagcagatgaacatatccaaaaagtcattcataaaatgttccgtccagataatgcctatacaaaatttgattttcgaaatggcaggccaacgaaatctgcaatcttaaccacgagttccattgacatggccaaaaagtattatcgggccatcaaagagatgacgaaagagcctgattggttaacaaaagagtttcccaatcagcccattcgtgaaggacgaacgatggaggatcctgattttccacgaatcgctattacctattcattagaagaaaatagccgagattcaagtgcccaacaagaagaaatgcaaaaaattattgaggaatataatcagtattatgatactgcctggtcactagcagacattgagcgttataacggagacatcaataatcgtttggcacgaaaaagagcggaattcaaacaatttgggaaacaaatcgatttagtgattgtagtggatcgtctattgacaggttttgacgcacctacgattcaaaccctatttgtggatcgtaatctagagtatgcaggattgattcaagctttttcacgtacgaaccgtacgtatcctgaaaagacaaaaggattgattgtgacgtttcgtaagccagccacaatggagaagaatgtcgaggatgcgacaaaactgtattcagaagcaaaagaagaatcgggtttgatttatccaagttatcaggaatccaaaaaaagattcaagcaggcatatggtaagttaaaagaggtttcatccatggaatccattgatgaacatacgccacttgaaatccgtatcgagtacgtcaaagcatttcaagaattgaatcgtgcttatgaatcgttagtgacttatgacgattacaatgatgacatggtaaaatctccaactttgaacaatcaaattcaacttttggaagaacaaattggcgtgtacgagaccgtgaagggttcattaatagaggaagaaccagaaaaagaaggagaagatttttcaacgatcgaattttatagtgaaaataccactaagttgtatgatattgattcaacttatattgatcaattactaggaacttatgctgcgaatagttcagatgcacgagaagaaattgaaaaagctttggctaaattgaataaaacagaaggagtcaaagaagtttaccgacaaattttaaatgcatttgatgtggggactttagatagtaatgaagatatctttgtcattaaacgtcgctattttacacaagcgagtgatgatttgattcatgtcttttccaatgagtggtttgtttctgagaaagaattacatgcttctaatctgcaatatctaccaggtgaagatccaattcctaatatgaaagcaattatcaacagtaaggattacgaaggatataaagccaaacatccagaagccaagccatttaaatacccacaagaaatgaagcgagcctggcgtaaaatgttagatgatgagttgattccacttgagaatgaattgaggtaaacgagaaaattgaagaaattgtatgataaacatgttaataaatgatgctcgaaataaaatttggttttatttttacattgatacggtaaataaaatttgaaagtagaagaaaatatgaacaacaatgaaacaaaaaaaacatatgaactaagaataactgctgatgagattaaatcaacagacccaacatttactatgaagaatctaagcttaggggataattatcaaccaaaagatgcttacttccgtacggcagaaggcgaaataactagaagaaactacggtaaaaatgaacggaaaatttcaaatcaaacattaccgcgattagctattcaaatgtttgaacgatcgattgtttctctaccagaaagcgaaagagcaacatttcctgtgtgtcgatatcactcaggggatgagataatacgagggatttttccagatgttgacagtttcaaaaaaaaaaggaagtccatcgaatttttgatttataaatataatgaagacaagcagatagtcatctattgttggagtattttttcaactttattatttgtacaagaatgtttgaaacgttttggaacatctggggatgaatttattcttgtttataaagggaaagagaaaaaggaaatacgagtaggagagactcagactatgaccaatcatttgctgaaatcatatgtttcacatttactcaaatctaaaaaccttattctacgtggcgctcctggaacagggaaaacattccttgcaaatgaaatggcagctgatgtcgtttcaaatggcagaactacacaaatcaatgaattgagcgaagatgaaaagagccgaattggatttgtccagtttcatcctagctatgattatactgattttgtcgaaggtttacgtccaactacatccgatgatggcgttgttagtttcaccttgaaagatggaagctttaagagctttgttgaaaaagcaaagaaaacaaagaaagtaaatggacaagataattttgaagaagcttgggctaaattttttgatgcggtaacggaagctagtatagagggagaaggctacaacaaacttaaaacattgacaggtaaaccagtacgcaatcttctagcttatgaaagaaatgaaattcaaggtgtttatcctgctaaaaccaatacttatctaaaccatgaccaaatttataatgtctatcgtggattgcctggtacaccaaaaggtggatttgatgcttatcgaaaagcgattgtaaaacacttaaaagaagaatttggcttaaaaaactacacggcgtcaacggtagattctacgaataaccaaaactatgtgtttatcattgatgaaattaatcggggcgaaatttccaaaatttttggcgaattatttttctcaattgatccaggatatcgtgggcataaagaaggtgtttatacacaatatgcaaacctccatgaaaatccagaagaaaaattctatattcctaataatgtttatattattgggacgatgaacgacattgaccgttctgttgacacttttgattttgctatgcgccggcgatttactttcttagaaataaaggcagaagattcagcacaaaatatgctgactcaagagaaaacaaaagaacttatgacgcgtttaaatgaggcgatcgttgccaaagaaaaaggtggactgtcaacggattaccaaattggtgctagttactttttaagtatcgataatggtgaggagacaatggaacaattatgggatactaagttatatccattattgaaagactattttcgtggtgaacataaggcgaaagaaaaattagaaatactagaaaaggtatactctaatgacggtgatttagatgaagctgaaacctctacacgataatcaagaaatcaatgactcagttgtgcaacatccaatcattacgaacttagttaatcgtgacttaagtagtttagagaaagaaaattttattatctttccgcaacagttaaatcaatccaaggatctaagtgaagataacttgatatttcaatcaagaaatggaaaaatttggacttgtaatgtcgtaggtatccttagcgattcaacagatgaattaagaattcattctagattcgctaatcaaatgaagcacgaagatttctttttacgttatatgcttcagcgtgttttgaattacaacgtgattaatgatcattttagtgcatctaaaaagatgacatactacgatttgttggtatttctctttccttattatctgaatgaagcaatgcgtaaagggatatacaaagaatatgtcaaacgagaatacaataatgccaatatcaagggagctgttgatgttgcaaaacacatccgttcgaatgttcctttcgttggaaaagttgcttatcgaacacgagagtttagctataataatcacctaacccagcttattcgtcatactattgaaaaaatccaatatgagtacgatttcttacttagtggagatgaggatacgaaagaaaacgtggttctaatcaaacaaacaacacctgattatgctagattaaaccaatttaatatccttcaaaagaatatccttcatccagtcaaacatagttattacgaggaatattcggctcttcaacaaatctgtatccaaattttatcggaagaaaaatcaggatttggaagtgataaaaatcaaatacatggaatcattatcgatgtgtcttggctatgggaagaatacattgggaaagtcactggttggaaacattatggcagagataaagggttagcaacaatgcatttatttcaagagcccaaccggtccccacgatatccagactttacatttaataatataccaattgatacaaaatacaaaaaacatcttgatactagaaatgactataatcagttagtcacatatattcatataatgaatttagaccaagcagatacaatgaaaggcggctttctgcaacctacttccgatccccttcctgcaaatcatgggtataaaaaaataggcatattaagcgggctaggaggagaaatattcacatatcattttttcattccgcaagctgcgtcaagttatttggaatttgtagaacagatgagagaggtagaagcagcactacaaactacttttcaataagtaggaattatagaaatgttactcaaaaaatcttcattaaaaaatctgactaaataagttgagaaaacagaatatacttcaatatccagtgatttataaatatcattcactcatgatacccagctgagagtgtaaaatattttgtgtaataaatatttcacagaaagaaagagaaaattatgcattggttatgggtattaatcgtaggagctattatcggtttgattgccggagcaattacaaataaaggtggatcaatgggatggatagctaacatcgttgcaggtttagttggttcagcaattggacaagcattgttaggtagctggggtcctcaattagcaggaatggctttgattccttctatcattggtgcgatcatcgttgttgctgtagtatcatttttcttgggacgttcaagaggttaatcgtcaaatatatcagcaattttacctattatcttaaggagcagcttttcgctgcttctttttttgtatagataaactgcttctatcactgatcatcgatgttgtctaactgatgtcgccgaatgcaagcattacctttgtcagattaaaaaatactcgttacacttaatatagaacgacgaaagaaaggatgatctcaatgaaaaaaatgtacgaaacagcaatgatcaatcgtggaggccgtgatggcgaggttgaggcaccaaacggaagtatgcacatgaagatcgaccgcccaggaatccatagtgaagggacaaatccggaacaactttttgcggctggatacgcatcttgcttcaacggcgcggttcaacacatgctggaagaaaataatcttgagtctgattctgaagtcaaagcacgggtatctttatttcaattagaagatgggggctaccaaatcggggttgttttagaagtttctttgccaggacttgagaaggaccaagcagagaaaatcgcagaagaagcccacgcattttgcccatactctaaagcaacaagaggcaatattgatgtggaagtgactatagtagaataagggattcttaatgttactataaatgagattatgaaagatcctataaagaaacgctagtaaaagaaacgctagtaaaagaaacatgtagttacggtaattaatagcggtatatgtacgattgatcgaatagaacaaggaggcaaaaaaatgacacagcgggtagcaataatgattttagtgttgctggtcattggcctccttgtttactatgtcctaaagtttaagcattggaagcagcaacggatacatcaggatattgaaaaaaagttaaaacggtatcctattgttcaagcagcttgggaaaaggctgaagcaaaacaatataacattcctggattaacagaaacaagaatggtggtgccggaaaccggcgaaaatgaggtttgtcaatggatgacgccgcaagggttggctttttctcaagattttgtgtttatttctgcctactgctatgaccatcagcatcattctattattcatgtactggatagagaaacaggacagccgatcaaactgctgattttacctaaacggccacatgtagggggcttagtatatgatacaaaacgggaacttttatggttgacaatcacaggatctgctactggacgagtagccgctttacgtttgatcgatatcttagcagatacatctgaagagacgggacagccaatcgcttattggctgacaactgatctctcagagattccacaagcatcgtatttgactcaaaacaatgatcaactggtatctggcaacttcacactaaaaggtgaaggacagttgactttctatctattgccgacgatagctgaaatgaaaacagcaattcgccgcaaagacaaaatccaaccaaccgtgacaatgagcagaaaaacatctgataagattcaaggtgtggctttttatggccattatctcttagccagtcgttcttatggtccttatacctcggaactcttagtgtccgagcgggactctcctagccggatcctaaaacgaatcaaatttccaccgtatttggaacaaatcgttgttgtagaagatcgtctagcagtattgtttgaaagtggcgccgcagcgtatcgcgagaaagccaatcctgtgttagccaatgttttattactagacttagcaacgttgcttcatgcaaataagcgtcccaaaaagattgctgcaactaaaaaatagtcggacaactcaagatgatcactgttgttcataaagaacgacaagaaaaatcatctagcgatgttcgactatgggtttatttaggaagtatttctactaagattcaatatggctatacagattcggcgaaaaaacaaggcaatgttaagtttttgagaatcacagatatacaagagggacgtgtaaattggtccagtgtgccttactgtgatattagtaattctaaactagttgatttaagattggaagaaaatgacattttgatagcaaggacaggaggaactatgggaaaaagtttcttggttaaggaaataagtgaggaatctgtttttgcttcttacttgattcgaattaggttagttgagaaattattatcagaatacgtagactgcttcttagactcgccattatattggaagttattagaaaaaatttcttacggaactgggcaaccaaatgtaaatggtacaaatttatctaaactacttataccattaccacctttagaagaacaacaacgcatgactactaaaatagaaatgataagaagatctattcgtagaatcaattttgagtaaatataacggacctagcatccattttataccagatgatgctaggtctattatttatattttatggaatttaattgatttgttctagtgttttaatattattacgacagtaaaaaaatagtttgattcttctaacatgaatgaccatctagaagtggaaatgtataaaagatttattttatgaagttttcctaatatcattcactcatgatacgcagctccgtatcataagtgatgttatttttgtaatgtgttcgggcatgctctctacttactagtaggtcaagtgattgatcattaattagtagaaatagcatgtccaaggagacattccacaaaatcattaacatacattaaataaattgagctgttgcataatagacataaggatgtgttcttttctatattttgaaaagctgtcagggcgaagtttaaatatcacaaaaattaattggaaaagataaacaactggaacttgctagcgttgcaagttgaataaaaaaacaaccaagattagattgtaggaacttgtagaagatcataatttgaagttaacaaaagaattccacgacacctctactctgttaagtacaggaaacagagagttaagggcaagaaaaataggcgaggataccgggttgaaaggccgattggagaacataagttaatagtaaataaaaagacgaagaaatcgcgtcaagtggattcttcgtctttttattgatgagattgttgtgacaacgtgcttattttattagaagatatctttttctgatttttctaatgctaaagctaaacacccaatgattccagcatcatctcctaattttggaggtaatacatagttttcgaatgctgggtagtctacatagtgattcatcaaaccaaccaaagcttcttggactcgttctctcagatgtgcttgtttcattacaccaccgccaaagatgatgacatcaggtgaaaatagaagagttgtgttatagacacattgagcgatgtaataagcttctaattcccaagaaggatcagcggcagacaactcttgacctttcatgcctgttctttgttcgattgcaggtccagaagccattccttccaggcaatcgctatgataaggacaaacacctttaaaggtatccacagggtgtcggcgcacaagcatatgtcccatttcagggtggctgaaaccttctacaaaagtgccattttgcaaggcaccgccaccaatacctgttccaatcgtgtagtaaacaatagtggaacgcccttttccattccccgcgacatattctccgtaagcagctgcattgacatcggtggtaaagacaatcggtagttcttttaaatttttatttaaataaccgataaaatcaaaattctgccaagctttttttggcgtagaggtgatatatccgtatgttgctgaattgggatgaatatcaatcggtccaaaagaacctattccaatcgctgccagttgttcttggtgttttttgaagaaatcaataacgttattcatcgtttctatcggcgtggttgtagggatttgtattctttcaattacttctaaatctttcgtacctactgcgcagacaaattttgttccgccagcttcaattgctccatataacataaaacatttgctcctttgcagttaagtcgttttaccttgaatcagctttactggtaaaacgtaatgtgattccagtggtttttcagcatcttggattctttgcagtagcaagtctacaaggatgtcggcaatatccgttattggttgagcgatagtagacagatgcggaaaataattctggataaattttgttccgtcatatccaatgattttcaattgctcagggatgcggatatcgagctcttgacacagattgtatgccaatacagctgtaagatcatctgtgcaaaaaatactgtcaatctcttcattttgcaaaatccgtttaatttctaaattttttaaagcagtggaacgagcagttgaatggaattgaaaaatctgtggttctagctgctgctcatccataaatttcaaatagccgttcattcggtcatttgtgggggagttggattcttgcgagcccgtcaaaatagcgattttacgagctccttttagatagagattttctgtcgcgagataaccgcctcggaaattatcactgctgacgattggtgttccgtctgccagatagcggtcaaaagagacgattggcaactcaatattttcgtactcctgtatcccgagattatgagcgccggcgatgatgccgtccactttatttgctgctaacatgttgagataatttcgttctttttctttattattagcactgtcacataagatcgaacgatagcctaaatcaaataatttactttccaactgttcgactaattcgccaaaaaacggattagcaactgttgggaaaatcaagccgatcaattgagtgttttttccttgaagtgaacgggctaacgaattcggctgataattgagttctttcattgcttgattcactttatcgattgttttttgacttaaagaaccataattatttatcactctcgagacagtagtaggagagactcctgctttttttgccacatctgtcaatttaacagccattttcttcatcctttatttgttcatattccgcagatgccataatttccctttaaattccctgtcactttttatatacaagcccgtttgatcatctgtcggaaagacacgggcagtcgctgtttgctgtccatcatttacaaacacctctacaacggaacaatcaacaaatatttgtaatttcagcggtttcttttcaattgagaattcacgtacagttccaaaattttcagcgaaagatttgccggcatggctgcgatccatactcattttaccatgtatcgtatcaaaggatagtgttaaaccgtgtttttgttgttcatctgcaaacaataaaatagtacctttctgtgagtaatcgaattctaactggagttcatattgatttatttccgcgtcaatagtggtttccaaaccgctaaagtgataaggttttccttttcgcaactgcgctgtttctttcaccggtcgttgatagagctgctctttttcaatagtaagttcttttacgatgctcaagcagtgtgcccatccttcttcgtcagttggatagctgatttcaggcaacccaatccaactgattgccaaggttcgtccattttcatcactgaaacaatgcgtcgcgtaaatgtcaaatccttcatctatattttttatgtgagtagggtcggaaagctcatttttttcaaaatcaaatgtttgaccgatcacgtaagtattcgggtaaatattactgtatgagtggatctcgtgagataaaccttgtgggcagaagaccagtagtgctttgccgttcacaaataatagatttggacactcgatcataaaacccatttcttcctctgtaaaacccaaagttcctaaaaactgccaattttgaagatctttactgtaataagttaggatacttccttgtttttgttcagtttgtgctccgacaatgagcaagtaaccgtcatcataagcaatcagctgaggatcacggatttcttgtgtatatcccggaggtggggagctgatcaaaggagtcggtatcttagtgatattaccatttttgtccatccatgcccctaactggaaggaatgacgtccccaattcgaatcacgcacatttccggtatatgcaaggaacagttgattatcaatcggcaaagctgaacctgagtacacaccgtgactgtcaaatgaattatccggaatcagtttgaggccatcgtttttccaatctatcagattaactgaggagagatggtaccaagatttcagaccatgaacagaccccatcggatatgcttgataaaatagctgccatttcccgtcgaaataggaaaaaccattcggatcgttcaataaaccagtaactggttgtatatggtagcctaagcgccaatgggaagaattgatttttttctctaaggaatgcaaatgttcttcagaccattctttatatggacgataacgatccgttcgtgaccaattttctttaagtttcatgacaaactccttgtaaacgtattcttgacgttataatatatttttcctgatgaaatgtcaaacgaatatcaaaataaagtagcttataaatgctattttttatatataaaaaattattttatttaagatttgataatcgattgacaattgttttaaatcatggcatattgtgcttaagaaaaatttatagttactgcttcaataattttggattaggaggaaatgaaatggattacaaaaaagtagctgaagaaatcagcaaagcgcttggagaagacaatgtacaagcagctgctcattgtgcaacacgtttacggcttgtcttaaaagattcagacaaagtagaccagaaggctctggatgataatgaaagtgtgaaaggaacttttgaagcaaatgatcaatttcagatcattatcggagcaggtgatgtgaataacgtatatgatgaattcgttaagatcaccggcgtaaaggaagcttcaactgacgttttgaaagcggtagcatcgaataagaagaataatcctgtcatgtcctttatcaaggtgttgtcagatatcttcgttccgattgtccctgcattggttgcgggtggactgttgatggctctgaataatgttttgacggcacaggatttgtttggtcctcagtcagtggttgagttgtatccatcagtgaaagattttgctggcatcattaatttacttgcttcagcgccgtttgcttttttgccgattttggtaggtttttcagcaactcgacgttttggaggcaatccgtatcttggagcagcaatggggatggcgatggtcatgccggatttagtgaatggatacagtgtgacgaatgctattgcagaaggatcgatgccttattggaatatttttggaatgaatgtggcacaagccggttatcaaggatctgttcttccagtccttgcagtttcttggattttagctactttagaaaaattcttccataaacggttggctaatgctttcgactacacatttactccaatgctagctattattattactggttttttaacttttacagtagtagggccggtgatgcgtactgtcggagacggcttagctgatggattaagctggttatacagtactactggagctttcggcttaggtgtctttggtctcttctattcgccgatagtcattaccggattacatcaaagctttccagcaatcgagactactttactagcagatgttgccagaacgggtggctcttttatctttccagttgcctcaatggcaaatgtagcgcaaggagcggctgctttggcgattatgctgctgacaaaaaataaaaagcaaaagagtctagctaccactgcaggtgtttccgctatgttggggattactgagccagcgatattcggtgtgaatttgaaactgaaatttccgtttatttgtggaatgattgctgcaggaattgcttcattctttatcggcttgttccacgtattagcagttgcgatgggaccggcaagcatcattggctttatttccattgcacctcgttcgattccttcattcatgatcggaattgttatcagtataatgatcggttttttaagcacttacttctatggaaaaaaacatatggaacttctagcagatggtgaatcaaaaggaacagaagcagctgagtcaatcagttcagctcctaaagcgactaggaaaccgcaagatgaagttttagctgcatcagtcagcgggaagattctccctttaacgaaggtaaaagatccagttttttccactgaaatgatgggaagaggtatagcagtcaaaccagatgacggggtagtccatgctccagcagatggtatattgacagttgtccacgaatctaaacatgcatatggcttgaaaacagagaaaggagcggaagtactgatccatatcggtattgatacagtgaatctaaaaggggccggattcacgacacagcgacaatatggtgaattagtgaaaaaaggggatattctcggtacatttgatcgtaaattgcttaaagaagaagggtacgacgatacaattatggaaattgtcactaattcctctgcatatgctaatgtaaaaattcttgaaaaaaacacggtcaaaagtggtgaagatattctgatagtgagtgaaacagatgaaaaataaatggtggaaaaatgcagtaatctatcaaatctatcctcgaagttttcaagatacaaatggagatggcattggagatattcctggtattctttcaaggttagattatctataaaaactgggaatcaatgcgatatggttaagcccggtttatgaatcacctaatgatgataatggctatgatatcagtgactacagaaaaataggcgcagaatatggaacgatggcagatatggatttactgataaaagaagcacgacaaaggggaataagagtcatcatggatcttgttatcaatcatacgtcagacagacatccatggtttcaatcggcaaaaaaagtgttaccagtccctatcacgactattatgtttggcgtaaagaaccgaatggattagagtcgaacttcggcggttcagcatggacctatgtgcccgaagtgaatcaatattatctgcacttgcattcgaaaaagcagccggaacaatctattactaaaaatggtcctcttttacatgatttattgcaagaaatgtaccaaaaaacatttggtcattatgatgtagtgacagtgggagagacttggggggcaacgcccaagattgcgcagctgtattcaaaagaagaacgcaaagaattatcaatggtctttcaattcgagcatattaatctagacaaacagaatggcaaacgaaaatgggatctaaaggatttagatccacaggaattacatcggactttttctaaatggcagattgaattagatggttgtgattggaattctttattttggaataatcatgatcttccacgaatcatttctcgctgggggacgatcaagaatatcgaacaatcagtggaaaaatgctagcgatatacctccattttatgcaaggtacaccttatatctatcaaggagaagagatcggcatgatcaattatccagtaaagagtattgatgaggtagatgatattgaaagtcaaagaatgtatgcagaacgtataaaaaaaaggctattcgaaggaagagttgatccaatcaatcaactcgaaggggcgagataatgctcgccatccgatgcaatggaacaatcacaaaaatggtggatttacagaaggaactccttggttgccagtggggaatacagaagagatcaatgtagaagcagcattagctgctcaaaattccttgttttatacgtatcaaaaactgatcgaattgcgcaaagaattacttgtgattgtctatggaaaatatcaagtcattaagacagagaaaccgaatgttttagcatatctacgcagttttaaaaaacaaaaaatactagttgtagttaatttttctaatcaaaagactacttttccaatcggtaagtatcgtgtcaaacaagtcttgattcaaaattacaaaaagaaaattactaacaatttactcccatatgaagcttttagcgcgccgatctattaagtgtttttttctatagatgaatctttgttatgaggtagatagttcaatgaaacagttattcgatttgtttatagaaaacaatttagtcagcaaaaagggggacaaacttttaattgtctccctttaattgttaggatggaatattatcactcttaaacaataagttaaaaaaatactcatttacataaaaaaagattatttagatgcgataatatcatagataaagaaacattcatcataagaaacagtgatcccaaattctgtttcaatatttttgaaggccttttttacatgaaaaattgtttcatgagaaggtcttgtgtcatcttctgatataattttaagttcatgaccgtttatcaatgtacgctcaattaaacacgctgtatgaatcaaaagttttaaaagaatggaatgagtgaattttttgtggaaagtacattccaattcttggatgaaatccattaagcttttttggatcttattcccagctaataagtagagatatttgtccactgcttcaattcccatatcaaaaacgatatttcttgtgaatgagtggctgctgcccttttttgattgttgttcttcagtcgtaagatgacaaagcatcttatctttgaataaaaaaatagaactacctaaggaagcgtctcggcgcttcctttttctatatgatcgtttaatgactgtaggaattcagtataccaaaagaaaaccacctttttgactaaacttgatagtggtcaattttttatgatggataagtatctatacttagtctcgtaagaacgaaaaggaaaagagggagaaagatgaaatttcaaaagtggatccaagagcatcgaaatcatatcaccgccttatcagctgtgttgattatttttggttttatcggaaaatttactggatttgtcttgttctataacattgctctagccatagcttctattattgcggtcatacctattatgatctatgcgtatcaggcagtaaaagtcaaagttatctcaattgatttactcgttactattgctgtgcttggtgcctttatgatcggagaatacaaggagtcagctatcgttacattcttgtttttgtttggtagttatctggaacaaaaaacattgaccaaaacgcgggaatcaatcaaggatttgaccgagatggccccatcgactgccagcgttgtccaagaagatggaacgactgaagaagtggaaatcgatgacgtggaagaaggcgatatcgtcttagtaaaaactggtggagctattcctgtggacggccgagtcattgacgggaaagggtatgcggatgaagccgcagtgacgggtgaatcacgacaagtcgtcaaaatcagtggagatgacgtattttctggaacgattttagcagatggctacgtgacgattaaagcaactaaggtcggagatgatacgacctttgccaaaattatcgaattagtagaagaagcacaagataccaaatcacatgcggaaaaattcattgatcgattttctcagtattatactccaaccgttttacttattgcattgcttgttggtctgatcagtcgtgattttcgtttagccatcactgttttggttcttggttgtcctggcgctttagtcattggtgcgcctgtttcgaatgtagcaggaatcggtaatggagcgaaacggggcatcttagtcaaaggcggtgaagcaatggatactttttccaaaatcgatacttttgtctttgataaaaccggtacattgaccaaaggaactactgctgtatccactatcaagaactatacagaggatgaaggggacagcttagctttagtggctcgattagaaacgttatccgatcatcctctggggcgcgccgtgatccattatgctcaggagaaagtccttgattttcaacaattagcagtcaaagataatcagacgatcaagggacaaggaatcacagctgagattgatggtcatgcagtttgtgcgggcaacaccaaattgattgccgctcacaaactttctcttacaccaaagcaagtacaagatttacatcaattacaacaaacaggcagctcagtcattattgtagcaatcgacaaaaaaatcactcaaatccttggtgtgtcagatgtgattcgaccagaagtcgctgaacaattagctaagttgaaacaagcaggagcaaaacatttagtgatgctgacaggtgataatcagatgactgctgattatgttgctgatatgttaggcattgatgaagtccatgctgaattattaccagacgaaaaggttcaatttgtgaaaaaataccaagaagaaggattgcgcgttgctttcattggagatggaatcaatgattctccatctttggctgcggctgatatcgggattgctatgggatcaggaacggatgtcgctatcgaaacgagtgacgttgtcttgatgcaatctagttttggatcgttggttcatgcctaccgtttggctaagaaaactgttttgaatacccgtgaaaatgtagtgattgccattggtgtcgtctcatttttactcatcggcttatttgccggatttatttacatggctagtgggatgttcgttcacgaagctagtatcttgatcgttatctttaacgcaatgcgtttattgtattttggacacgaaagcaaagaaaaaaatcgtaaaacttgataagaatcaatttttttatggaagctgtaatctagaataagactatcaagaaaaaggaaggaagaactacgatgaaaaaaatgattatgcaattagatacactaacttgtccaagctgtatgcaaaaaatcgaacatgcggtttctcaacagcctggggtaagcaatacgaaagttttgtttaatgcgagcaaaatcaaagcaaactttgatccagatgaagtccaccctgaacaattagctgcagttgtggaaaaattaggttatgaagtccaatcaacaaaagtaaaagaggcgtaaatcaatgaatatagtggaagaaaaatttgctcaagaaacaaaacaagcagatatcgaccatcataaaccaactgctggcgccatggtgggacatgtattagcaaattttaaattagaagaaatgaaattgatccaagcacaattgtatgttttgggtacatcttcgcaagaattaagtacccttttttcggaatatgctgatcaagaagcgagatggttcaataaaatctctcatgagttagtgattgagaatgaaatcgttccgtctactttagaagaagtcatgcgttatggaaaaatttacgaacatggtcaaaacaaatatttaccagcctcaacaatgttagaaaactttgcaaaagatttcgatttccaaaatgtctttatcacacgggcaatcaagttagctgaaaaagaagaaaagtatggcttgcaacaattgcttgttgaacttttaagtttcaataaagaaatcatctaccaagtacaaagactccaaggaaaaactctccgacaagatttggatgaagaagacgatgatgactaaaagtctatgtttcttcaaatacaaatataaagtgtgagaaaaacaggaaaaaaacacaacgttttgtcttaaaaataaaataaaaagaagcacccgctgatgttgtctataagacatcagcgggtgcttcttagtttttaaatggtttaaaagatggatgagaaaatacaaaaaatcaataaaatcacattgcttatttgatagaataaagaagtgggggagtaatcgaaaggagtttttttaattgaaaaagaggattttattaacaatgggcctagcttttttgttagctggttgtaccaacgggaatgaaccaagaaaagaatcaacaaaagaaacaattgcaactattacaacaactagcacagagagcaagtcaactgcaacaagtacagaaacagcagatacctctacttcgtcagagtcttccaaaacgactgaaacgactcaaacatctacttcaagttcttctttagaggcttcatcttcctcttcagaaagcagcgaacaagttgaacaaacactgtggaatgcagacaaagccgcacaattagaggcatttatgaccacatggggccaaacaatggggcaacaatacaaaagttatacgaatcaaatgagtgtggacttatatggtcttaaagtccctcaagctattttgaatggggagtggaagatggctattggtggagtgcctgcttctgcagaatggtcagaaagtgggacaggtcaagcagattatcaaattacagccgtctattccgatgcagagacagaaccatatctgaaaaagcacgtctatctatttggatttcagcaaaatcagccaaaagtattggtgacacaacaaaatcaggggaatcccgataattatctttacttcaacgagacagcgaataatgaattgaaaaatggctttaatcaaatcgtttatgggtaagtaaattagtgagagaaagaagagactcagtggaaaatattaattgattgctatgtctaagaattaagatgaaggatgaaacttccagtttcatccttcatcttaattacgttttacttggataactttaataataacgataaatagttttctctcgacttctttagagattgaataaaccctccaatactaaaactgaatgttgcaagagcatgaattgccaattgtattgttagaatttttagaaaattacacctttagtttctttagataaaatgatacaatgattgttaaaattgtgaaagggtggtcatttgttagagaagcttttggatatgtcgttagttcaacgtattgttgttggtattttagtcggaatattgttgggtatctttttccccacatggacatttatttcaatattggggacgttgtttgtcagttgcttgaaagcaattgcgcctcttttagtttttttcttgacgatggcttcaattgccaaacataaaataggaaataagacatttgtgaagcctattttagtcttatatttagtaggaacattgctttcggcacttgtagcagtgattataagttcaatttttactgttcctattactttacaagaaacagtatctgaacaagcaccgcaaaatttggaaagtgttttatctacgatgttgacaaatgtcacacaaaatcctgttcaatcgcttattgatgcgaattatcttggtgtcttattctgggctgtgttgttaggtctagcttttcgatcacgttcagaatcgacaaaagaattggtggatcaaatatctgtagcattatcacaagtcgtacaagtgattattgcatttgctccgatagggattttaggattggtttatcaatcgattgccacgactggaatcgctggattggcagagtatctgcagcttttacttgtgttgattggcacgatgctgtttgtcgcattagttgtgtacccgttcctcacgtttttgtttattaaagaaaacccctatccattgattctcttttgtttgaaagaaagcgcgcttccagctttctttacccgaagttctgccgcaaatattccgataaacatgatgctggctgaaaaattgaaattgacgaaagagtcttattccatatcgatcccattaggtgctacgatcaatatgggcggtgctgcgattaccatttccgtgatgtcattgacggctgtacattccttagggattgaagcaccgtttgttttgaaagtccttttatgtattttgtctgctttagctgcttgtggggcttcaggtgttgcgggcggttcactgttattgattccactagcatgtagtttgtttggtatctctaatgatgttgcgatgcaaatcgtcggtatcggatttattatcggtgttatccaagattcaatggaaactgccttaaattcgtcaagtgatctgttgtttactgcaataggagaattaggcgcgcgtaaaagaagtggagaaaaaatcaaattgaaagatcgattagacggattaaatgaacattgaacattagatatttagggatgaaccttaagacgattcaaatttttaatgagttatatagatgttcctgtagaatagaggttcctgttaaatcgagataaagtcgtttataataacaattaaaagcataggtaattgttattggaggcgcatcatggattttttacgtaaacttggttttttctttttactattaggcgtgttgagtgattttttgactccgtacgtattaggattgtattatcctgaattagatcaaatgaagagtgtgatcagtgtatttggagaggttttcagtcctgtaagaaaggcgtttcttatttggtcagtggtttcagggatttttttcatcctgtcattgcctgcgttgtatgctgcatttgcaagtatatctcgtgtgttagctaccttagttacagcatctatcggtttctatggtataggtgattgtatttttacaggtttgttcagtatcaatactcatgaatcttcgtggaatgtctcgacatgggttcataatatcggatcaggtttaggttatagtggttttttattgtttccagttcttcttttcttgatctatcgaaaaaatgagcaactggacgtaagccacttataccttggactgtctgtgatcagtttgctttttgcggcgatttatggtctggcaagaatcccttctataaattcttggccattactgaataaaataggattttgccaaagaatcagttttttctttaattatgtgcccattgcctggttgagtatcttgcatctcaaacagtaaaacttgagtcgtcaaattgaacagtcatcggacatttcgtccgttggctgtttttttgtttttctgaaatatagttccataattttcttgtataacttctgttttagcgtatattaactgagaaagagcagtgtatgatttctcaggttattttaatcttttatttggtctagttctccttataagaaaaaattatagtgaatatagaaggtgatggaaatgagtgtaatacaatatcaagaaagcaaacttcgaagagtagcgatcctgaacagactgtccaatttcgagcatgtaagctaccagcaactttctgaagaatattatgtttccagaagcagtatcgcaaatgatatttcttacatcaaatatgtatttgcgaaagaagggttgaatctcagttttgatcgtttcgggacatattttgaaggaaatgaaatacaggttcagaaggtactgaagcgtatgatcctgaatcattttgatgaattggagatcgtaagagaaatagtggatcgaaagcttctagaaacagtcgaacgatcttttcgcgagagcattgcagacaagcaaattgagataccagaaagctacttttcaagtatcatcgtttcgatcttattgatgattcagcgttcaagagaagggaagaaaatcagcttaaaaggtaaaaatcaatatggaaagtattttttagaattcaataaatatcccctcgtttgtgaattgctgcatcagttagaggaacagcgtatttaccaattttcgcaagaagaagtacagtatttgacttatgttattgtgggaagtggtttacgctttttcatgaaaaatgaaacgatccctttggtatttcgagaaaaaatccggcaattgatccaaaaagtgagtagaggcattcagatagatcttacccaagatagtcgtttagaagaagatctgcttgtacatctgtatcagctgcttttacgtattgaggctcaaacgaccatcgtaaatcctttgatagatgagataaaacaaaattatccttctttgtatggtgttgtctggtttgcgttaaatgattttcgctggccttatcaagtaagcttgtccgaagatgaagtaggttttgtagctatccatttccaagcagcaatcgagcgtgtcaaacgattaaatagactcttattcgtatgtcccaatggcatgggaaccagttcatttgtttctgcaaaaatcagaagaatcttacctggtatcgatagtatcgaaacagcatctgtcgataaattgaacagactagatttgtttgacgtagatttgattatctccactgtcgatatacctaagcaaattagaccagtagtaagaatttctccaatggttactgctagagatatgaaacgtatcatgaatcattatatcgatctggtcatagataacgaacaaataaacatcgaaggctcgatatctgaaaaagtgaaacatcttatttcctctaatgtctattttgatcacttggattcaaaagaagctgctatccgttttttggttgatcagcaacagtttgagaatgaagatttgaaacaacgatttctccactctatttttgagcgtgaggaaatccaatcaacatacttggagaatggttttgctattcctcatggcaatcctaatgtcgttaaacaaacttcggttgctgtattgatagcagacaagccattttcatggggatatcaaaaggcagatatcgttgttctgctaatgatccgagaagaagatgtgaaagaagtcgaacctgtgatgaaaatggtcatgcaaggaatagaggataaaaattggtttatttcaaaaatgttggaggtcagagaatgagtactatcaataaattgctgccgaaaaatcaaatccaagtaatagaaacggctgaaaattggatgaaagcagtcgaaatcgctagcaatccattattaaaaaacaaaatgataacgcatacgtatttagaaaacatgatcagaagtgtagaggaaaatggaccatatatggtgttggctgattattttgcgctgatgcacgcaaaaccaggtcttggagtaaacgagcaaagtatgagtcttttagtcgtaaaagatgccgtagatatgaaagggaaaccagtccatatttttttggttttagctgccaaaaaccacgaaagccatctggagagattgaaagatatcatggaaatatttatggacaatgaaaaatatcaaacgattttatcaggaaataaagaaacgatcattcagttatttgcataaggaggaagaaaaatgaaaattttagcagtatgtggatttggtgtagggagttctatggttttgaaaatgtctcttgataaagtaattaaggagcttggtttaaaggcgacagtggaaaatacagatttatccactgccaaagcaacgatggcagatgtttattttacaagtcatgaattacttccagaactaaaagcttctgtaaaagcgcctgtttatcctattaaaaagtatatggatacttcagaaataaaggcgcaattggaacaatatctagctgataagggggaataaaagaatgaatttcattagtgaacacatcttgaagaatccgcccgtcttgttaggtttgattgcgatgctcgggctgatcatccagcgaaaatcattttcagaaacgattaagggagctttgactgctgcatttggtatggttgctttgaccgccggagtcaatatgctggtcggaacgatttctccaatcaatgtagctgtccaaacacagttgggtgtagaagtgacagaaggactatctgatgtgacgtttactgcagaatatggcggaacggtcggattagctatgtttttaggattagttatccatttattgattgctcggtttacacctgtgaagacgatctttttaacaggtcatatgctttggtggtttcctttcgtatttgtagcagctggtgtggaagcaggactgtcagggggagcattgattggaatcagcgggattttatcggcttgttattggtctttcatgccgtggatcatgcgcaaatatgtctgggatgctacgggagatgattctttcctgattggtcatccaacgggtgttttgtctttagtttcaggatttgtagcaaaacgagtaggaaataaagaaaaatcgacagaagatatcaaagtacctgagaatctttcatttttccgagaaatctcaattacaggtgcactagtcatgttcttgatgaataccgtagttgggatcatcgcacctgttttgataccagaaggggataatctcctgatgttttcgattgaagcagggttgaattttggtgcaggactactcattatgctatatggtgtccgactactgatcaatcaaatcatcccagcgtttcaagggattgcagaaaaagtcgtaccgggagcgaaaccagcatttgatgtgcctattttattcaattatcgaccaaatgcagtgattatcggttttatcgtggcaatgatcacttctacgattttagttgttttggcgaattcattccatctattcggcgtgttgcttgtgccattagtaatcacaagtttctttgaatgtggtggtgcagcagtcatcggtgaaggtcaaggtggctttcgtggagcggttgtcggaacaatcgcagcttcatttgtcatggtcgtattagctggtttttcagctattgtttttagtacgacgatccaaagctggatattgattttcggcggaaacgatttgtcgttatggggaatgatcggtagaggattcagcggtttgtttggagggttctagatgttcaaatatatggataaaatcaaacagttattagatttggttgaaaaggaagaaaaaaagtcaatcaaagaagcaatcgatgtattgacccaagcgaatctgcaaaaacgttcggtctatatttttggtgctagtcatgctggtattttagcggaagagatgtattatcgggcaggtgggatgatgaccatcaatgctatctttggacgagaagtgatgctagatcgttcccctattacctttaccagtcaaatggaacgtttagaaggatatggaacgaatttagcaaaaacagtttcatttaaaaatcaagatgtattgatccttcactcagtatcgggaagaaacccaatcattattgatttagcgttagctgcaaaagcgaaggacgtaaaaatcattagcttgacgaatgtccaatattcacgatcggtgactagtcgtcattcatcagggaaacgattgtttgaggtttctgatatagttatcgataaccatggggatataggagatgcttgctgtgagctgacaggtatcgtacaaaaagtcggtccttcctctactgtaatcggtgcagccatcctcaatacgatcatcgtggaagtttgcgaacagcttattgcaaatgggataaaacatcctcctatattttattcggcgaatttagatgggggcgatctgcgaaacacggaattatatgaggaatataaagaagtgattcattatgaattcatgtaattcataatggcaatttatcttttagaatataagtgaaataaaaagggctgcgacaaaagtattgtcacagtcccttatttcgaacaaagggtgttccagaaatatctttcggaaataaacccaaatttcttgaattatttaaaagaaaatcggtttttcaagataatagtgaataagaagatgatccatccaacgatagtgagtatccaacctgtcgttaaaccaggtgtatgatagatcagtttgatttgatgattacctggattgaggagtagtcctgtatacatataattcgattggataattggtattttctttccgttatcataagcagtccatcctttttcataagggatagttaataaaagcagtttttctttttccagatttagttcaccagatacttcatttgccgaaaaatggacattctgaagtgtgttttcccttaatttagctatttccgtacttaattgactatagtcacgcgtatataactcaatagaatcaaatgtatagactccttgatttctaaagctgacttgaatagtttgattaggttgcactgcccctaaattaagtaaggaatttttgatccctacgtaccatccttgatattgatttcgaaaattaaactcttttgacagttgtccataagttacttttaaatacgtggcagtctcagttggaagaaataatcctggttgtgtattaggataatttattcccttaaaccgtagaaacaaataattgtttgtcaaatcagatggagcgtctacagagaatgtaacagttgcattgttcttagaaatgatatactgatttccttttatctctactccatccgtttgctgaatatgatcgttcagttttttgattcctttatcggtcatctgatttttctttagaccagagatatctttatttataataacactttttgtcatactatccataatagctaacgaactagtttgagtatcattttgtttgatataggaatcgtacgtatagccaaaaggtaggaaatttgtattctgatagatttctacatcttgaccatttttattgattgtttgtaaataagtataaccaaaaggaatatcttgattagtgtcagtttttagttttgcgtaatatttgctatttgctaaagtgcctaattctgcacgactatctagcccataatattcatagtcactgttgatattgttctcaatagactgattgaaggaaaaaatatttttatttgctaaactaaaataaaaattcgtactatttattccccttaacaaagcattgttttcttcggaacgaggatttccagttttagacaattcataccgagaccagtcagtatctttattgataatatctgagatagctgaactttttggtgcccaataatcattttctacgatatttttatcagtataactgttaatgataaggggattgattttgatatttgtttgaaaggctccataaactagagcattcaaaaataccagtatactcaacgcgatttttgtttttttcgaattagcaaacaataaaaagatagttgaatagagcaacaggaagatcaaaccgatataaggcggtacatctcgcttatagtttgcaaaagtgaaaaggataaagaaaaagaaaacaataaaagaaatatgcacaaaccgttttctttttgataaatcagttgcggattcaactaaaacaggtaagtattttgctgttagaaaagcccaaaagaatgcataaccaaacatccaacgattcgtgctataagagaatccgttgaaaagactaccaaaaaatggaaagaataaaaaaatagtcaacaagctaatggctaaaagatcaagtcttgcaaaattatttttttgcttagaacgatataaaataacggataatacaaaaacgatgattgggaaaaaggctgtgacagttgaggcttctcctccgtaaactggtgaaataaagtttttcacaaaattcaaataaaatgatttcgtgtaaaaaggtaagagcgttgaatgaatctccccacgtccagcattgaaaaattgattaattacgggaatgaaaataacggagcccatcattattcctaatacgtaactaccaatagatttgaataaaagagaaaacaacactttatagtcctttaaagtataaagttcaaaatatctgtaaacagcgtataaaaagattaagatagaaagcatataaaagaaataaaagttgctgataacagaaatgaaaatcataaacgtaaagagtttatatcctcttttctcgaagatatactcaagccccaaacatagcaatggtagataaatcatcggattgatgaagtaagggtgtttccaagcagaacttagtacgaaaccagagaatacataaatgaatgtggcgataaaagtttgatagttggccattttcttatatcgaagaaagatcgatatagagattccggaaaagaaaatgcgtaacatgattgctaatgaaaaggcaaattctgcatactttggtttagcaaatactgctaatagtgaaaacggatcaccaatgatatagtaatgtaatgttcctaaaatatcttgaccataaccaatactaaaatcataagttgagatagaaaagttatgatcaatcaaaatatttttgattatttcccgaatatattcgccaaaataaacaaatgaaacaaagtgttgggattgaccatcccatagctcaacaggggcttttccagcaataggccaccacatataaagactaacgataacgacccataagcagatgcttaaaatagaatagtaagtgaaagcatctttttttaacagttttttcaaaacaagttcctccgataatagattaaagaatatatatcaagtatagacaatgagaattaggaaaactagcattattttaaaatgagtatctgaaaatcaaggggacatcaatagtttgcaagctacgctatttagattatgttatactcatgaagcaaataaattgtaactgatcataaaggagttaaataaatatgagaaacatcaagttgacaatcgaatatgacggaaaaagatattcaggctggcaaagacttggagatgacgataaaaccatccaagggaaaatcgaaaaagtgttgcatcagatgacaaatgaagagatagaaattattggatcaggaagaacagacgccggcacgcatgcacgaggacaagtggcaaatttcaaaacaaacacagaaattgagctgtcagaaatgatcgactttatgaatcgttaccttccgcgagatattgtcatcaaaagaatcgaagagatgcctgagcgcttccatgcaagatataatgcggtgggcaaaaaatacagctattatgtttggaacaacgtgattccttcagcatttgaacgaaaccacagcttttattttcctcaagagttggatatggataagctgaatgcagcttgcgaaaaattgatgggtacacatgatttcattggtttttctgcattgaaaaaatcaaaaaaatctacggtacgtacgattgatgaattatctatcgaacgtaagggagaaatgcttcattttacttttgtcggagacggatttctatataaaatggtgcgaatcatcatgggaacattactagaaatcggtacaggtgccatgccgatagaaacaatcgatgaaatattcgaaagcaaagtgcggcaacatgcaggagaaaccgtccctgcacaaggtctgtttttggatgaagtttattatcgttcataaaaaaagaatcatctttactcgacttctgagaactggaaaacatcccttttttcagaggtcgttttttagttaaatcaaaccatagaccatagagtatgctttttaagataaagatcatcttatatcatctgaagccgcttatcttctttgaataaatacgattcaatcgcttatttcctcactttatgataaattacagctaaagtcactagcttgtcttcttcggaaaggaggagagtctatggataaggaacaagtattcattcaaactctttataatctgattttaaatccgaatacacgagattgggaacgaaaagtattgatccagacaaagaatgacataagagaaaatacatccgttaaagaacagttatcgaaactagaagcaacactacgtccattagctatccggaagaacctaacgcctgatgtaatggatttttatttattgcttacagaaggatttgacacgcagcaaaaatatgacttttccaagcatgctatgcaagatgctgactatcaagaacgtgcagtatttgcagggggatgtttctggtgcatggtcgagccgtttgaatcgaaaaaagggatcctatctgttttgtcaggatacacgggcggacatgttgaaaaaccaaattatgaacaagtgagcggtggctacacaggtcacatggaagctgtggagatcatttatgatacgagagagataagttatagcgatttattgacaatctattggcaaataactgatcccacagatgcctttggacaatttcaagatagagggaagcaataccgtccggtgattttttatcaagacgaacgtcagaaagaattagcggagcaatcgaaacaggaactagtcagttcaggaacgttccaccaaccaatcgtcacaaaaattgaaccagctagtacgttttggccagcagaaaattatcatcagcaattttacaaaaaacaaccgaaacgctataaaaaaattcagcaagcacgtaagcaatttctgatttatcaacgaataaaaaaacaaatggtaaaaaaatacaagaaaaaatcattttgactaactccttttctttaaaatgtagtaaactaaaagcagaataaaagaaagcgttttaaaagtggtaaggaggagaaaatttgtatattgcagatagtgcacgttatgaaaaaatggaatatcgtaaatccggtcattcaggtttaaaattaccaattttatctctcggattatggcaaaattttggagattatgatcctatccataaccaaagagagattttaagaggtgctttcgatatgggaattacccatttcgaccttgcgaataattacggaggccctgctggagctgcagagaaaaacttcgggcgtatttttagagaagactttcaagcctaccgtgatgaactgattatttctagcaaagcaggttatcatatgtgggaaggtccatacggagaatggggctcgcgtaaatctatcatttcaagttgtgatcagagtctccaaagaatggggctagattatgttgacatcttctatcatcatcgtccagaccctgatacacctttggaagaaacagcagaagcattgatgcaacttgtaagacaaggaaaagcattatatattggtatatccaactataatggagaagacaccaaaaaaatgactgaaattttaaaaagaaaagaagcaccgttcattattcatcagatgcgctacaatatgttttctcgtgaactactagaagacgacttatctccagtattagaagaagaagggctaggagcaatcacgttcagcccgcttgcccaaggtttgctgacaaatcgttatctgcatgggattcctgaagattctagagcacatcgtaaggaaataccattcctttcagaagaacaagttggatcaactctggaaaaaatcaaagcactgcagacaatcgccgtatcacgagggcaatcattagcgcaaatggcccttgcatggaatttgcgacaaaaatctgttacgagtgtactggttggagcaagtcggttaagtcagttacaagaaagtattcgaatgatggataatttagatttctcaccagaagaagaattgaaaatcgaccaaattctagaatagaaaagatgtaatcaaattttttatccatctatcaaaaaatgaacaaaaaatgtcatcaagaatcgaatgaagatcatctattattgaacatcatacgttttgtcgttcaaaataaaaaggatcgaaggctaggagtgaattttatcctagtctttttttatggtaaatagcttcgtttgtatatccatgaacggatgaatcgattttttatacaaaaaatcatcagatgattcaaacgtgttataataattacgaaaaaatacatcagatgaaaaggaggtatgtggtttggaagaaaataaaaccctagtagaagtaaccacggacaagatccttagatatttaaaggaaaagcagttgcaagtaggagataagttgccgaatgaatatgagttgtccgattatttagaggtgggacgcagcacggtgcgagaagctgtccgagcgcttgcttctaggaatattcttgaagttcggcaaggggcggggacattcgtcagtgataagcgagggattgctaatgatccgctcggtttttctttgattgaagatcaggatcggatgatacgagacttgtttgagctgagatatttattggagccaaagatggcagggttagcggcggaatatgcaacgaaaaatcaaatcagccgaatgaaaagcttaacgcaaaagattgaaacgtcttttcgagaaggtacacaagatcatgttcaattagacatcgattttcatacgacgattgcagaagctagcggaaacgtagcgttactgcatatcattccgatcattaatgaatcgattgctttatttaataaaaattatgatatccagcatttgaaaatcgagacgatcgatatccatacagaaatcgttcaggctatcgagaggcggaatgtacttgcggcatttgatgcgatgactgtccatatggcaataaatcggagagaattacagaaaataattgggaagaaagaaactaattgacagttcatctgatgtattttatgataaatacatcagatgaatttttgttttatatttggtaaaacggacaagcaaatagtttttattcaccggaatgtaagcgctgactaacagacgaaaagagatgacggcaaggagaagaagtaggaatgaggggatctggaatgagctttatggataaattagccaatgttttagggaatttggcaacgagaatcaataatttaaggtatatcatggtgataaaaaacgcatttgctgcattgattccggtaattattacgggtgcttttggcacgttgttttcagcaatggtctttgattcggaaaatgggttagcacagataagttttttgcgttttttagaagaattaaaacctatcgcatctgccatcagctatgtcacactaagtttcttgaccatctatgctgtttttctgatagggatcgaattagcaaagctgaataaagtgaatggtgtattccctggtatcatcgcagtgatgtcttatttatctgttaatccaactgtttatgaattagtgaatgaaaatcagactgttatagtagaaaacgtattggctaaacaatatacagatacgaaagggttatttttgggaatgttggtctccatcctttccattgaactttattgctggttgaggaaacagaagaaactacagctgagaatgcctgataccgtgccaacgaatgtttctgccagtttttctgcgttatttcccacgattctgacagtatcaggtatcgcggctgcgggatttatcatcaaagaacttacagggatgtacctttatgatatcatttacaatatcgtacaacgcccattagaaggtgtcgttcaagggctacctggtatcttgttactgatgtttattgcacaagtcttttgggtgattggtatccatgggaatcaaatggtgaagccaattcgagaaccgttgcttttagcggcaattgctgtaaatacggaagcttttgaagctggaaaagaagtaccaaacattatcactatgccattttgggatatgtatatgagtatgggcgggtctggggtcacgataggtctactgatagcagtattgctagtgggaaaacgagaagatatgaaacaaatcaccaagttatctcttgctcctgggatcttcaacatcaatgaaccagttatttttggtatgccgatcatgctgaatcctattttagctatcccgtttatcttaacgccgcttgttacaggaacgatcggttattttgcaaccgctttaggatttgcggcaaaagcagttgtaatggttccttggccgatgccgccgatcgtcaatgcttatctggccacagcaggaaatatcggtgcagttattacgcaacttgtttgtattgttgtttctattttgatttatctgccattcgtaaaagtagcaaattgtgtggaaaatgatgggatctaaaaaaaacaggaggaaatcatgaaaattactattccagaaaattttattcttggtgcagcatcttctgcttggcaaacggaaggttggaaaggaaaaaaagaaggacaggattcgtttatagatagctggtataaaaatgaacattttgtttggcataatggatatggtccagccgtagcaactaattttatggagcagtaccaacaggatatagatttgatgaaatccatccatctgacacattatcggacttctatcaattgggctcgttttttcactgattacgagaattgtatagtagatgaagaatatgctcagcatataagtgaaatgatcgactctttgatcgaagcagacgtagaaccgatgatttgtttagaacactacgaagtccctgcttttcttttggaaaaatatgatggctggtcttcaagaaaagtggttgatttttatgctaagtacgcaaagattgcttttgatcgttacggtgacagggtaaaaaactggtttacattcaacgaaccaatcgttccccaaacgcgttgctatttggatgctgttcgctggccgcatgaacaaaacacaaaaaaatggatgatgtggaattatcacaaagttttagcaacggctaaagctgtagaaatttaccatagtggcaattatggcggaaggattggctgtattttaaatcctgagatggtctatgctcgttccagttctccagaagatcaaaaagctgcttatatgtatgatctgttttataatcgagtattttttgatccgatggtaaaaggatactacacagaagagttcctggagttgtgtcgaaaacaatcgatttatttcgatcctgcaacagaggatttagaaacgatccaacatcatacagtagatttccttggaatcaatcaatattaccctaaacgcgttcgtgctcctcgttatcaatggaatgaagagacaccgtttcatccagaacgatattatgaagtctttgatttacctggaaagaaaatgaacaattccagagggtgggagatctatccaaaaatcatgtatgatatagctatgtatctaaaagaaaattatcgtaatattccttggctgataacagaaaacggtatgggaagagaacatgaagaacagtatatggatgagaaagggatcgtgcaagatgactatcgcatcgaatttatcggacagcatttgcgttatttgatcaaagcagcagaagaaggtgccaattgcgaaggctatatgctatgggcattcactgactgtgtttcaccaatgaatgcatttaagaatcgatatggattagttcgaatcgaattgaacgatgaacgaagcagaacactgaaaaagtctgcttcatggtatcagtctctgattgataagagagaattaagcttacctgatgaagtctataaataactagaattttttcgaagatattgattctatttgctggctatttgaaataaaagaggttgtgaaagtagcattttaacctcttattcaaaaaagttgtgacaaaagatttgtcataactttttttgtgcacgttaaaagaaataaacacaataaaaaagaatttgtgtgtttagtgtgcgctttcttttttagtgtgtatgcaacttggtatagaccataaacgtgataatatcaactttttaaagcgcttttaaagttggcacactacttgctttatatacaagtgtaagaatagaaaggaacgtgtttaaaatggaaaagagaacaatcatgcttgtatgttcagctggaatgagtacaagcctcctagtcacaaaaatgcaaaaggcagcagaagcaaaaggaatggaagcagatatctttgctgtctctgcctcagatgcagataatcaactagaatctaaaaatgtagacgttttacttttaggtccgcaagtacgttttatgcaaaatcaatttgctgaaaagctagcacctaaaggcattcctttagatgtgatcaatatggctgactatggcatgatgaatggtgaaaaagtacttgaccaagcagaaaaactaataaacaaataataaaaatatcggaggaaacaagaaatggaagatcaaaaaaatctagaagccatcatgggtctgattatgtttggcggaaatgcaaaaagcgatgcaatggaagcgattgctgcggcgaaaaaaggagattttactttagcagaggaaaaaatcaaagatgcagaggaatctttagtccaagcacatcactctcaaacagagatgctgacgcaagaagcacaaggaaaccacgttgaagtaacacttttgacagttcacagtcaagatcacctgatgacatctattgcttttacagatttagcaaaagagatcattgatctgtatcgtcggttggacgcgtaatccacagtaaagaaaagagggaagatttatggataaatttgttgcatttatggagaaacattttatacctgtcgcatcaaaaattggtgcacaacggcatttagttgcgattcgagattcatttatggtgagtatgccgttaatgattttaggagcattagcagtaatgatcaataacttaccgattcccggtttccaagaattgatgaattcaatttttggcggtgaatcatggaaaggattcggagctgcagcttggaacggcacatttgccattctttctgtcttgattgctttcttacttgcgtatcatttagctaacggctaccgaaaagacggtgtttccgcaggtgtgatttctttaggctctttctttgctttaggcggagcattaggtatgagctcaaacggtttgtttattgctattattgttgggattatttcaacagaaatctttgtacgtttaagcggaaatgaaaaattgatcatcaaaatgcctgatggtgtgccaccagcagttgcgaaagcatttgcttcattactgccagcaatgatcactatctctgcctttgctttagttgctgcaatttttgctgcatttggggttgatgatatcgtgggttcattctatacagtggtccaagaaccatttatgggacttgcgaactcttatccatctgcattattgcttgcatttatcaccccattcttatggttctttggtttacacggggcgaatatggtcgatcctttgatgcaaacgatcaatgcgccagcaatcgaagcaaatgtcaatgcgatcgcagctggacatagcgcgccatttatcgtgaacaaacctttcttcgacagctttgtcaatttaggaggaacaggtgcaacattaggtttactgttagctatttatttagtaggacgtaaaaacaaaccatatatggttgtaacaaacttgtcgattgcgccaggtgttttcaatatcaatgaaccaacgatgtttggtttaccaatcgtattgaatccaattatgttcattccatttattttgacaccaatggttttagttagtgttgcgtactttgcgacttctacaggtttagtgccagcagctaccgttatgccaccatgggtaacgccaccaattattggcggtgtattggcaacgaagagtattgcaggtggtgtactggccgctgtcaatctgatcctttctattttgatctatctgccgttcgtcaaggtagctacgatccaagaaagaagaaaagaagctttggatgcttaatgaataaagaaagcagaaccggttatctggttctgctttttttatgaaaacaagtaatttaaaacttaggatcgaataatgaatgagaaaatcgaggtatatttgtcttggaatttgtgtataaaataaaaaatcccattcattcaaaaaaatcgagcgattgaaaagctatttgaaatacaaggtgctataatagaccaaatatgaatgggagagagtacaaatggagagaagaacagtcataaaattgcgggatcgaccgacgttgataaaagaaacagccgaatggtttgcttcaaaatggcatctgccagttgctgtttatgaagaaagtatccaagcaagcacgagaaaaaacgcatcggttccgcaatggtatgtggtgttggatgagtggggagagattattgcaggtgcaggtgttgttgacaatgattttcatgatcgagtagatttgactccaaatgtctgtgcgctgtttgttgaaaaagactaccgaaaccaacggattgccaaaatgattttagaaacgatcaagcaagactttgcagaaatgggcgtaaagatgctttatcttgtgacggaccatacggatttttatgaaaaatacaattggcaatttatcgggatggctcaggataatgaaggaattcctgtgcgagtgtaccaaatgccgctgtaagagtaggtacatgaaacagcatatagagaaggaaaccgaaaaattgttctatacttagaaattttttcgaatcgcagtaggcgaaatatgcacaacacaagaataacaaaaaagcatggagaaggctaaacgcccttcccatgctttttccttgttcttttctcgtcgtaaataaaaatgttcctaacgattctgagaataggacgaatcgtcaagaaaatagcaccagccaaataaaaataggtgccatatcgatcggggattttagttaaggaagcaaggcttccaaaaatatagaaaatcccggttaataaatcgacagctagtgagatcaatgtgtaacggttttggaaatagaagcggaagcgacgccctcgtatttcgatatcttcttcttttcctatttcaatctcatgggtatttcgtttgattttgggcataaagaaaatcacctgtattttttactgatttcaaggtttcaaaacaacttttatatttttatcttcttttttgtcaaagatctcatatgcttgtgctgcttcttctagtggtagcgagtgagtaatgatctgtgtaggatcaaatagtccttctgcaatcatttcgtagattttcggcatcagatggataatgggtgcctgtccatgtttgaccgcaatatctcgcatgaaaaactcttgaagcgggtaagaagaagctggcgtcatatacacaccagttacttggacggttccgaattttttgacagcttgcgaagccatctgtaaaggcgaaatcgtgccactttgtaggctcaccaaattttttgctttttcttttacaggctctaacccgtccattcctacacaatcgatgatgacatcggcaccacctttagccaactcatataattccgttccagcttgtgctgtgtcttctaagaaataagtttccacgccgttgtaattagccgctttatctaaacgatgttgtactggatccactgcaatcacgcgctctgctccagccattacagcgaatttttgagcaaatagaccgactggaccagatcctagaatcacaactgtatcgcctttttttacgcctgcattttcaacgctccaataagctgtaggcaaaatatctgatagaaacaaaactttttcatcaggaagattattatctggaacgacaaacgaagtagagtctgcataaggtactcttaggtattctgcttgcccaccccaatgattgccattcaacttgccaaatccgaaaagcccgccatataactgatctggatttgattcatcacattggctttccatgtgattcaggcagaaatgacaatgaccacaactgatattaaaagggataaccactcgttgcccttttttcaatgtttgaacttgtgatcctacttcttcaacgattcccataggttcgtgacctacaacataccctttttccaaaactgcttcaccatgatggtaaagatgcagatcggatccgcaaatggcggttgctgtgatacggatgattgcgtctgttggttctaatattcttggatcatctacgtttctgatttccattttttgttttccttgccaagtgactgctttcattggagatgctcctttcagattcacaaaattgtctgcattattggtactacagatagtttcattctaaaggagttcttatctttttgataatgaaacgcttttttctcaaaataaaaatcctcaaaaaagcaagagttccaaaatttttttttattagaaaaagaaggtgtgtgccttcattgtatccttacgtacagtaaagtatagttgaactattgaatcattttaactatttaaacaataaccaaccatcattcgtttcagtgaaaaaacaaatacgaggaggcgtaatgaaacaaattcaaaataaatggaataaacggatcattgttatgattagttctgtctgcctgttttgcctgactgttatgctttgtttaataagcaccttggcaaatcaacattttatgttagagcaaaacatgcaatcggactatgcgaaaaaagtagctgctgagatcaatcaagagatccaaagctatcattatgagattggagctccggctgaagcattggaaaagattgtttctgaagaactagtacaaaaaaatatcgagcttttcatccgcaacagatatgaaaaagaaccagtagaactgatcggagaaaaggaagtagaagaaaagctccaagagataatcaatacatacaaacaagaagaagcagaggatgatccatttgctagtgaagaaaacaatttactcatctatatgacttctgggatttttcgacgaggaatacaatcaatttatttgatgtcgttcatcgatcagatattgacgatacgagagcgaatggtttcttttcttccagtgatcagtagtatcttacttgtattgctgagcggagtgttttacttatacagaatgtcttggaaaaaagttctttggtcatttgcagtggtgattggaggagcaggcttccaattattaagtctgtcagtcagtctctatttgtacgatatgaccagtcagttagatattcgaacccaagcactgcaacatttgttagacacatatattttgtcattcatccaattttttagtgtagtggcaatcgttgaagtagtgatagcagctggattatggtggattggtaagagagtgaatactgaaaaaatggttttttcaaaaagaaacgaatataaataacaagaggttgtgacatgaaatctgtcacaacctcttgttatgaataaacggtgttcccctaccaactcctcggtcacaagtcacaatattcataaaacataggaagctattttttgaaattgttccttgtgactcggagctgaacggtaggctcacaacctcttggtaaacggtgttcaaaagccagtttctcggtattaagccaaatttatgcaaaaatatagaaagccatttccacaaaatttttcttaatactcgaaactaaacgactttttcacaacctcttggtaaacggtgttcaatcagctgaccctcggtattagctcaaaaaatggcaaaatatgaggaactattttgccatttgtttctctaatactcaggtcagaacgctgattttacaacctcttccttaaacggtgttcaaaagcttgcatttgcggtaataagcctaaccaaacgaaaaatatgagaagctatttttgcttggctgttcttattacttgatgcaaggcagctttttcacaacctcctgattattcaaacattttttttgcggcacgagctagagtagggatgtctttgtcgtaacgcggtgttttgacaagacgggacatagggatgcccgcaaaatggaaagcagcgatttctccagaacgtacagcactttgttcagtaaagatcatctgataaggctgctcaacaaattctcctgtaaaggccagattggttgaatgtttaggaatgacttttggtcgatcactttttgcacggttattaaataatgcggaagcataaggcatatagacagggatattatttattacgctgtcgaaaatctctgtttctttttcacgaatattcactggtccaggatctacttttgaaagttgtccaatcagttcttccaacatttcttttccgttcatcttaatatactgtttatccacaaattcgccacgtcgtcttggataaaggaaataaccccaaataactgtttcatttggtttttgagacgtaaaatgcggttgatgatgcacgacgatagacatattgacatctttttggcctaacgacgtgatcggtgtggttgaaataaatgaattcaaggcatttcctggttcttgagtcgtgatacgggtgatttcattcaacaacaaatggtttttcgtcgtcagggtaaagctgacccattcgctcgcatctcgatccgcgaaaaatttatcgggatttcctaagttatagaaacgttcgctggcttttttccagagactagaagctgcaccataatccatattttctacagctggtgtttcgtaatctcccaaagtagctgaatctgtaatggaaccattcgtgaaaatgaccgctgtatcttcatctaccgtgacatgttcctcttcctgagtcaatgtattggtcattttcaaaccagtcacagtgatttcatcttgcatcggtgtttctttgaattcccagtcagtgacacggcggttcaaaatgattttgcatccttgttctttcaagtactcgatcaaaggaagcatgatactttcgtactgattgtaacgtgttcgattgacgcccactaaatgttcgatttgagtgaattcataaatcatttgatgcatatagcgacgcaattcttgagcagaactacgtgttctgaaagcaaatgttgtttcccacataaaccagaagtttgtttcaaaaaagtgtggatcatctttgaaatattcttcgatagtgatattgtctagtttttcttcttctgaatcaggcatggcaatcagtttagtcagaagaatacggtccttgttgttgaagcccagttttccgccgtcaatgatccctttaccaccttccatcaaacgtgctttgtcaaaggtacggtgttttgcatcaaaatctctcgtatcttcttcagcagtcattcctggctcagtaacagaaggtattcgacttaatagatccatcaaatctacataggtacggtaattaagcatacgaccgcctcgagcaatatagcctttttggttttctaatggatgatttttattccaatattcatccactacagtgtcggtcggtgcaccatcatttgaaccgtgatcatccaatgaataaaaggtaatctgatcccctttccatttgccttcttgaatcaaataaacagccgctgccatattggcaataccggcaccaatcattattgctttactttttctcattgtgattcctccaatgtcttccaagtatgtccgtagtgattcaacgaaataggatgctagatggattcaaattcatcatataaatgactgtcatcttcgaatagccctgttttttttcctagatatgcagcgccaagggcaagcaaacctaaaccgatgccgactttgattaattttttactcatgaaaaacgcctccttgttttctctttctatatccaaggatagttcgtttttatgagaatgccaaatgatagggtgagaagaaaaaggaaattttgacaaaaaagaagaagtgtctgaatgccgtgtaagaaaacaagaaaatggaagaaggaaaaaagtagaaaaagacgtacaaaaaataacaataaatatttttgatgaatgataaaacaacgtacaaaaagtctgaatagcagaaaaaagtgaatcatattaaaaaaattatatgatataattttagtgaaaatggtttcctgtctggcaagaagatgaagggatgattttgaaaagcaaagcacaaaaaaagcgccgagaacagcgctgctttaaaaaagctgatgacggacaaagccttattttaacttgctatattgatttgaatgctaccaatatgtttattatagcaaaaatcacagcttttacaataggtgttttcgttttttcaattatgatgagctgttggatgaaaggatgatttagcgcatgaagaaagagtatacgatcggattagatatcgggaccaattccgtcgggtggtccgtattgacagatgactatcgactggtttccaaaaagatgaaagtagcaggaaatacagaaaagagtagcacgaagaaaaacttttggggtgttcgactttttgacgaaggccagactgccgaagcaagaagaagcaagcggaccgcgcgcaggaggttagcgagacgcagacaacgaatccttgaactgcaaaaaatattcgcaccagagatcttaaaaatagacgaacacttttttgctcgactgaatgaaagttttttagtcctagatgaaaagaaacagtcgagacatccggtctttgctacgatcaagcaagaaaaaagctaccatcagacttacccgacgatctatcatttgagacaagcgctagctgactcttcagagaaagcggacatccgtctcgtttatttagcgatggctcatctcttgaaatatcggggacattttttgattgagggtgaattaaatacggagaattcctcagtgacagagacttttcgtcaatttctgagcacatataaccagcaattcagcgaagcagacgacaaacaaacagaaaaattagacgaagcggtcgattgttctttcgtttttacagaaaagatgtcgaaaacaaaaaaagcagaaacgctcctgaaatattttcctcatgaaaaatccaatggttatctcagtcaatttataaaattaatggtagggaatcaggggaatttcaaaaatgtatttggattagaagaagaagcaaaactgcaattttcaaaagaaacatatgaagaagaccttgaagaattgttagagaaaatcggagatgattacatcgatctttttgtccaagcgaaaaatgtttatgatgctgtcttgttatctgagattctttctgacagcacgaaaaatacacgagcgaagctttcagcagggatgatcagacgctatgacgcacataaagaagacttggtccttctgaaacgatttgtgaaagagaatctgccgaagaaatatcgcgccttttttggggataattcagtcaacggatatgcagggtatatcgaagggcatgcgacacaagaagatttctataaatttgtcaaaaaagaactgacaggtatccgaggcagcgaggtgttcctgacaaagatcgaacaatagaattttttgagaaaacagcgcacatttgataacggtgtgatcccgcatcagatccatttgaccgagctgagagcaattattgcaaaccagaaaaagcattatccttttttaaaagaagaacaagaaaagctggaaagtttattgaccttcaagataccgtattatgttggtccgttagcaaaaaaacaggaaaatagtccatttgcgtggcttatcagaaaatcagaggaaaagatcaaaccttggaacttacctgaaatagtggatatggagggctctgctgtccggtttatcgaacgaatgatcaacacagatatgtacatgccacacaacaaggtattgccaaaaaacagcctgttgtatcagaaattttcgatctataatgagttgactaaagtaagatatcaagacgaacgtggtcagatgaactatttttccagcatagagaagaaagaaatctttcatgaattgttcgaaaagaatcgaaaggtaaccaaaaaagatttacaagaattcttgtatttgaaatacgatatcaaacacgcggaactgtccggcatcgaaaaagcattcaacgcttcctatacaacgtaccacgattttttgaccatgagtgaaaataaaagagaaatgaaacaatggctggaagatcctgaattggcatcaatgtttgaagaaatcatcaaaacgctgactgtttttgaggatcgggaaatgattaaaacaaggctgagtcatcatgaagcgactttaggtaaacacataatcaagaaacttacaaaaaaacattacactggttggggtagattatcgaaagaactgattcaaggaatccgagacaaacaatcgaacaaaacaatcttagactatttgatcaatgatgacgattttcctcatcatcgaaatcgtaacttcatgcagctgatcaatgatgatagtttatcgttcaaaaaagaaatcaaaaaagcacaaatgatcacagacacagaaaatctggaagaaattgtcaaagaattaacaggcagtccggctatcaaaaaaggtatcctccaaagtttgaagattgtagatgaaatcgttggcatcatgggctatgaaccagcaaacatcgtggtcgagatggccagagaaaatcaaacgacgggcagaggactcaaaagttcacggccgcggttgaaagctttggaagaatcacttaaagatttcggcagtcaattgctgaaagagtatccgaccgataacagctccctgcaaaaagaccgattatatctctattatttgcagaatggtcgagacatgtatacaggtgcgcctttagatatccatcgattatcagattacgatatcgaccatattatcccaagaagttttacgaccgataactcaatcgataacaaagttttagtttcctcaaaagaaaatcgtctgaaaaaagacgatgtaccaagtgagaaagtcgtgaaaaaaatgcgcagtttctggtacgacctttattcgtctaagctgatcagtaaaagaaaacttgataatctgacaaaaatcaaattgacggaagaagacaaggcaggattcatcaaacggcagttggtggaaacgcgtcagattaccaaacacgtagccggtattttacatcatcggttcaataaagcagaagacacaaatgaaccgatacgtaaagttcggatcatcacgctcaaatctgcactagtcagtcaattcagaaaccgtttcgggatctataaagtacgtgagattaatgaatatcatcacgcacatgatgcatatctgaacggtgtggtcgctcttgctcttttgaagaaatatccgcaactagcaccggaattcgtttatggcgaatatctgaagttcaatgcgcataaagcaaacaaagcgacggtaaaaaaagaattttattcgaacatcatgaaatttttcgaaagtgacacaccggtttgcgatgaaaatggcgagattttctgggacaaatcaaaaagtatcgcacaggtaaaaaaatcatcaatcaccaccatatgaatatcgtgaaaaaaacagaaattcaaaaaggaggcttctcaaaggaaacagttgagcctaaaaaagattcttctaagctgttacctcggaaaaacaactgggatccagctaaatacggcgggttaggtagcccaaacgttgcttacacagtcgctttcacttatgaaaaaggaaaagcgcgcaaacggacaaatgcgctagaaggcatcacaatcatggagagagaagcatttgaacaatcccccgttttatttttgaaaaacaaagggtacgaacaggcagaaattgagatgaaattgcctaagtacgcgctatttgaactagaaaacgggcgtaaacgaatggtcgcaagcaataaggaagcacaaaaagccaattcatttctcttgccggagcatctagtcacacttctttatcatgcaaaacagtacgatgagatttctcataaagaaagttttgattatgtgaatgaacaccacaaggagttttcagaagtgtttgcccgtgtcctcgaatttgcagggaaatataccttggcagagaaaaatattgagaaactggaaaaaatttacaaagaaaaccaaacggatgatctagctaaactagcaagttcttttgtcaatctcatgcagttcaatgcgatgggcgcaccggctgatttcaaattttttgatgtgacgatcccgcgaaaaaggtacactagcttgactgaaatctggcagtcaacgattattcatcaatcaatcaccggattatatgaaactcgtatcaggatggggaaataaatgggatggcgcacagtagtggtcaacacacattcaaaattagcatacgtaaataatcatttgattttcaaaaatgctgaaaaaaccgaacgtctccatctgtcagaaattgatgtgctgttattggaaaccacagatatcactatcacaacgatgctcttgaaacgattagtcgatgagaaaatactcgtgttgttttgtgatgacaagcgacttcctgttgctaagctgttgccgttctacagtagacatgacagcagtttgcagttaacgcgacaattggcgtggtctcctgaaaaaaaggggcaggtatggacagcaattatttcccagaaaatccagaaccaaagcaatttcttgcaaaagcaattatttactgaaaaagcagagtcaatacaagaattgcacgaaggtttacttgaatttgacccaacgaatcgcgaaggccatgctgcaagaatctattttcaaacattgttcggcacgaagtttactcgtgaagaaaacaatgagatcaatgcaggattagattacggatatacactgttgttgagcatgtttgcccgagaaatcgtcaaaaatggttgcatgacacaatttggattgaaacatgcgaatcaattcaatgattttaatttggctagtgatttcatggaaccattccgaccggtcatagacgagattgtttatcgctaccgcaactgcgaatttcctgtgatcaagcggcgtttgtttgatttatttaccaataaatacagttatggaaaaaaagaaatgtttcttaccaacatcgtatcggattatacgagtaaagtaatcaaagtattgaataacgagacggaaggagtccctcaatttcggatatgagttatcgttatatgagaatgattttaatgtttgatatgcctactgaaacagccgatgaacgaaaagcatacaggaaattcagaaaatttttattgagcgaaggattcatcatgcatcagttttccgtgtacagtaaattgttgctgaatcctacagctagccaagcaatgctgaaacgattaaaaagcaataaccctaaaaaaggatttgtcacactactcacggtaacggaaaaacaattcgcgcgtatggtttatttgagcggggaaagagatacaagtgtggctaattcggataagcgagtcatttatctaggggaggacgaagatgctgaatcttaattttccattattggaacagcctctgtcactggaaaaagctacatttttaatcgtagaagatgtcactgtgtttgcaaaaatcgtgaaatggttctatcagtacagtgaatcccatgaactaaagctgttcaacgataaatacaaagaattaaaagagtcagatttactgattatcacagatgttttaggttttgacatcaattcggcatcgactttaaaattgatctacgcagatttggagcgccagctcaatgaaaaagtagaagtgaaatcaatgattgataaactgacagcgacaatcagtgagctgatcgggtacgagttgttggatcacgaactcgatttagaaggagacgagatcacggtcttggaattattcaaagcattgggtatcaagatcgagacaagaagtgatactatttttgagaaattacttgagttgcttcaggtttataaatacttgtctaagaaaaaattattggttttgatcaatgtgtgttcctatctcacggaagaagaaataagcgaagtgcaagattatatttcgttatatcatatggaagtgctatttgtagagccgcgttcgatcaaagggataaaacaatttgtcttggataaagactatttcttgaacttggaaaacatggtataatggtaaaaaagagaagcgttcaaagctgaagttttgctatgaacgagtagcgtgattatgaaacattgacggaaaaattttttctgcgaggttttagagctatgctgatttgaatgcttccaaaaccgttatttagcaacactttaatcataattggttttagagctatgctgatttgaatgcttccaaaacttgcttaataattgtcatcgtcgctgtagagttttagagctatgctgatttgaatactactctagaaaaacagccttgcacttatcgaaagaggattagtgtcaagggtgtttttcatatgagtggacggaattatctgttttcttttacaattgataatagatactttgctgtatagtcagtagctgatataaaagtatcggctcttaaatggaaaaaagataggtggcgacgcaatgtttaacacacaattgatcggttatttagaatggatcattgctattttaaatatttgttctatcggtatcttaattgctgggatcgttcttgttctattcaaactttttgattggtctcatgtcaagaaaaactatgcagaacgtaatgctcgtaatgcagatacaagaaaactgttagcaagttatattttgttaagcttggaagtactagtcgttgctgatatcatcgagtcagttatcaagccgacttggacagatattttgaagcttgcacttattattatcattcgaacagtcatttcttatttcttgaatcaggaaatagaagacaaagagaaacaaagaagaggagaggtaggatgacgacagagttgatgcagtttcttcttccatattttgaaaaacttgtactgggacttgatatttttgctatctgtttattgatttggggagtttgtctgtcgattaaggatttcttgaaatacttatttgtccatacagaagcgaaaaacgaccgagtcagcgagaacaatgctattaaaaagatgttaggaggctatatacttctaagtttggaaattcttgtttcagctggaatcatcgaatcgattatcaagcctactttgcaggatattttccaactagctgcattggtagttatccgaacgatcatttcttattttttaaataaagaaatcgggccagtagacgttccaaataagtgaggttatgagcccgccgtttatcgagaggttgttaagaagtgggcagattcaaggaatgagaagaaatttacgaaaatttcggcttatttccgaagaagttacttttggaatattgtttactcagaataagaggctgtgacacaatgtttgtcacagcctcttatttattttgcacagctgaaacgattgctcgttcgatcgtattgattgaaataggaataatattctcatattggactgcatccggtgtatataatgtacgttcacataacactcggttcgaggattgctgtgcatacttctttatatcagatatacttgcataaattgttggtgcaacttgaaaatcaaaagtagttacagcttccaaggcttcccgataaatcagataatgaacatccgaatttgtgacgatatagatagtcagacgttcttttgtcagacggagaattccacttaattcgatgacaaaagctcgcatgcaattaggattaaaccgtagatcataaggtagtcgtttggcccaactggaaaaaagagtttggacttctttatacaaatttgtctgttcctcatttagaagataaaatttttctggcatgaataattgatagttatcccaagccgaacgcatcagatgaatcagcgcacgttcaaatggctgattcccgaataattcttgatggaaatgagtttcaaaagtagcaactagttcttttatttcgggagtattgtcaataaacacttggtgtagctgttgaaaatcttccgcaatcaactgataagaatggcaaccataattacaaagattgaacagtgtcaaaataaaggcaaattcttcttttttataataggtttggaaatcagtggtttcccatgctgactcgacataattgtaaataggacgttttttgatttcttcgataaatgttggatctattgtcacagtacataactgttggcgtaagaaactaatagcaaaaccaatcgataagatttctttattttctttatcataaaatctaccgctattctccgttacagattcaatgaaacgatccgcacgttcaaaaaatgattcaggtagctcccaggacttaaagctgcctaaacgataagccacattaagaagcaacagacgtctttccatttcagtgaatcgaggggagtagcggtcgatttcgatcccacaatcatgaaaataagccaatacttgtttttttaaggagtaagctttgctgacagagatgaattcacactcagttagttggagataatcaggttcattttcttccaaataaagcaggcaagtttttaaaaacaacgaattttggatcaattgctgcatgatcttacatcgaggtatatgttctgaaaaatataaagtgtaacaatctttttctcgatgcgtataaacaatttgttcttcaaattctttttttatgttattgatatcattgagtaaagtggttttgcaaacatgtagaagataggagagcttttctagattgacttctttatttacatagaattgcccacataaaaacagctgtctcaaaatattcttctcaatatattcttcaatcatagtaaagcctccatcttgtatttttttgcacaatatggaaaatattatgacatgttttctttttgaaatcatcagttaatttctgaaaaagcctgtaaattccgttaataaaagatttttatgttataaaaattgaaaaataaatattttcattagaaaatagattgtgaatttttaacaattaaacggaatgcaaatacagttgatgaatgaatgatagtcatttaagttatttgttcgttttttttagactatccattttagaagtctgatttattaaaaaattgttcgtttttccacgtttaattatcagaaaaatccgactttatttatttttgtttgaaatattctacgtgaatctgatgttataaaaaaaattttctcatttttggcgctatagtgaagtggtgttacagataagtacatgtatctgcgagacattgaccaacgaaatatggagggaagaaacataatggaaaatagacaactggttattctggcaaattagttgtattccccctgttttccatctatttttcccacgagataagtgccgttatcctataagaggcaacaagcgacaatctaatatttatgttttttgctcgtcaaaacgaattatttcagacttccctgaaataatcgatacgcctgaagaatcttcctacgtataataaaagtatcaattaagtaggaggggataggatgaactggtacaaattgacggtagaagatacattgaaaaaccatcaaacatcaacagaagggttgtcgcaagaagaacggcagaaacgcctgactgatcaaggatataatgagatagaagcaagacagcagacaaaacgatggaaaaaaatagcaaaacactttactgatctgctgatgatcgtgttgatcattgcctcttttttgaaatttgcttcgagcgaatacatcgaaggaagtattattttattcgtagtgatcgtcaatggactcgttagttattggcaagaaagaaaagcagaagaatcgttgaatggtttgaagcagctgatgggacaagaagcgatagtactatcgaacgggatgcaagtaaaaatccctgcgaaagaactagtaaaaggagatgtcattgtcttacgtgccggatatgtcgttccagcagatgttcggttgatcgaagtacatgatctactagtagaagaatcgattttgacgggagaatcagaagcatctgaaaaaaatcattccgttttggcagcagaagaatcaatcggtgaccagaaaaatatggctttttcaggaacacttgtacaatctggttctgcagtcggtgtcgttgtagaaacaggaaacacgacagaaatcggtaaaatcaatcaagcactgcaatcggtcgaacaacaaacgacgcctctgatcaaaaagatcaaccgattgaacaaacaaatttttcaaggcattctttgtttaatcttgttcttagttgtttttacaacattccgctatggcatggattggcatatccttctttcagctatgatcgctttggtggtgtcaatggtacccgaaggattaccagctgttttgaccatgattctatccgttggagtacatgaaatggcaaaagaaaaggcgatcatcaaaggacttccttcggtagaaacattaggttctatgacagtgatctgttcagataagacagggacattgacaaaaaatgaaatgacagttgtggatgtagcagcaaaagaagaaactcgcgtactgtctattatgaaaaattgtcaggaattaaagacgaaagaagaacagaaaatagaaaatttaagtggcaatccgacagaacttgcactgattcgacacacagaaacagccaatctgcctttgaaaaaaatagaagcaaagattccgttcagctctgaatacaaatatatggcaacgatgcatacggaggaaaaaggaacggtgatttacgtcaaaggtgcgccagaagtattattggctaaatcaactctttcttattcagaacaagaagcatggggtcaaacagccacagcgtttgcgaaaaaaggtcagcgtgttttaggatttgcttacaaaaaagtagattcgaaacaggaactcacgcatgagtctttaacccaattaacttttgcagggattgccgggttgattgatccgccaaaagaaagtgcagtcaaagctgtaaaggaatgccaacaagcagggatctcagtgaaaatgattacaggggatcacaaagatacagcaaaagcgatcgcggaacaaattggcttaaaacatactgctaaagttttagaagggatcgatttggatcttatgtctgaagaagagttgactcgacaagtaccaaaagtcgatgtctttgctcgaacgacaccagaacacaaactgcgaatcgtgaaagctttgcagaaaaatggagaaatcgtcggaatgaccggagacggcgtaaatgatgcacctgctttgaaaagagccgatataggaatcgctatgggaatcaaaggtagtgaagtaagcaaacaggcagctgatatggttttaggagatgataatttccatacgattgcaaaagccgtaaaagaaggtcggcgcattttggataatttgcaaaagaccatcaatttcttcttaccaactgcattagctcaaggattgattttgatttgggcgctgatactgaatcgcctgctacctttgtccccagtacagattttatgggtcaatatggtaacgacaatcactttatcttatgcattagggttcgagtcgccagatccagaaatcatgaagcgtccaccgagagatccaaagcaaggaatcctatctggttatcatttgtttcggatcatctatgtcgcactactgatcatggttcctgcctatttattggctatgcaatttgaagggcaaagcttacagcaaaccattcttctgcaaaatatcgtcttagctcaagctgtttacatgatcaattgcagagagttgtccaagccgtcactgaaccaaggtcttttgcaaaacaaatcgctttttctttcattaggtatccttgctttattgcaggggatggttatttttctgccaatcggtcagcagctgatcggtacagtaagtttaacgatgacacaacagttattgattggggcaaatgtgattcttctattcttagttgtagaaatagaaaaagggatcatgaataaactgtttcgcaaaaaagaaaaaacagctagagaattcagtcgctagccgttactataaaaaagttttgaaagtgagttcagtcaaacgattgagctcatttttcgttggaatagaagaaatgtatacaatagggatatctagagaatccaacgggaaattggaaatcaagatatctgttttttcaaaagaaatagtggaaagatcggttagttcgataggtaagaagcagacacgttttcccaagtaatcttttaattcctgctgcaagaacgccttccatgaaggttctccttggaaaataaaatagacattgaacaaattcggtttgatagaaaaaatcgtttgttggatcagtaaagacaagagttgaagaaagtaatttggttcattgatttccatttctttttttagatcgttcagtaaattctctttctgctgatacaagtgtgcatattgctgatcatacgtctctaaaaaacgatggtattggcgttccaaaggttcgatcagtattggcgattcatgatattttaatacgaggagagccaagttatcagtcagagatgttttttttagttgatcaagagacagctctgaagctagttcctctacaaacgtttcgaggacctctaaaaatggagaatgatgcaggcagcgagcgatttcttgtccatagttattgttgtaattccaactttccagaaagcagaaagaagcaaaagaaagctcagtgtctttaaggtaaataccttcctttaaatacaattttttcaatgcagagtcatacagggaggagagtgtgctgttgatatggatagaagaatctaaccggcaattcgcttttatacggatcgtattgataaagaaccaacatgttccgaaaatctcttctgtttcaacagctagttcagtttgactgaggtttcttaaaaattgaaaataatgggattcatggattgaataatcctcgaaaaaatagttgttatgagtgaaaggaatcagcaatcgatgatagaaagtacgaatcgcacgctcttttccaagaatacaagctgtatatttcgtcaaatcgatctgcaagtcgtaacttgctaaacgctgattgattttagtcacatgtcttttcaatgtcccataagaaagcccatgatccgctagaaaatcagggacagcaactttttttgtaaaaagcagatttttcagcagttcgacactgactgattgtttgaaaaaaatctcccaaaggtcatttgttaataaattttgctggttttgcaaactgattcctgcttgatcgctgaagatgtcccagccttcgggcagatgagagcgaatagattgaaggtcagaaaaaatcgttcgttcggttgtccctatgatttcagctaattcatttacggttatctttgtatgattcagcaattgttcgactaaagaaacatgacgtcgaatatctttttcggtaatgatttttttcattagtgaatacataaatcagactcccttctattctaagaatacggagaaaataaacggtggtcaagtttcatctgatctttcaaccagtattcatttttctattcttacgtggtatgtttgaataaagagaatcaataagaaagagatggaagcagatgctaacggaaaaagaactaatcgatcacatcgatgaaacatacaatttgtctccagaatatatttttaaaaaattccctgattattgcgtattcagacatcaaaaaagcaaaaaatggtttggggtcctgatgtctgttccagaagaaaaaatctatgatgatgcaagtgaccataggatcatcgatatccttgatttgaaggtcgatcctgaacttggcggtattttgcgaggaaaagaggggtattttccagcctatcacatgaataaagaacattggatctctgttgatctacgtaaaatagaaaaactagatgaactagcaggtttgattgatgaaagtttcaaatcaacgcaatgaatgtataggacaatagagaagaggttgtgacagaagtgtttagcttcaagaaataagaaggaatttacgaaaatagcttctcaaatttttgggaaatttgggcttatttctgaagaagttacttctggaacaccgtttgttcgaaaaaaagagctgcgacaagaattttgtcacagctcttttctttttattttcctaaataaaattctcgcatcgtttttgcaatcattttgatcaaaggatgatcttctgtgaagctagaagataaataaattgttcgtgtcaagggcaaatctttgatttcccgcaagacgaaaggatcatttttatcgtaagaccaagaaacttttgggaaaaagctaacagctaagccttgcttgacaatagaacgtaatgtcgcaggatcatctgtcgtcgaactgatcgtcaattcgatacttttcgcttcaagtgctgcatccagtgtatgacggaaggcattgctctttgacagcatcaagatgggggtgcgttggatatcttctaattgcagatgttcttttttcgcaagaggatgtttcttaggaatggctacataaacaggttctttcatgataggaatattggccatgccaggcttcatctccgaagtgatgtacagtacagggtcggtaatatcatctggtaaatgatgttgcatgatcgttaattggatatcaggatgcttttccataaaaattcggaccaagttcggaatagaaacagaggctacctctaaatacaaaatgacggaagtaacgatcttctcattgaccgaagacaataatttgattccttcttctaatgtgtctaatgtcttgactgcatatggatagaattcttctgcataaacagttgtctcaatgtttctgccgctatggtaaaacaaagggactcctaattcgttttccaaatgtttgatcgcacggctcaaggcaggttgagaaataaataattctttggctgcttgggtgacattttttgtttcgaacacttttttaaaatactgtagatgaagcaatttcataattatccatcccatccatacctttttgttatggttttttctttttttggcattttttattatagcagaaattgactaagatagcagtggaaaaagtaagtgctaaggaggcgaggctcatgagtacaggtttcttatttcctgggcaaggcagtcagaagttagggatgttagcggatatccctgaaatgtacatggaacgtttagaaaatgtgacggggtatcggttagttgataaagaagaaaactatcaagatacggtttttatccagctagcattactgacaaaagcagtattttatttagatgaaatggaaaaaaacggtattcagcctgatattgtagcaggacattcgatcggtgctttttgtgcagctgttgcttgtcgatctttgacatttgagaatgcagcggaactagtctatcaccgcgcagtcttaatgaaagaagcttatccaagcggttatgcaatgggcgtagtagtaggtgtgacgagaagtgaagcagaggaaattgtagcaaaaacatttgatcctgaccgcccagtttatttgtcaaatgaaaattgtcccatgcaacatacgttatctgggagtatcgaaggtttatccgttacgttggcagaagccaaacggcaccaagcgcaaacagcgaagctgctgaaagttcctgtgccatctcactgtctcttgatgaatgatacggtcaagaaattcaagccgtatatgcagtctgtccatctatttgatgctagatgtttgtatataaaaaatacggatggaagagccactcaggaggcagaagagattcgtaaagatttgttggaaaacctagctttccctgtgcaatggaaccaaatgatggacttggcaaaagaattaggaatggatctgacgattgaatttccccccggcaatactttgacaaagctgattcatacaaaatttggtgtagataaagggatccgtacgatcaatctagaccaacatggtattgatgacgccacgtttctatatcaaaaatggagatgactaattatggaaaaaccaaaccgcaactgggcttctaaacgcgaaaaaaaagcgcagcgattggaaaaaatcagcaacttgctcaatggcaagtatgtagaaactgaaaaaatcgtagaagtgatggaaaaactgattgctcccggcgacaaagttgtattagaaggcgacaatcaaaaacaagcaagttttctttcagaaagtcttgaaaaagtagatgcagaaaaagtgaatgatctgcatttgatcatgtctagtatctcacgaccagaacatttgaatatttttgaaaaaggaatcgcaagtaagatcgatttttcttatgcaggtgcacaaagcttgcgtgtcgcccaaatgattgaagacggcacaatgaaattaggtgatatccatacttatttggaactttatggacgcttattcatcgatttgattccaaatgttgttttagtagctgcagataaagcagacaaagacggcaacttgtatacaggtttcaatacagaagaaacaccaacaatcgtcgaagctgcagctttcaaagatggtatcgtgatcgttcaagtcaatgaagtcgttgataaacttcctcgtgttgatattcctggagactgggtagatgttgttgtaaaagcagatcaaccttatcaattagaagccctatttacgcgcgatcctcaaaacatcacagaattgcaaatcctaatggcgatgatggcaatcaaaggaatctacgcagaacacggcgtacaatctttgaatcatggtattggattcaatacagcagctatcgaattgttattgccaacttatggcgaatcactagggttgaaagggaaaatcgcgaagaactgggtattgaacccacatccaacgatgatcccagccatcgaatcaggttgggtcgaaagtatccatagtttcggtggcgaagtcggtatggaaaaatatattgctgctcgtccagatgtattctttgtcggaaaagacggcacgatgcgtagtaaccgaacattatcacaagctgcaggacaatatgccatcgatatgtttatcggttcaaccttgcaactagactatgaaggaaattcttcgaccgtaacaaaaggacgactatctggctttggcggtgcgcctaacatgggacataatcctggcggtcgtcgtcattctacaccagcatggcaatcacttcgcaacaatgatgatccattagggaaaggacaaaaattagttgttcaaatggtggaaacatatggttcaaataaaaaaccagtctttgtcgaagaattagatgcactagctgttcaaaaacaagcaggcttagccaatgcaccagtgatgatctatagcgaagacaccacacatatcgtgacagaagaaggaattgcttatttgtacaaagcaaaaacaaaagaagaacgccaagcagcaattgcagcaatcggcggtgttacacctcttggaatgacaagtacgaaagaatcactagaccgtttgcgcgatgccggcatcgtgaaattgccagaagatctaggcatcaaacgtagtgaagcgaaacgttcattattagctgcacaaaccatcgatgatttgatcgaatggtcagatggcctgtatgagccgccaatgaaattcagaacttggtcataaaattggcgagaaaaaccttttgtcgccatttacccaggtggaagaagaaagacgaataagcagaacgtgtatgctctgttttacaaaaaggggagagatccatggaacaattagcttataaatatccaacgaaacagccgatcaataagaaaatccatgtaggagtggtcggttcaggtgatttggaaatcttgatgtttccaacagaaaaaaaagaatctactgtaaaaatctgtacaggaagcgatggcttcggcgaagtatggaacaacgtattaacgagattttttgatcgttatccaatttcagcagatatcgtgatcaatgacttcggtgctacaccaggagttgtgtacctacgattgacgcaagcaatggaggaactttcagatgaaaaatagttttgtagaattaaacgccagagaacgagtgaacgctctacttgacaatggacgtgaattgattgatccattcgatcaaatcatcgcgccaagtttgccggcacaaggaatcgtccctgaaagtgatgacgggattgttgtcagccgtggcacgatcaatggcaaacaagcagtagtaatcgctatggaaggaaaattccaaggtggcggtatcggtgaagtttccggtgcaaaaatcgttgctgcactcgaacatgtattagaagaaaacaaaaaaggaaatgaaatttttccagtcatcgtactagatacaggcggtgttcgtctgcaagaagcgaactacggactgttatctatttcagaaatcggaaatgtaatcattgctttgaaacaatgtgtaccagtcatcggtttgattccaggacgtgtaggatcatttggcggtatgtcgattacttcagcattgatgagttatttgatcgcaacaaaaaaagcgagagtcggtttgaatggtccagaagttattgagcaagaagcaggtgttcgagaatttgattctagtgacaaagacttgatttggaatacattaggatctcgtcaacgggtagaatcaaaaatcattgatgaactagtgactgatagtgtagaagcaatcaaagctgctgtcatcgcagcaatggacgaacgaaaagacacgcatcgcagtgaaagctcagcattttatttatcattacttgattctttggatctttcaaaaccaatgagcattgacgattacaatgaagcaattgctaaccatcaagcaaaatcaatggacttaccagaagtagcagaaggaaatgaaccagctgcaacaagtgttggttacgattggtttgcggcactaactggcatgaaaaatccagcttcttctattagtactgtgtattatggcaaatcaagtaaattcgtagaagaagccatcgtgacatcgatcgtacctgatcctaaaaacccgatgtaccgtgtacgaaacggtgaagttggtttagttgaaggtttccgcatgggacaaattttaactcatgtttacgaagaagataaagataaaaaagtgaaacggccaatcgtcgttgtgatcgatgtaccaagccaagcatacggttataacgaagaattgatcggtatccatgtggctttggctaatagtgctgctgcttatgcaaaactccgtcaagctggacatccagttattggattgattgcaggaaatgctatttcaggtgcgtttttagcacatggattacaatcaagccgcttgattgctttaaataataaagaaatcactgtccaagcgatgtctaaagaaagtgctgcacgtgtgacaaaacgttcggttgctgaaatcgaagcagctgctgaaaaagttccagctatcgcttacgatatcaataattatacaaaactaggagcaatctatcatttcctagaagatatcaccgaccaagctgcttcagaacaaaatgtcagcaaagtcatcgaagcaatcaatgaagccattcaagatgtccgcaatacaaatgatacgatgctgacaaatcgatacacgaatgaaacagccaaaacattcggacgtgtcgaaacaaataaagtccgtgccaaaatggacgaagaatgggatgcataaaaaatgattcaagcacatgatatggttgtttttgataaaaaggaaatcaagaaagagttgccagaatggttgaagctttctcaacaagtgtatggtgtcgttcggcgtgctgaacctgctgatcgggggtttttgccgattggtctgcgaggtacggcacgaaatcagcgcttggctcttgagattccaagtgactctgttcaaaaagtgatctatccatggacaatcattgatcgagaatcttttcgagaaaaggaagttgccccctttcctgtttatcagcaatttcatgcggctagaaacatattatcagggtgcaaatgggggatcggcggcagcttaggatttgaattatcaactgggattccggcagtaaaagaaaccagcgattttgatttgctgctgtacgcagattcaccgattgaattgccaattcaggcaattcaatcgcatcctgctttttttgagcaattcgatacccaagtcattacatcaaaaggcggattttcgctaaaagaatacttgcggacaccagagaaaaaactcctgttgaaaacaacaacagggccaaaactaaccaaagagatttggtaataaactaaaagtgagagaaagagatgtttgaaaacaaaaaaaacaaaatcaacgtaagtgacttccagaaagtatcagctgtaacggctgttatgatgcaaacgatattgagctttgctttggcaaacagccacagcgcaacaaatacagcttttcttggtaccttttacgtcatcgttaaatacacagcaccaatgtttatttttgcaattgtctataatatggtaaaaacaagtcagcatttgtcttattgggaatttttgaaagaaaagttttttgaactagtcgttccgtatcttctatggacgacggcttatctttggctattcccagcagtccaacaacaaactccgtatacggatactgcaagctttttactgaaatatgtcacaggtgatggagcacctcatttatggtataccgtgatgatgctgcagatccaattgttcatgccgttttttgtttggctcggttacaaagtatttgctaataaaaattatgtatggccagtattgattggctcaacgattttatatgttgcatggtatctgttctatcaaacacaagtattgactggtccttatcatgacagctggtacttgttagatcggtttgttgctagttttatgatttacgggatttatggggtagccgcatttgtttatcacgaaaaagtctatcaatatttggacagagtacgttatcttttcttacctgttggcttagttatcgcgttcttttctgtccgttcattgctcgcacatccaggagacttgagctttgcgaatgcgccttacttgaatacgatccaaagtttgtacagtttagtcatcatctttgctgtcttcatgggcgcttcaaaaatgattgtaaacgattcgccaaaattaccattgttcaaatggttgtctgtttatgcttaccgtacgtatttagcaaatgtctttgttttccaagtactgttgttattatttaaagatagttggctgcagttaccttcaggattcatgattcttgtagcgtatctaatgacggcaagttgtgcatttgctttaagctggttgcttcacatcatttgggtagccatcaaaaaagggttcaacaagtaatagaaagaaggagtgagtgtcatgataaatgacgaacgaaaaaaagcagtgactcagcaactcgctgcgttggtagaggaagcattgatcgcagaagtaacattaagcccaaaacctggattagtggatgcactggatgcgggtgcacattccgatatggactatgctttatttcttaagtctgcgaagacgctgactcctttttttgaagaaatggctcaaatagcatggcaacatgctatcgatcaggagttaagagaaaagattgctgagattggacggaaagcggaaaaggcaatgttgattgctacagatggcatcaatacccataaaggatcgatttgggcaatggggctattgatcagtgtcactgcgcaaaaaatcagtacggaacagcctttttctttatccaaaatacttgatgatgtcagtaaacttgctgcttttcctgatacaaaatatcgtcataaaaaaaacactcatgggcatacggtgaagcaaaaatacggcataaatggtgcatatgaagaagcagtgttgggttatccgcatatcaggcttgcaatccaagctgctaaggagctagataatgattctgatgtacagaaacaaatgcatatgttgttagttttgatgagttccttagatgacacctgtgtcttgcatcgcagtgatcagaaaacgttagtggaaatgcagaaacttgctcatgctgctagtcaaagtgctttaccaaatcgtccatttatagcactgttgcacttttgtcaggaaaaccaaatctctcctggaggaagcgcagatcttttgtctgccagcttgttcatgctgaagatagaggaaatatggactgccaacacctatgtctgtccgatgtcacttaatgattaaattaagacaaagctgctaaaaaaacagtttatgcatctggttattgactcttccttttagcaaggctatgataacaatagttttttgtaataaaagataacgaggaaggcaatgaaaaaaatcaattatttagcaatcattttgttagtgggcctatgtttgtttgctctgccgacccaaggattcgctatcgcgggtggtcatggtggaggtacatctagcggtcgaagttcgggcagaggttcatttggcggtcgttcatatgggggcagttattttggcagtcgttcttacggcagagattcttatgggtattatggtccaagtacaggtccttctagttatgagcaaacgggatttcttgcattagctgttttgtcagtaggaggggtttctgctttttctatcgtcaagaataaaagacaaaagaaaaggctgaaagcggagatattgtcccgcatgtcaggaacggctaaagaaaagaaagcacagtttctggaaatccaaaagatattcatgaagatccaatctgcttgggaagaagaaactcctgaaaaagccagaagctgttatacagacaagctgtttgccgaacatcagaaaattctgcaaaaaaacaaagcagacggtgtaagaaatcatactaaaaaaataactattcaggaagtagggaattatcgacagatccacgaaaatagttttgccatccgaattgatttcagatgctgtgattattcagtcgatcgaaaagatgggcgagtgatctcaggaagtaagacacaacgacagtatttttctcagatatggtattttgatttttctgagaaagaaaaaagatggcaagcagattttatccagccgattatgctggattgacagaaaatacttatgaacggaactgtgacaaaaattttgtcgtagctcctttttctgaataaacggtgttccagagatagcctatcggcaataaggcacgattttgtaaaatatgggaagctatttttcaaaatcgcttcttgtcgctcaaggctgaacatctctgtcacaacctctccactaaatggtgttcaaaagcttgcatctacgataataagcccaaccaaatgaaaaataggaagtactatttttgtttggctgttcttattacttgatgcaggacagctttttcacgacctcttttttgtatagatgggcaaaatttttgtaataataggcgtatgtctttttcgttgagaagttgaaaaagcatacggcttattttttgtttgctatgcttactttctttccacttcaagtggcagaaatatctactttttattatgtaagcggaatcatatacttggaatcagaaggagatcatttctatgaaaacaagaacaattgaaatacttcacagaatcatgacagcccaatatccagtaaaagcggaacatctagcagctgatttccatgtcagtcagcggacgatccgacaggaagttcttgaagcgaatatctggttgagcagtaaaaagcttccggaaatcagaacaattcgcaacaaaggttttttgttgaaactggagaatgacaagcaagttcgattagaaactgaaataaaagaggtgaaagacggctttttgaatcggcgggaacgtatttttgatttagttttagccattgcttacagccgaaacccgatccatctaaacaaaaaagaagaagaatttcaaatctctaaaagtacgttagatgaagatatgcgacgattacgagcaacactggtcagttatggaatcgagatcgtcagttatggaaagcagggactggtttataaaggttcagaacgatctatccgtacgatgatctatgattttatcaatcagaatctggggatgaccgacttctttatgaatcaagacgcgcaactaacaccggctcaaaaaatctttttccattattttcctttggtggaaatcaaaaaaatagaggagatctattccaataagttgttaaaacaagaggatgatatttataaaaagcaaattctgatttttacattaatctggatccagcgaatcaggaaacatgaattcatctccgccattaattggaaaaatacagaaataaaaaacagcagcttctctgcatttatcgactacatgatcacggaatttcagttgaacaatgtcccacaagtagaaagaaattatcttcgtttcactatcgagacgttcaatgctagagatatctccaattcgattgagtgggtacaagctcaactactaacgatccaattgatccaatttgtagagaacgagacacgcataccttttcatctaaaagaagaagctttattcgaaaatctctataaacacatggctgcactgatcataagaatcaagcatgctatccaagtcatgaatccattgaaagaaaacatccgaacaaattattttccaatccaccgcgcagtcactcattttgttcctacgatcgaagaagtaattggcggcaagatactggaggacgagatagcttttcttgtcatccacttttcgacgattgccagtgtgatcaagcgagacctgaattatgtttatcaatcagttgttgtctgtaatcacggcatggctaccgggaatctgttagcagaaaatctgaaagaaaaatttcctcagattgagattactgcagttttaagttcaaaagaaatcgaattagtggataaactggatgtcgatttggttttcagcacctttcaattgaattatcgaaacaagccgcttttagttgtcgatccaattctgactgagacgaatattttagttatagaagattttttgaaaagaaatgaagaactgcagcggttaaaacctaacagtcatgaatcgacgcagttattcactcaaataatcggtgtcatggaagaaagtggtggccgagtggaccgcatcatctatggcaagttggaaaaattattcgaaacaaacaatttagaaatcaacaaaagggaggtccagcctatgttaaaagatattttgacggacagcaatatcataattaaagaaaaagccgttacttgggaggaatcgattgaacgagctgctaaaccattggtcaaagaaaacattgttgaagaacgctatgtcgaagcgatgattcgtgcagtgaatgaatacgggccatatatcgtgattggtaaacacatggcgctagcccatgctcgaccagaagatggggtcaataagttaggagtcagcgtagctacgattgagcaaccaatcgatttcggtaatcctgaaatggatccagtaaagatcattttttgtttagcagcagtagattcctactcgcatctgaacatcatgaaagaactgatcgaactgatcaacaacgaagagaagttggatcgattgatcgaatgcaccaatgtggaagatttcaaacaactgctttttcagtagttgagaaataataaatgatacgggggagaacaaagatgaacaaattgaacattttattcgtatgcggcgcaggtttaggaagtagttttgcagcacagatgtctgctgaggatgttttgaacaaattaggagtagaagccaaactggaccattgtgatatttcttctgcagtgtccatgaaaccagatgtgaacatcacagcagaaaattttcgctcgcagttcgaaaaattctcagtcgatcctaaaacagcgatgatctatttgaaaaatattgtctcgaaaaatgaaattgaagaaaaaatcaccccagttttacaagataagggagttatctaaataaaaaagaaaagaggataaaaacatgggcgttatcaattttatcatcgaaaatattttgactcaggcatcgatcaccattgcattgattgctatgttgggtctactgctgcagaagaaatcagcaggacaagtcatttctggcacgttaaagacactcctaggattccaagtgttgagtgctggttcgagtatcatcgttgggagtttaacttatttcgggaaaatttttactgaaggattccatatgcaagggatcatcccttcgattgaatctatcaatggtcaagcaatgaatgatttaggtttaggcagagatattgcgctgacgttcttagccatttttgtattcaatattcttttagctcggttcacaaaatggaagtacatttttctaactggtcaagccattttatggatggcgacgatgacgacagtctttggttatttcgccggtctgcgaggaatcgtattgatcttagtcggtggttttatcggagcttgtttcgccattgctatgccggcagtagcacaaccaatcattcgtaaaatcacaggatcaaatgatattgctttagggcatttttgtacgattgggtacttatttgaagccggtgtggctaaactttttggtgagaaaggcgaaaataaaaaatcgatcgaagatatcaagctgcctacacatttcgagtttttgcaagatacttatctgtctgtcatggtcgtgatggttccactatatatcatcactgttttatttgcaggtgaaccattcgcttctgaattatcaggagatcaaaactatatcatgtttgcctttttacaagccatccaattcgtagtgggtgtgtatgtattgctagctggtgtacgtctactgttaggtgaaatcgtgccggcatttcgagggatagctatgaaattagttcctgatgcgattcctgccttagattgtccagttttctttccctacagcccaaatgctgttattttaggtttcattacgacaacgatcggtacgattattgccatgttcactttgccgatgttcggcttagcgatgattttaccaggtatgctaacgaatttctttgccggaggaacagcggggatatttggtaacgcagttggcggacgtcgaggagcgatcattggcggtattgctcatggcttctttattacattattgcctgctttgctagtaacgatctttaattcgatggggttcatcaatgctacagcaaccgatgtagatacagtagccgccgcactcttatatgcctggattttaagcccaattttgaaagcattttaattgaaagtagggaaaatgatgttcggattttttaagaaaaaagaaaatgaaccaaaaaaaagatcgataaaagaggaaaaaatcctctcgccagaagcgatcgaaaagattcaatcagagattacacaattaaatcaagagatttcaacgacccaagagaagcacgaattagcggaactttatgaacaaattggacttaaattttctgaattgtatgagaacgatcaagccatccaatatttagaaaagagcttggaaaataaacagacgatcggagatgggtataaaaaactgatgagcctctataaccagaagcgtgcagatgctgctcgtgctggggatgatcaaggaatcgattactacatgggcaaaatggatgagatgcgacaaattgcaaaacaagtaacgatcaaaggaaataaataaaaagataaggtggcaataaaagatgtatacaacattgaaagaagtaacaaaaacagcagaagaattgaattttacagttggagcttttaatacacataacctagaaatgcttcctgccatgctaggcgcagcaaaagaaatgggctcgccgatcattattcaaacaagtgtcgacaccgcaaaatatatcggcatgcatgtgttagtcaatgtaatgacagctattgcagaagaagaaatggttgatgcagtcttgcacttagaccacgcccgagactttgatgatatcaaagaagcaatcgatagcggatatacttctgtcatgtatgacgggtctcatctgcctttcaaagaaaatatcttgaaaacgaaagcagtggtagaatatgcccatgcacacggtgtttccgtagaaggagaacttggaacgatcggcggtacagaagaagggatccatgtcgctgaaaatgacaaggtatatacaagaccggaagatgcagtgaaatttgtagaagctacaggtgtggatgcattagctattgctattggtacgaatcatggacaattcaaatcaaaaacagaagtgaacattcccttgctgaaagaaatcgatgcagtagtcgatgtccccctcgttatccatggcggaacaggtgtgaaagaagaagattatcctgaattgatcaataacgggatccgcaaattcaatgttggaacggagcttttagtcaactggacaaaagtggctaaaggaacctttagtgaaacagaaatcaacaagtctcttcgccataatgtgattccagcaaatgaagcagtaaaagaaattgtcaagcataagattggactgtttatgaacttggaaagtccaattaacttaggaaacaaatgagatgaaaaagtatttcattcttctagctggtagtcctggtacaggaaaaacatatcttatgaataaactacgggaacgatttccagatatgtatgccatcacgctcgatgaaatcaaggaatattatgcagaatccatcggttttaacaacttggaagaacgggcggaacaagaaaggacgaaagtttatcctttctattacaaagcacttgatctgtatatggaagcaggaaagaaagtgattgtgtccgagtatccttttagtgataagcaaaaaactcgactccaagaattagcagaaagatacggatatcaggtgattacgattcgcctgacagcagattttgaagtgttatggcaacgtcggtacaaacgtgatcgtgaaccagatcgtcatttgagctatatcatggatcattatcactatggcgacatattggaagatcgatcgaaagggacgaaccatattacgaaagaagcattcaaaaagatcatcactgaccgaaaatatgatgaattccagttaggaacactatatgaatttgatgtaacagactatactcaagtggattacactccattattggataaattagaaaaagaaatcaatgacaataagtaacgaagaaatggtttgatagtgacaggtaataaagacaggcggctcttctcttgaggttgtgaaaaagctgtcctgcatcaagtaataagaacagccaaacaaaaatagttcctcctatttttcgtttggttgggcttattaccgcagatgcaagcttttgaacatcggttattcacagcacagaggagtcgaatgtctttttgttctaaaatgtttttttaatattcttttatttattgccgatttccttgtgtttatttgccgtaattaggtcagtcttctatacttgattacatagtcatacattcgatgaaaagaagggaagagaatgaataacaagttggctcaatacaaaagactactcgcactttctcaagctggtctgtattatggaaaagatgtattcgataaagaacgatttgaggagattcggacgatctcattggaattgatcagtgaaataggaaaagaaactttcgaagaaataaaagcacttacagttattgaagaaggtcatcccacaccaaaagttgatgttcgtgcctatatcaaaaaagacggcaagatcctactaatcgaatataaacggacgaaagaatggtcactgccaggcggatttgccgaaataggtttatctcctgaagaaaacgtgcggaaagaagtctatgaagaaacgggtttaacagtagaatctacacagctgcgagcggtttttgatacgaataaacaaaaagatattccgcagctttttcagtattataagcttgtttttgcttgtacgatccacgatgaagatgcaaaatttattgagaacaacgaaacttccgacatgggtttttttagcatagaagagttgccaaagctatcagaaaaacgaacaacaaagaagcagttgctcattttagaaaacaaaaaccagctttattgcgattgagttttttcgtaaaagaagaaagctatttactctgcgagttctctaaaaagaactcgttcttttattaaaaaatagttgcatttgcaacaaaaagaggtaaactagtcttacaaacaaaataaaggtggggtgaaatggctgaaattcttcgagacatcggaatgattgcccgagcgctggattctatcagcaatatcgaattcaaagaagttgatttaacaagagggcagtatctttatttagtacgtatttgcgaaaatccaggaatcatccaagaaaaactagcagaaatgatcaaagtagatcgtacaacgactgcacgagcaatcaagaaattagaatccaatgggatgatcgaacgtttggaagataaagaaaataaaaaaatcaagaaactctatccgactaaaaaaggagcagaaatctatcctttcatcatccgagaaaacaactactctaatgcagtcgcattaaatggtctgtctgacgaggaagcgaaacaattggaatatcttttaaagaaagtatgcaagaatattagcgaagattggaattttgtcaaaaaaggtaataaaaggatctattgaaaggaagaagccgtgaataaatacgaaattcgaaaaatgacgccttcagatgtagacttactacaacaaatcagtatcgaaacatttacagatacatttggaaaagataattcgccggagcatctagctgcttacttgagacaagcttatgcgccagaaaaacttacagaagagctaaaagagaaagaaactgattttttactagtaagtatcgaccaagagcctgcgggttacctgaaactaaatataggaacgagtcaatctgaggaaatggatgatcattttttagaaatcgagcgaatctatgtacgaaaaaaatttaaacatcaaggtattggtacatttttactagatacagctatcaaaaaagcaaaagaaaagcaaaaaacagccatttggctcggtgtgtgggaacacaacgatgttgcgctcactttctatcgcaaaagaggatttaccaagtacagtgaacatattttttatatgggagatgatccccaaacagacgatctattcatcaaggaattattctaatcaagaggtgtaaacatatgaaaaaagtaatagtggatgccaatttttgggaagtatttcctgaagcaaccatcgaaatcttatccgcgagtggtatcgataatcacgtaacagaagaaactgaagaaacgtatcatcaattattgaatagcgcggcaaaagaagcaagaaattaccttacagaagaaacattcagccaaaacgaagtcattgctcagtggcgtcaggcttttaccacattcaagactaaaaaaggtgcacgttcttctattgaagctttactgaaacgtgcaaatcaagaacgggaatttttcccaatcaacccgcttgtagatatttataatagtatttccttgtcttttggcgtaccttgtggcggagaagatatcgaaaagatttcaggaaatctgcatctaggaaaagcccaaggtggcgaatcattcctgcctttaggtgcagattccgatgctccggcacttccggaagaaatcatctactatgatgaacaaggagcaatctgtcgctgtctcaactggcgtgaagcccaaagaacgatgctgacggaagaaacgcaagcagcggtgctggtcattgaatccatcaatgctgaacaagcagcacgtggcgcacaggcaatcgaagcgttgaaggaaaaaatcgatcaaacatttggcgtgtctagtgtcagacacacactaaccaaagctgaatcagaagcagaattataaaaaaatcgaaaaaagaagagcggcatttattgccgttctttttttgtaaaaaaattaatggagtacatcaagtctagaaactattgctttatttttcttgaataggatcaaacacaaggtgttcgcgctttcgtgatataatggaatcagtttatagacaggtaagaaaatcaactagaaagaagggtcaaacgatgatacaaaaaacacgtgtgatgctttatgtcaatgacgtagagatgatttgccgattctttgtagaaaaaattggtgcagaaatttcagaaacgatcgaattgccagaagaatttaagagtattgtactgagtatctcaaaagaattagaattaggtgtatttccaaaagtatttgtgcagaagttttcaccagaagtattgggaccgccaccttctttagtcttttttacggatgaatttgaaactatctacgagaacatggacgaacctggagaaatcacagacaacaatggcgtcttgactttcaatttttcggaccctgaaggcaattattttgttataggaaaagctgagtcgtctgtttgaataaaaaggaggaaaaacagtggatctaatgggaaggctagaaggttatttgaagtatcggcgagcaaaacatagtgagaagcttcgagcaaggaatctcaaatcaggtaaaaagaagacaaaaggttggggaaaaatggtcgatacaggttttggcggactaaataacctaaatcctgttgatacaaaagaattcattaaagaagagcagaaacggatgaataaagggtacgcaaaaaaatgaacggaaatttttggatagaagcttcatttctatcaaccggataaataaaataaacaacaataaagtactgctacttgttagtaagttttattttttataaaataactatatggttattgtagttatgaaaggagtagcagatggaaaagggtatcaaagggatatatagattatttgcagtactagttattttttttatgatttgggcgatggcatcaactattttttcgccaaggataggcgcgatattctctttattcagagatagttattcaccaaaagttactatagttgttaatatattttgtctgttttttgcatttcttctattttttattttgaaaaatttattaaagaaaataaaaatagattgggatttaagtgacaaactgctcttttatatatttgggttagagttagttatttacgcagtcagcttatttctttttattagatttattggttttcatcaaccagtcgatgatactgctattacattaaaatttttagagcaattgaaggctggagaaaattggggatataattatatgtattccaatcctcaaaacctattgctgatgtatatttttaggggaatacaatttttctttggtacgaattactatccgatcattgcagtattttgtggcattcatctaataacgatcatctttctttttctttctctgagaaatttaaaagttagtaattttgcaacattgattactattcaaatcatgttatttgccttccagataacattacatgttcctgtagcctatactgatatactttcattgttttttggctcagccacattcttttttataactaaatatgtaaataagaagaaacagtatgtgaatagaaacattatttatgtactgcttgcaacagcaactagcacgattggttttataagtaaagggacgggtcttatcttgatcttagcgatgatcttattctttgctttttatcatactgggaaatggcggttgctagcattccttcctttagtttttttagttttaggaaattttgggtggaaacaatttatcgatgcacaaaaactctatccgaatagtcactatggacagcccaatacacattatttgatgatgggattgaataatacgcctattcctgataatttatctggggatgacaagtatcgttgggtagtgggtgcttattctagcgccgatcaaagatttacatgggatatgttcttggataaaaaaatgcctaaaaaagaagtggaagaaaagcacctatctatcataaaagaacgattgaatgcgatggattttaagcaattcttagctgcaatcaataataaggttgcagttacttggagctcaggtgatctaaaatcatcatttgaaatatttttgggtacaggaaaaaatgaaaagaatatgtgggtattcagaagtaaaacaagtggattaattttatacgctgtaatgatggtgattcaatacttggtttatcttggaattatttttaccagtataaaatttttcaagaatataaatccactagtttttttgagtaacatatatatttctggttattttgcattcttattgatctgggaatctagtcctagatacgctatggggatttttgtacctgcgataataatgataggactgttgattgaaaaagagaagacaaaaagaatctcttagtttgtagtcattcactaaatgatgtaatgtagataaaagaagacaagtctaataaataagttagatttgtcttctttatttacaataaagaaatgtttctctctataaagaagaatctcaaatagtggaaatatggattttttaatcaaatagaacgttcggattttgcttgaaatccgaattttttgtttacttatgttttgttttagtatatgataaaacacgttgttttattaataaatcgaaattttaacggactttatttataatgttcggatttagggggatggaagatgaaggaaaaaatactttcctacttcgaaatagaaaaattgaacaccacggtaaaacgtgaggtactggcaggatttacgacatttatttcaatggcctatatcttatttgtaaatccaactgtattaggcgcttctggaatggatgaaggagcggtgttcactgcgactgcattagccagtgcgattggctgtattttgatgggggtattagcccgttatccaattggaacggcacctgctcttgggatcaatgctttctttgcttattctgtttgtttagggatggggatcccatgggaaacagcattgtccggcgtattcgttgcttctttgatctttattttgattacaatcttcaaactgcgggaaatgatcattgatgcgatcccagcagatttgaaatatgcgatttctggtggtatcggtctatttattgctttccttggtctgagcgaaggtggcatcatcgtttcgaatgaatctacattagtaggattaggatcactcaacgttggttctacttggttgacgatttttggattagtcgtcacggctatcttgcttgttcgacgtgtaccaggtggcattttcatcgggatggcagctacaacgattttaggtctggtcacaggtttgattccaatgccttctgaaattgttgccgcagcaccaagtttgaaaccaacatttttagttgcgttaaaacatgtaggggacatcaattctcttcaaatgtgggtcgtagtactaacattcttgcttgtgactttctttgatacagcaggaactttagttggattagcaaatcaagcaggctttatgaaagacaacaagatgcctcgtgtagggaaagctttagcttctgattcaacagctatgcttgcgggctccttattaggtacttctcctgttggtgcattcgtagaatcgtcagctggaatcgctgttggaggacgctcaggaatcacagcaattactacaggaatctttttcttgttaggtttgttcttttctccattactatcagttgttacttcacaagtaactgcaccagcattgatcatggtaggtgttttgatggctcaatcattacgtcaaatcgaatggggaaaattagagattgcgatcccttccttcttgatcttgatcggcatgcctttgacttatagtatttcagatgggattgcattaggttttattttctatccaattacgatgttagcggctaaaagaggaaaagaagtatctccaatcatgtatggtctgttctttgtattcgtgggattcatgtggatattgaatatgaaataaagaggttgtgaaatcagtgttctggcctgagtattagctcaaaaaacgaaaaaatagttcctcctattttgccgttttttgagctaataccgagggacagctgagtgaacaccgtttataaagaggttgtgaaatcagcgttcttccctacatcaatcaatcctttcaaaaaacagttgaggaaatttcctcagctgtttttttgttttattctgttaccgataacaaggtgcaatgactgtttgaaagcgttacaatttttggtggaagaaactaaactagatgattaagtgaaaaatagaaacatccatttataggagggaaatcatggaacgaaaatggtggcaccattcagttgtttatcaaatctatccaagaagttttcaagattcaaatcaagatgggattggagacttgcaagggattatttctagattggattatctggcatatttgggcattgatgtgatttggctttcgccagtgtacgagtctccaaatgatgacaatggctatgatatcagtgattatcaagcaatcatggcagaattcggtacgatggaagaattggaggaactgattgaagaagcaaagaaaagaaatatccgtatcgttatggatctggtggtgaatcatacttcggatgaacacccgtggttcattgaggcacgtaaaaataaagaaaatccttatcgtgactactatatttggcgtgatccagtcaatggagaggaacctaatggattgcgctcgatattcagtggacctgcttggcagttggatgagcaaacagggcaatattttctgcacttgtatagcaagcgtcaacctgatttgaattggaaaaacaaacaggttcgccaagcgatttatcaaatgatgaatttctggatcgacaaaggtattggtggctttcgtatggacgtgatcgatatgattggcaaagaaccggataaagaaatcacaagtaatggacctaaactgcatgagtatcttcaggaaatgaatcaagcaacttttggcgacaaaaatctgatgaccgttggcgaaacatggggagcaactaccgagattgctaaactttattccaatcctaaaagaaaggaattatccatgatcttccaattcgaacacataggattagatcagcaagaaggcaaagacaaatgggatttgaaacctttaagtatctctgaactgaaaaaagtattatcgaaatggcaaacttctttgggggatgaaggatggaatagtttattttggaataatcatgatctcccgcgaattgtttctcgttggggaaatgacgatatgtatcgaaaagaaagtgccaagatgtttgctatcttgcttcatatgatgaaaggcactccttatatctatcaaggagaagaattaggcatgacgaattgcccaattgatgatatcgcggaagcaaaagatattgagacaatcaatatgtataacgaaaggatttcttctggatttacaaaagaggaaatcttggaatcaatcaatgcgaaaggaagagacaatgctaggacgcctatgcaatggaacgccagtgaacatgctgggtttactatgggaattccatggcttcgagtcaacccaaattataaagaaatcaatgcagaagaagcgttagcagatcaaaaatctgttttttatatgtacaaaaaattgatcgatttgcgtagaaaacacgacatcatcgtctggggtgactatgaattagtagaagagacgccagagcatatctttgcctattctcgcacatatgaagaccagcgatggctcgttgtttgcaatatgtccagtgaaaaacaggtgttcactgttccacgtgaagctttaagggttattgtatcaaattatcctctgaaacagttaccagacggcaaagttgagttacgaccatatgaagcatttgtggtggaagtaaaataaagaaaagcttatttgattgaaacgtattaccgagaagttgtgacatattttttgtcacaacttctttttctcaaaactaaacagaggaggcggtcattactccgtgttttttgacaaaaaataaaaatcatactatgatatgtacgccaatggaggggatgaaatggaaaagccaattgaaaaagcgttggatgaatgtcttttctttagtgtgaaaaagcttgatcgcatgttgaataaattagctgatgaagcatttagaaaaacaggcctggcaccaacatatggatttattttattgatattaaaagaaaaagatggtataccgcaaaaagatattgcgcaaatgctctattctgcgccttcaacaatcgctcgttttgttgaaaaattagaatataaaggatacgtcaaaacagttagcgaaggacgcttgtcattggtttatcttacagaacaaggacgccaatttactaaggaagtcgatggtagctgggaagaactccatcagtcgtacaaagcagtcttgggaaatgaagcaagtaaagaattagccgagataatgaatgaagcaacagataagttacaaaaaaaataaaaatttttttaagcaaaatagttgcatgtacaactaatcgaggggtttaatgatagatgattctcgataggttaattagagcaattcatgggaggaataacaatgtcacaatttgatcaatcaattactttaccttcaggagttcaattgaagaatcgattgatgctgtcgcctatgacgacacaactcagcttcttcaatggtgtgatcaccgaagatgagattacttattataaacaacgttctaaaggacttggtgctgttattactggtgctgcaaatgtccaagatatcggaaaaggttggccaggtgaactgagcatcgctcatgatgaaatgattcctcggttaagtgaactagctaaagcaatccaaggagacggtgcaaaagcgattgttcagattttccacggtggacgaatgactagtcgagctactctatccggagaacagcctgtatctgcaagtgcagttgcagcggaacgacctgatgcagaaacaccgcgagcattaagtgaaaatgaaatcaaagaaacaatccaagcatttggcgaagccacacgcagagcgattgaatcaggatttgatggtatcgagttgcatggagcaaatacgtatttgattcaacaatttttctctccacattcgaatagacgagaggatcaatggggcggtagcttagaaaatcgctatcgttttattgacgaattattaacaacggttttctcaacggttgaaaaatatgcaaaaaaaccattcatcgtagggtatcgtttctcaccagaagaatatgaaacaccaggtattcgttttgaagacacgatctggcttcttgaacgattacgtgagacaaaactagattatctgcatgtttcattaaatgcgtatgatcgaagagcccgttctgataaatacagcgatcagtcgattcttgaagctgtccacgacacgatccaaggaaagatccctttaattggtgtcggaggcatccgtactcgcaaagatgtagagcaagtactgaaatatgcagaacttgcagcaattggacagcaaatgatcgtcgatcctgactgggcagagaagttattggaaaaccgtgaggatgaatttgtaacgaaaccttttgaagaagcatataaagagctttatttgccaagtccattatataatttcttgaaagcacgttatcaataactcaatttttatagaaagaggatggaaaaatgaaagtattgatcgtattaacaaatgtagaaaagtacgaaaagatcgagcgtcctacaggtttgtggttaagtgaactaactcatttttatgatgtattagtaaaaaatggaatcgatgcagattttgtcagtcctaaaggtggatatgtacctttagaaccgcaaagcgttttgaatatggatgaaatcgattgggcctattataaagatgaagatttcagaaatcgggccttgggaaataccttacgtcctgatgatgtggatgcaaaagattatgcagcagtttattatgctggtggccacggaacaatgtgggattttccagaagcaacagatcttgggaaagttgcttcacaaatctatcgaaatgaaggactggtctcagctgtttgtcacggtgttgtcggattgttgccagttacagatgaatctggaaagtctattttagctggacgcacagtgactggattcagtaatgaagaagaggaagccaatggtacaacgaatgaagtaccattcttagcagaagatgctttgaaagaaaaaggagctgactatcagtcaggtccagctttttcagaagtcgttcaaatcgatggacgtcttcttacagggcaaaaccctcaatctgctcatcaattgggcgaagtagtggttgaagcattaaagcattaaaaattgtcaacataaaaatgataggtctattctaactattacattacacacgctaaaactcgtcttttcgttcttttctgtttcctatttggacagaggtacgcaaaaggcgagttttttgcctttctaagagtacattttttgaaacatctcttcagaaatgatactcttcaattaggtcaactaatttattactgagaagcagacctagtcacacggtaggatggagagagtgtgttctgctacgctgctatggatcataggaatgagtaaacgtggtttatgaacattgtgatttcagcccatgttggcagtcgcacacttaataagaaagaggaatgcagatgaacattgtaattgtcggcgggtcgtttgcagggattcatgcggctatttatcttcgccaattgataccaacaagtgaaatatatttgattgaaaagcaatcgaagttagggtggattcccagcggattcaatctgatagtaaaaggaaaggtcaccagtgaaaaacaactttcttggatcaccaaagaagagctgattgaccgctatcgtatccatgtttacacagaaaagacggtaataggattggaagaaaagaaagtcattttagcaggaggagacaaactggattttgaccgtttgattttggcgactggctcaaatcaaaattttcgaaatgttcctgcagaagcaagattcattcactcagttaaaaagatacaaaacatagcttctcttcagcaaaagatcatggatgcaaaaaaaattgccatcattggagcaggtcaagcagggatcgaaatagctgaagggttagcatcaggaaaaacacaaatccatctttatgaaagtcgaaagtcgattctttttcgttacctagaccctgaaatgacggaaccgttagtaaaggaaatgaaaaatcaagggatatcgcttttcttagaagagcaagtcgtatctttatccgaaaatgaaaccgctgtagtagagacggaaagaagaagggaaaactatgatcttgttttgctggctaaccattctcgccccgacaatcagatgtgggaagaacaattaacattgaatgatgatggaacgatctgggtagatgactatttgcaaacgtctcaaaaagacgtctatgcaattggcgatgcaatccaagtcacttttcgcccaacaaatgaaaaaatgtacgtttctctagtaaacaacgctgtccgtacagcgcgaaatgtcagcaagacaattagcggctccgcgacaaaggatcagggaacctaccgaccagtcggcaatcagtggtttggctatttcttaggaagcgtaggtatgacagaagaagaaagcattttttatccccaaaaaattgaaacagggtacgcggaatacaagcttgcagcaataaaccaaagcaaagtcaaaatcaaattcctatttgattctgaaaaaaagattcttggagcacagctccaaagcagaaaagaaatgttccatcttcttgaccaactgacaatcgcagtagaagaaggctggacgttcgaacagttagaagaacatgagctgtttttccagccagaatatcgtgtgcctgatatggtgtggtcaaaggtggcgaatactgcctatgaagattgaagcattattagaaagaaaagagcagttacagatcctgattttgcgaaaccttgttctgcaagggggaacagcctctatcaatggattgagagagcatgtccaactgtcaaaaacttcttttgatcaatatttggaagatattgaattgattggccggatgatgggaaaaaaagtagaagtacagcgaaacgagtatcaggcgctgcttgtgttggacgaagatgtcagtttggaaaaaattcttttgtttttattacaggaaagcttgaagtttaaaatgcttgtctatttattagaacaccagcaagtatccatcgttcgattagcgacagcgtttaatatcagtgagtcttctgtttttcgaaaaatcaaagaattgaaccagctcttagaggaatttggattacaaatcaaaaacggtcaattatacggagaagagctacagatccgatatttttattatgaattattccaatatatcccggaagaccaacgaccgttttttttgcaaaatacaccagaaaaaagaccattcattctaggattgggtcgcgtattagaaacgacgtttacggcatcagcagaagcacagattgcttgctggctcgggatcacgaaaaaaagactattgaatgaaaaaagtacgtacgcaactttggaagaaaagaaattactctatcagtcggatcggctttatcaagcaatcgatccaatcatcgtgatgcatcttagtcgaacagcagcagaactgaatgtatacgaaacaatgatgttttacagcttttttgtttctttttcgatagtagacgaagaaatattttatcaatatgatttgacacggagcaaaaagttacccacagctgttttggatacttatattcgggaaacgatgctatggcattatcgtcctcgtcgtttgaaaatcaaagaggaaaaagcagtaggctaccaaatttcacaaatcaacaatgaatggtttttctttgttggaaagatcgaagtctacgagcgtgatcggcttttggagcagcagcaaaaaatgcttgggcattccttaacacagttattggagaaactacaggaaacagcgatgcagcaattgccaaggaaaagcaccgaagacagtgcacttagttatctgatgatccagtatgccaatgttcttttgatgatcgatttttatattgcgaaaccagtagtgatagggatcgatttagaaagtttgcctatttatcgtattgctttccaacagtatctgatcagagaactgagaggagtcagcggtattgagattgaaagttatgaagaaggaaaaaactatgatttggtcataacgttttgtcagagaaacaagcaacagaatgaatattatctatcagaatttgcgtcgccttatgacattatccgattgaaaagaagaatagaaatgttgaaaaaagaaaagaattaatcaaaaactagcatcataatgaaaaactgtcaaaaaaagaaaaaacgaataaaattttgacagtttctttttttaaatgagtagtatgataaaagtagttaaagaaagcgtttgcagataatggagggaatcacaatgacagaaccaacgtatatcatggcgattgaccaaggtacaactagctcacgagcaattatctttgacaagaaaggaagacatatcggcagttctcaaaaagagttcacgcaatatttcccgcaagaaagctgggttgaacatgatgcaaatgaaatctggaattctgtacagtcagttattgccggagctttcatcgaatcagggatcaaaccaaatcagattgctgggattggcataacgaaccagcgtgaaacaacagtaatctgggaaaaagatacaggacgtccaatctatcatgcagttgtttggcaatccagacaatcagctggaattgcagataacttaaaaaatgaaggctatcaagaatttttccacgaaaaaacagggttagtgatcgatgcctatttctcagcaacgaagatacgctggattcttgatcatgtagaaggtgcgcaagaacgcgctgaaaaaggtgagttaatgtttggaacgattgattcgtggttagtatggaaactgaccgatggacaagcacatgttactgattactcgaatgctagtcggacgatgttgttcaatatccatcagctagattgggatcaggaaattttggatttattgaatattcctcgagtgatgttaccaaaagttacttctaactcagaagtttatggttatacgcaaggttatcatttttatggaagcgaagcaccaatttcagggatggcaggagaccagcaagctgcattattcggacaaatggcattcgaaccagggatggtcaagaatacttatggtacaggttcatttattgtcatgaataccggtgaaaaaccgcaattatccaaaaataatttattgacgacaattggttacggcataaatggaaaggtttactatgctttagaaggaagtatttttgtggctggttcttcgattcaatggctgagagatggacttcaaatgttgcaaaaagctagtgattcggaagacgcggcaaaacgctccacaaacgaagatgaggtctatgttgttcctgcatttgttggactgggggctccttattgggatcagtcagcgcgaggggctatgtttggtttgacacgtggaacgacaaaagaagatatcattaaagctactttgcagtcgattgcctatcaagtgagagatatcatcgatacgatgcaagatgacactggaatcaatattcctgtattgaaagtggatggcggtgcagcaaataatgaatatctgatgcaattccaaacagatatcttgaatgtaccgatccaacgagcagaaaatttggaaacaacagcactaggggcagcatttttagcaggattagctgtcggttattggaaagatacagatgagatccgcgaattttatgaagctggtaagttatttgaagttcaaatggaggaagagcgccgagaaaaactttacaatggctggaaaaaagcagtaaaagctacccaagcatttgaataaggaggaaatccatatgttttcaaacaagacaagacaagatagcattcaaaaaatgaagcaagaagaattggatctgttgatcatcggtggcggaatcactggtgccggtgtggcagtccaagcagcagcatcaggaatcaaaacaggattgatcgaaatgcaagattttgcagaagggacgtcctctcgctcgaccaaacttgtgcatggcggtattcgttatctgaaaacatttgatgtggaagtagtagctgacacagttggtgaacgtgcagtcgtacaaggtattgccccacacatcccaaaaccagatccaatgcttttaccaatctatgaagatgaaggagcaacaaccttcaatatgttctccgtcaaagtagcaatggacctttacgacaaactggcaaatgtgacaggaactaaatatgagaactataccctgacaccagaagaagtattggaaagagaaccatttttgaaaaaagaaggactaaaaggtgcaggtgtttaccttgatttccgcaacaatgatgcccgtttagtgatcgataatatcaaaaaagctgcagaagatggggcttatctagtaagtaaaatgaaagcggttggcttcttatatgagggcgatcaaatcgttggcgtcaaagctcgtgatctgctgacagatgaagtgatcgagatcaaagcaaaattagtgatcaatacgagtggtccttgggtagataaagtacggaacttgaattttacgcgtccagtctctcctaaaatgcgtccaaccaaagggatccatttagtcgtagatgcgaaaaaactgcctgtaccacaacccacatacttcgatacaggaaaacaagatgggcggatggtctttgctatcccaagagaaaacaagacttactttggcacaacagatacggattaccaaggagactttacggatccgaaagtcacacaagaagacgtggattatctattggatgtaatcaaccatcgctatccagaagcaaatatcacattggcagatatcgaagcaagctgggcaggacttcgtccactattgattggtaattctggttctgattataatggtggagataatggatcgatttcagataagagcttcaataaagtagttgatacagtgagtgaatataaggaaaataaagtttcacgtgctgaagtagaagatgtgttaaaccatttggaaaacagccgtgatgaaaaagcaccttctacgatttccagaggtagttctttagaaagagaaccagatggattgctgactttatcaggtgggaaaatcaccgattaccgtaagatggcagaaggagctttacgattgattcgtcagctgttaaaagaagaatacggaatagagacgaaagaaatcgactctaaaaaatatcagatttcaggtggaaatttcgatccaacgaaattagaagaaacagtgaaggaattagcaaaagaaggagtagcagccggtttagaggaagaagatgctacttatatcgctgatttttacgggactaatgctcgacgtatctttgaattagcaaaagaaatggcaccttatcctggtttgagtctcgctgagtcagctcggttacgttatggcttagaagaagaaatggttttggctccaggtgattatctcattcgtcggacgaatcatctgttgtttgaacgagatcagctggatgagatcaagcaacctgtgatcgatgcaattgctgggtattttgggtggacagaagaagagaaagcgcaacagactaaacgtttagaagcattgatcgcagaatcagatctgcgagaactaaagggggagaaataaatgaacagtgatatgactcaaatcatgggggagtttattgggacattgatcctagtcttgcttggagatggtgtgtgtgcagctgtgaatctaaacaaaagtaaagcacaagcttctggatggattgtcatcgcatttggttggggacttgctgtaacaatggctgtctatatttctggattcatgggcccagctcatttgaatcctgcagtctctctagctatggcgatgacaggggcaattagttggaatcttgtcgttcctttcatcattgcgcaagttttaggagcttttgcaggggccattcttgtttggctttcttatttgccacattggaatgcaacgaaagatgagagtgcgattttaggtacgtttgcaacaggtcctgctatacggaattatccagcaaatgtaatcacagaattaattggtacatttgtattagttcttgggttgctagcttttggacaaaacgaatttgcacctggaacgaacgtattcgctgtaggtggattgatcttagctatcggtctttcattaggaggaccaacaggatacgcaatcaaccctgctcgggactttggtcctcgattagcacatgcggtattgccaatagctaataaaggaacttcagattgggcatattcatgggtaccaattgcaggcccaatgattggagcaattatcgcggtaggtgtctattcgttaatggtgtaagtctataaaacatactaaggtttgacaatcaaaaggcgtcttgctatagttaagtggaaaataaataagacctagaagaatggggaatgttttgtgagtgtagctggtatctaatcagtaagtcgaatagccaataaacaaggtttatttggtgagcttatgaaacggtacctgtcaggaaaacaatatctttgtattctaatgaggataggacatgacttttttaagctgtgttctatccttttatttatctctaggcccttatttattttgggacaggtatctcttcaagaaaaggagagagtatgaacaacgaaatgattagtcaattacaatttgatcggatcaaaaaggaaatccaagcaagagcaatcggaaactatagcaaaaaacgaatcagcaatatgacggcctcgacaaacctacaaaccgtcttagatcgtcaagaagaaacaagagaagcacgcttgatcttagaaagtagtcagcatgttccatttatgggattgccgaggatcgatacactgacagaacaagtcaaaaaagggttggttctgtcgcccgctgatttgatcgaatatgcggattttctaagaagcagtcggatgatcacaaagttttttgataagaatcaataccaggcacctttgttgtttgcttatagcaagcatcttcctgatttgataaatgtagaagagttgattgaccaaaaaataaaaaataataaagtcagtgacgatgcttcacgtaatctgcgtaaagtacgcaaacaattacaaataatcgaaaaagaaatccagtcaaaattgctgaaattcttacgtcatccgaaaaacaaagaaatgatccaagaagcaatgatcgttcaaaaaggtgaatattatacgattcctatcaaagtcagctataaaaataaagtagatgggacaatcatcgatgaatcgaacaaaggaacgacggtttttattgaaccgactgtggtttctaaactgaatgaacactatcaattgttaaaagctgaagaaatcagtgaagaatatcaagttctggctgcattgactggtgctattgcagaaaatgaagaagcaatcgatttattgatcgaaacgatgacggtattagatatcatttttgctcgggcaaaactcagtcgagaaatcaatgggatcacgcctaaaatcaataaatcagaacatatcgtcatcaaacaaggcagacatccatttttacctgatcatgcggtaccattggatattgaaatcggtaaagactatcgaggcttgattatcactggagcaaatgccggcggtaaaacagtcgtgttgaagacggtcggtttattgactttgatggcgatgttcggcatgcaagttccggcaaaagaagggacagagcttgctgtctttgatgaggttttcgtcgatgtcggtgaccaccaaaatttagaaaatgcgttgagcacattttctggtcatatgcaaaacatcgctgctattttgaaaaagataaaaaggaatacattggtacttctggatgagattggcagtggaacagagccaaatgaaggggctgcattagcgattgcaatcatggaatctatgtatgagcagggggcattgatcattgccacgacccattatggagaaattaagaaatttgccagggatcatgaagattttgtgccggctgctatggctttcgatcgggaagcacttcgtcctaaatatcaattgcgtgttggagaaacaggagaaagccaagctttatggattgcacataaaatggctatgtctatgaaattgatccagcaagcagagcgttacctggaggaaaaagcctaccggacacagaaaaaagaatttcctcctaagacagcagttataactaggaaggacaataaaaaagaacgccagctctttgcaaaaggcgatcgaatatttgtgaatgaataccaaaaagaagcattagtttatgaggatataggtgaagatacgattgccgtatatttagaaaaagaaatgatccgtgtgcctcgtcagcgtgttcgtctggtgcgttcagcagaaaatctgtacccgacaggttacgatttagacagtctgtttatcgattttaaaacacggaaacagcagcgtgacctagagcgaggatcaaaaaaagcccataaagcgttagtaaaagaaatgcgtaaacgacaggaagaaagaagagcaaaagatgaaaaaagcaagtgattatttcagaccaactcatatgatcagtgattgcaaaaaaataacagcagtaaaatcattggttttattctctatgtaagctaaaataaaaaagagtgctgaggaggtgggtcggtcaaatgaaaataagcacaaactggcgtaaagaaatccaaacgattccgaatcttttatcgatattccgtattctcttgctgccgatttatctttattttgtgctgagacagtcgttttatgtagcaggcacgataattgttgtctcaggattgtctgattatttagatggggtcattgctcggagatataatcaggtaacagacttagggaaggtacttgatccgtttgcagataaattgacacaacttttcctgattttgtctatggcatggtatcgaccgtggctttggctattgtttggtctattcttgataaaagaaggctttatgtttgtagctggattaatcgggctatctaaaaatatcaaattaagtggtgcgaagtggtatggcaaagtagcgactgctgtcatctatgttggcatgatccttttgttgcttttcccagaattaccaacgctgtgggtgagagtcatttttgccgtcatcacttacggtcttttacaatcttttatcttgtatgctgtcgagtaccgaaagatgtttcaaagaaaataaagaaggggtgtgacctatgtcgcactcctttttttgataaatagacttccaatagctacttctcgataataagccaaccaaaccaaaaacatgaaaagttgtttttaatattatttcttgtaactcggagttaaatggtaggatcacaacctctactgactagggcttgatataagcataaccttgggattgcagttcaactaaatcaagtacacctgctggtacaacgatcacttgttcaggtaaagaactttctgaaacatgattagcacgcatagcattcgcacaagcgtgaaaaacgacttctttcaaatttaagaattctgcattggcagagtctagataaccggtaatcgcgatgccgttgacggaaacgacgatcgtcgtttcaggagaagcttttatcaggttttttacgtttttccctgtttctgaccatttttctaattcatcaatatggaaaacgactttcattgaaatcattcctttactttttaataatcatcttgattgcttgctctaatttagctgcttgttcttctggattactatcaggattttcaaagcaatttttcagattatctgcaacgatcattcccattacgcgatcaatgctagaacgaacagcgcttaattgagtgatgacatccatacattctttttcatcttcgatcattttttggataccacgaatttgtccctctgtacgtttcaaacggttcaggatatttttattctcaatctccatagcacattctcctccatttttataactcgataatacccctaatcggtattttatgcaaatataaaaagcagtaaaaaaatgaagagtcattctggttgacagaataagaaagctcttgtttaatataccccataaggtatttataaaatataaatgaggtgcagaaaatgagtttgttatttcaacccataaaatcgataacagtcccagaattaaaggaaaagcttttagaaaagccagtattacttgatgttagaacacctgtagaataccggggtgggcatataaaaggagctaaaaatattccattacaaggcataaacagatatgatggagacaaagaaaagaccgtttatgtgatttgtcaatcagggatgaggagtaaacaagcagcaaaagaattaaagaaatctggttatgatgtggtgaatgtacgtggcggtatgaatcaatggtttgatcgaacagtaggagggaaataagatgaaaatcgttattgtcggaggtgtagcgggtgggatgtctgctgctacacggcttcgccgtttaatggaagatgcagaaatcattgtttttgaaaaaggaccgtatgtttcttttgcaaattgcggcttgccttattatctttcgggtgaaatcagtgaccgggaaaatcttctggtccaaacgccagaatcattagctgctcgtttttgtttagatgtgcgtccaaaccatgaagtgacagctatctttcctgaaaacaaaacagtagaagtcgtacatggaggtcaaaaacacctggaacagtacgatgtattggttttatctcctggcgcaaaaccagttgttccgtcaattccagggataacagaagccgacaatgttttttctattagaaatgtaccagacatcgataaagtgatgcatgcgttagaaaaacagccaaaccgtgccgtgatcgttggtgcaggattcatcggattggaaatggcagaaaacctaaaaaaaagaggtttagaagtcatggtgatcgaacaagcgccgcatattcttccgacactggatgaagaaatggcagcttttatagaaaaagaattgtctcatcaaggagtagaagtgattacttctcatgctgtcgctagatttgaagaccacgggaaacgattgcgactggatgacgggcgtaccatccctgctgatttagttattttatccattggtgttcgtcctgataaccagttagcagtgaccgctggaatcgaattaggtatacgcgggggtatcctagtagacgaacgatatcaaacgaatattcctgatatttatgcggtgggggatgctatcgttgtaaaacagctaatcactggaaaagatgcacttatttctcttgcttcaccagccaatcgtcaaggtagacaagttgcagacacgatttccggaatttctcgaagaaatcaaggcagtattggaacagcaattatacgaacatttggaatgaccgccgcatccaccggattaagtgaaagaacagccaaagaaaacgagctgtcttttgaagtcgttcatgtgtcaggaaaagatcatgcaagctattatccagaagcaacagatattttactgaagttgatcttccatccagagactggcgagatttatggtgcacaaggtgttggggcaaaaggtgtggataaacggatcgatattttagcaacagcaatcaaagggcatttgacgatcttcgatttgccggagttagaattgacgtatgcaccgccatttggctcagccaaagatccagtaaacatgctaggatatgcagcaatgaacattgcagaagggcttagtgaaaccgtacaatggcatgaattgccaacagaattagccaaaggaaaaattttattagatgtgcgaacagcagaagaattggaaaaaggcaaattcaaggaagccaaacatatccctttgaatgaacttcgggaccgattaaatgaattagacagtcaacaagaatatatcgtcagctgtcatagcggcttacgtagctatctagcagaaagaatcttgaagcagtctggctaccacgtaaaaaaccttgatggagcattttctttatatcaaactgtccgacctgaagaactgatatatcctaacaaatgatactcgttaaaaagcttgcattcgactcttaaaagaggtaaactaatcggttccaccactttaaaaaaagaggagaatgtgtatggtcaacacacaaaagcagttagaagaagcatatctgaagaatgtgtatcaaaagctaatcgataaaagaaacgaactgcgtgaatcgatggatacggcaaaaatagaaggaaaccagtcgctgaaagaaatggctggcgagcttcgattgaattttgacagttacttagataacctggatactttttcgatgattgaaatgaaaaatagagaaatcgatcagatgaatatcaaacagaaaaacgcagaaaatcagctggcaaagatcgaacgtttattgaaaagtccctattttggaaaagtcattgtagactttctggataatgagccaaaagaatccttttatatcggtacagcaaatttcacagatgatgtagatgaaaatcttgtttatgattggcgttcaccaattgccgaacttttttacaataacgtgattggtccgtcttcttatacggttcgtcaaaataaaatcgatacggttatcaaagaaagacgacaatttattttggaaagagatcgtttggtcaagttttttgatacgtctgtagctatccaagacgatgtgttattagaagtgttaggtcaagatgaaaccaatgaaatgaaggctatcactgctacgatccaatcggaacaaaacacaatcattcgggatgtgaaaagtcaaaatatcttggtaaatggcgtagcaggaagtggtaaaacctctgctatcatgcagcgtattgcgtatctgctctatttatatcgagatacgatgacatctgatgacttgctgattctatcgcctaatcatcggttcatcgactatatctcgaatgtcctaccatcattaggcgaaagaaatccactgaatctaaccatcttgcagctggtttcacagctttcagcagaggaaatagaaggtgaagaagcttatttcaaacgtatcacgaaagaaaatgtatcagagcaagcagaacatttgcgtagtaaagagtatatcgatgatctaaaacgatcagatcctttgtttctagatcatcctgattttatccgtggacttactaaaaatggaaaaacagttctttctaaaaaaacgatcgaaaaaatatatgagaaagttcctgctcatcctaaattgatcgataggcttcaagcaacgaaaaaggcactgatgagcgaatggaagaaccatcttttgaaacaagcaaaaagtcctgcagtgcagaatcaggtactctcgttgacagaagataggcagttgaaattattcggtgaattgatttctgatgattcggaacaaagtatcgcaacttatgcaaggaaacttttacaaaaaaactatcgaaaaataaccagacaaatcgaagaaatggcgtgggtggatgagcatcgattgtttgaaagaatttatgaaaaacgatatggctcagcttatgtttggcaacacacacgtactgttgatgaagcagtcattttattagctattcatcatttgcttgttgaaaaggtaaatgtaccagtgtttcgctatttattgattgatgaagtacaagattataccctggcacaattaggtctattgattgaattatttccaaaaactcactttactttagtaggtgacgagaatcaagcaatctttaattcttccactacttttgctgatattatgcgttgtttcgatgacttccatctgccgatccatcgatatgatcttagaaatagttaccgttctagcggagcaatcacagagcttttcaaaacctatgctgtggatcaagagaagatcgacatcgtatcgatccgaccgcaaggaaaagaacccgaataccgctcttttcaatcctctgaagaattgttggaaatactagctgagattttggcttctctaaaaggagaaaaagcggcaattatcacccaaacagaagagaagacccaaacgctacaagaatcgattaaaaaaagttcatatggattagaaaactgccagatcattcctttgagtctagcaaaaggactagaatttgatcatgtaatcttgtatccatttgaaaacaatagagatgagcaaagaagacgcagacaaatgtacacggcgatatctagaggaatgaaaagcattgtcgtattggaaagagaaacataattaagagataaaaaaataaaaagaacaactgataaaaagaacaaaatatttttcatttgccgatgagaaatgttttgttctttttcttaggaaaaatttaggaacactttatgtgaaaagaaatgaaaagtatggtaaactcctacgtcgtaacaaaaaatgtgaggtgaggatatgaaaaaagtaacaagagaagaagttgcatcgattttggtgaaagataagtatttttcgaaaggtaattattggttgaaaatttggcaaacgctagtggctcttttcggttggatgatcgttgttcttccttttatatgggtgttttttccattgacgagaccagaaagagccaaagatttttacttgtacgcttttttattggaaaagaaaatgctgtatttcttcatcggcttttttgcattgatctttttcagcttcctgattatctcatttgtgttgactagatggaacaatcgaaatttgtatagaaaagtaaataagtcttttgaatatgaagatgaagaattgaaaaaaagacaagaattacttgaagaaatgtatacggaacgttttggaacaaaggaagagagagaaacggtccgtttttattctgtctccgaagagaaaaatctagatacgacactcattgcagatttgtataaagaaaatgggatggaactgaaatgacctcaatcactcatacaggtaatcaattcctagatacttgtttgtctatcatgtatttttttctcgtttcttacccgattttaggcggatttgcatggtttattggtgtctggtgttatgtttttttatacaaacataaacaaaaagaatgggtagatgttccatcaggtgtcgaaccgttcattacgatcatggtaccagcccataatgaagagattgtgatcgaagatacgatcgagtatttgatgacgaaattgaattatcacaactatgaagtattagtgacagatgatggttcaacggaccaaataccagaaatattagccagactgatgaaaaaatacgctaatcttcgtgtggttcggatcgaaaaaaataaaggaaaagcccatgcgtttaatatcggacttgcctttgcaaaagggaaattgattttaagcaatgatgcagatacggtaccggagccagatgcactgaacaggtatgtgaattattttattcgccctggtgcaagacatattgctgcggtcactgcaaatatggatgtccaaaatcgtacaaagttgattgcaaaatcgcaaacggttgaattctcaagtatcgttggtattatcaaacgaacacagtcagctgttttcggtggcctttatgcgtacagtggggcaaatacgatgtatcgaaaagaagccttgatcgatgtgggcggattcagacaagatcgagcgacagaagacatcagtattgcttgggatcatcagttgaatgattgggtatctgtttttgctcctgggatcatctttttcatggaagtacctgtgacgttgaagatgctatatcgacaaagaaaacgttgggcaaaaggtggaacagaagtctggctgacgaatttcaaaaaagcgatgctccatccttttgaacatatcggaagaacgatcatcttcattgatcaaacattgagtattgtctggtcaatattcttttgtatttccgtgattctttttattggattgattgggcattatgtgtaccaaggaaactatgaacagatctatgtcacttttacattcagttttgtgttcatctgctttgaaatggtcgcaggatttttccagttgttagcttcgctgattgtagatgatcgacgaagaaaattgaaataccttcttttctcacccctatatatgcttttgttctggatagtgaacgcgataacgatcgtgacgactttcattccagcggtcaaaacgattttaggttatggaagcgggacatggaaaagtccggaacgtacaaaaaaataaaagatgcaccgttttttagacaaacagcctgttgtgtttatggttcttccagacatttttgcttataataagaaattagttaaaaagtagtaaggatgggaaagtgatgaaaaaaagaatgaagccgttgatctggccgattgctgttttcggtattttcttcttcggacaaacagcttttgcagaaacttctgaacctgctcaaacagagccttcaacaactataagctcttctgatgctgaaaaaggaacctcagaaacagaaatgacttccaatgtaccgacagataactcaggagaaacgatttcgtcttcagaagatacatcaacgaatagttctacctcttctgaccaaatcgatcatttgcaagacttggaaaataaaagaaaagaactcgaagaagcattagaagctgcaaaaaacaaattgaaagaagaccaagcagcaatcgatcaagatttagctgatcttaaaaataaagcgggaaatgaccgtgcacaacttgagaaaaagcttgctgaagcgaaagcaaaagcggaagctgtccaaacagatcttgacgggaagatccaacaagcaaaagaattcaatcaacaattagatcaggttgctcaaacagcttctggaaagctaagtcaaactcaagcggatatcacagcggccagtcaagcgatccatggaaagatcagcgaagcgcaaacagttgctaatgattttgaagcaaaaaaagcagacttagcagctagtttccaacgaataaaagatattttgcattcggcaggagaaaaatcagtggcctctggaaccacgacagaaacagttcatcaaacgacagagccatccgaatcaacaagtcagactttaccaaaaacaaatgaaaaaacagcttctgtcaattattccttcgtaggcacaggtgtgctagttgcagcagtttacggaatcattcgcaaaaagaaataaaaaagagagaatgggaaggtagtgaacctcgaagttagactgaaaaatctaactcttgggtcccactacatgtcccatctctttttatttattaagacagctattcctacttatcttgtggagacagctgttccactacatgtgaccatcagcataccattgtcgctacctaatacttcgtagtccatttttacgccaatgattgcatcagctcctaatgcttttgcacgttcggccatttccgcaagtgcttcttctcttgcgcccattagttcattttcataactttttgaacgaccgccaaagacgtttcgcaaaccagccccaaaatctttcaatacattgatcccagtaataacttcaccaaaaacgattcctttataagctactacggtttttccttccacactattcgtggttgttgtaatcattcaatcactcctctctttaacgaaagtataacaaagttcaagatgcgcaacacatattttcccaaaattaggaatttattatatacttgaattgttcattaatgaaagcgaaaccaatcgttagcaactatgtaaaagaaaggaagattcttgtgaaaaagagtattttgcttatttctcatagtcaaaaagtaacagatggtattaaagaaatgattgagcagatgcaaaaatcccaagaggtgcagatcttttctctcggcggaataaatggcgagatcggatcagacccgatgaaaatcgtagaagctgtcaatgaatcaagtgatgcagctagttattttgtttttgcggatatcggcagcgcggtattgaattcggaactggcaaaagacatgttggaagaagaacagcagcaacgttatcatctggtggatgcgcctttagtggaaggagcttttgcagcagccatcactgccggtataacggatgatactcagcaaatcttaacagaagcacaaaatgccggaaagaaaggatgggaataaattgaaaaaaatcatgaatgatccaagcaatattgtcgaagaaatgctggaaggattagtaaaaagctatccagaacttgttcatcgtgtagaatcttcccgtgttgtagccaagaatcagaaatcggaacaagttggtttggtttctggtggaggaagcggacatgaaccatcccatgccgggtttgtaggggaaggaatgttaagtgcagcggtgctcggtgatgtatttacttctccaactccagatcagattcaaacggctatcaaggaagcggatagtggcaaaggagttttactaatcgttaagaattatacaggggatgcattgaacttcgatatggcaaaggaactagctgctatggacgatattgaagtagaaagtgtaatcgtagatgatgatatcgccgttgaaaatagtacgtatactgctggaaaacgcggagtcgcaggtactgtccttgtacacaaaatcgtgggcgatgcagcaagaaacggtgcttccctagcagagttgaaagaattgggagaaaaggtcgtacaggcaactaaaacaatcggtgtagcgcttcgagcagcaactgtaccagaagtagggaaaccaggattcgaactaggagaagatgaaatcgagtacggtgttggtatccacggtgagccaggctatcgtcgagaaaagatgcagccttctaaagtactggcaaaggaacttgttactaagattttagatgattactcgaatttgccaaaagaagcaggtgtattcgtcaacggaatgggcgggacgcctttgatggaacagttcgtattcatgaatgatgttttagctctgctggaagaaagaggcgtcaatgtagttttccgaaaagtcggtaattttatgacctcactagatatgcaaggcctttctcttacgctgatcgacttgacggagacacaatggaaagattctttagaaagcaatgtacagacgatttcatggtaagacaatctcaagataaaagggtgataatatgaaactaaccgttcaagaaatccaagaatggctctcacaatttgcagaggcaatcaatcagaacaaacaatatctcagtgatctagataccccgattggcgatggagaccacggaaataatatgggaagaggggtttcagcttatgaagaagcttttcaaaccgatcatcctggaacaattagtgatacattcaaagtattctctatggcgatgatatcgaaagttggtggggcttctggtccgttatacggatctgcattcatgaacatgatgaaagcgacaaaaggggtcgattctattgattctcaagaaaaattaggagaagtgatcgagcagggaacagcgggtattcaaagccgaggaaaggcagaagctgacgataaaacgatgttagatgtttggctaccagttacagaggcgttgaaagcagggaatctaacaaaagaaattattgaccaggcaaaagaacacaccaaagacttggtagctaaaaaaggacgagcttcctatctaggagagcgtgcaatcggacatatcgacccgggagctgcttccagtgccattttatttacgtcactactcaatgtgatcaaaacttcatgaccattcctgtaaatggaaacagaggctgaactcgaaaagcaatcagttgctttttcgattcagcttttttacagttgtttcttttaaataacatagttaaaataaaaaagaaaagagggaacaaaatggatttaatgaaagaagactatcagttatttgacagagacaattatgcattcaaacaactcaaagaaatacatacaccagatgaagtcgaactaatcaaacaagaatacaaagcacactggcaaaaatggaaagagatccagctccagacagctgcacttttgcctgatacatatggcatgagcaaacctaaaatcgaaagctggacgaatggctggaatttacgcagtcatttttggagtgcttatcgacgtgaagatcggcaaaacgagaatgcctgtctagcagttttgttgaatcaaaaacaataccaaatctatttgatgtatcagcactataaaagtgacacgagagaaggaagcgttgaaggatacaatcaattgctatctttactgcaggaatggagtacccaggtagcgattgaagattattatatctggcctcagcctgaaaatgagctggaagatcatttgcctttatccgtttatttatcagataagagcaagcaagaagagctgcgagaaacaatgggcgatcgaaccttccaacttggcaaactgtttttttctccaaatgaatacacaaacatcgaagagaaaactgctgaggcactcaaagaactagcgccattgtatcacgcgataaaaaagaagttatgaaaaagctgatttgcgttgcgtactaaatagatggcatatcatcgaatccactgctctcatgatgcaacataaacagacacctgcgaaaaatcatttttttgcaggtgtctgtttggtttttccatcagtcaaatcagaataaaaatttaaacaaatctaaaaacataacagttaacaatctctaaaaaacaacaattacttgcgcctgtttattcttttgtatatgtgtttcgaattacataacagaaaaaatgaaaaaatattcattttgttatcaaacaaggaaaagtaagaaaaaggcttcttttttcactgataagcctatggtaaaatccgtttaaagcgttttctttgtgaagagaagtaagaaggagcaagtatgaaaaaaatcattttcagaggagtcatagtcatcatcgcactaagtataggagggaaaatattgatggatagaagagaaaaagacaacgaagaactgcgtaccatccaaaccgatctggcaaattatttgtataatcattatgagatttcaacagtagatgaaaagcgagaaaaggaaatcttcaaagaatttaatcaaggtaaaggagacatgactgaacaggaattttttgaaagattagattctataactgagtatattgatattgagaaaatagaatttacaggtttctctgtaacccctatgaaatctttagaggtacacttcgaaatcaatgacctgctctcccacactgcgacattaggagtaaagtctgcagaaacaggtcagtggatctataggattgatagtggtatagaaaaaccggggcaagatcattatctcagtagaaaagaccaagagaccaataggagcatacccatgaatatcgtcacattctatgatggggggatcgactgatggatcagaatcaagttttttcagaaacagtttatcaagtagaagtaggaaaaattaaaaatggtgatagaacggggaaacgtaatgaatatttaattcttgatacggtaaacaccgacaaacatacaatcggaaaagaaaaaacaccaaagaaaaacggtatgcaggccatggtcgtggctgaaatcaaagatgaatataaaagtaagaagcaagatcaattacagcaaatttccggctaccccaaatccgtcatcaaaaaagacctgactatcgcctacgcaggtaccaaaagttggcaggactggaaaacgaacatccgagaagtcggctttgaggacaaacacgacaacggcgccttccagtcggctttagcgtatgccgatgcaatcgaaaagacctattctgtcaaagacggctacaccatttccacgaccggtcattccttaggtggagcgcaggcaatctatgtcgctgttttaaaaggctatcacggatttacatatgcagcggcaggcccaggcctgagtgagaaacagctcaataattatgaagggcagatcatcaatctgtatgacacttcagacatcgtgactagtggctggctgactggtgggaaaggccaactgccatttcacagtttcggaatcgacaacatcggctggaaaaactatggacacgatctaaatcagttcaatctcgacaaaaacgggaattacatcgataaatatggcgatatcgtcatctattccgaccaacatggaggggtcgccctcgaacagaccttactcgcccagcaaatcatcaaaaacaaagctatgatccgtcaaatggagacatatggcgaaaaaaatcaatgggagaaagatcggatcagtcaactgaaagaagaaaacaagtggctccagctacaaatcagtgctttctccaagctagtgacttggcggaaaagattcacagctagcagcggcggtctgtcgaccaatgaacagatctatttagacgaccagcaggcgctgatgatcgtgaaacatgcggcttccgtcttcaatcaagcgatggaacaagtgctagtcatttaccagcgtggaattcgtgatttggaacagctgtgggcagatggtcttgcgatggtccgcagacagacaccgcttttgtctcagaacgaaatgctcgatgctctgcgagaagtcggttgtacaaagcagacgatcgttgatgaacctacgcaggaattcagggaaaaaatcttcaaaatcaagcagctttcagcagaattctctaccttggcaaaagagatcgaagcgaaaatcaatgagctggtccaacgtgatcgagacttggcacgacaattattttaaaacaaggagtagtgagatggaaaaagaaaaccagattcatgaaacataccgaaaagaacgactgcagctagaaaatcaggaagatcagctcagacagatgcaaaagaacatgcagcagctggcagaaacgacttattccaatatacgtttttcggtgtgttcctttgaatgcccgaaggattctttgtattttgcacaaaaagaactcagacgtttagaagagaggttctctcatgaattgatgcagaaacgaaaaaaaatctatgatcagcaagatgaagtcgaacgccgttatcgtgctgatctgcaacgattaaacaaaaagtaacaagaaaggagataataagtgatcattctagaggaaaaaatttgggaagattaccagaaagagatacaaaaaatctcagcaagagctttagggattgcgatgactcaagacaaagtcacgaaatgcaaaaaggcgaaacaagccgcagaggtggaagcaagtacggcaaaaaaagcggtatcctctgcaacgactggattggaaaaagcagtaaagggtcgtttcggcaaacaagtaacagcggcatttagtaaaaaaagccgaatgttagtaagtttttgaacactgtgaatctcggaggttgtgaacttgccgtttaaccctgagtcacaaggaacaatttcaaaaaacagcttctcatgtttgatgaatatcgtgacttgtatccgagaagttggcaggagaacaccatttattcaaaaaataggagttgcgacaaggcgtttgtcacagctcctatttgacataagaggcaattttcaattttacttatagatagtatcaaaaaatgattttaaggcataaaacactcaccgccattattaccgagagtctgatcctagtggccgaggtggcaaacggtatgcttttccatgaaatgagtattctgatcgtggtcataaacggcatgtgtctgcttacttatcgcacaaaaagaaaaatcttgatacaacaattacccaagttaaacgaacaagtagaataacaaacaaggaagaaatccaaaggaggaatctgctatgagacatgaaggattgtgtgtttcactcgttccattattcaatcatctcgagatagaagatcagcaaaaaatccactcgttagtgacacacagaaaagtggaaaaaggagaacagcttcttgcgccgaatggagagtctcaattagtaatcgtggcttctggaagtatgaaagtgtatcaattatctgctagcggaaaggaacagcttttacgagtagtagagccgggcggatatgagggagagagccagttgttaggcgttccaaatgaatctttatttggcgaagcactagaaaaaacggaaatttgcgtattgagacaaaaagatttctcggaacttttactgcattatcccgcccttagtctgaaacttttagcaatcaacgctgagaaattaacaaaagtacagcagcagacaacttttttgatgatggaaaaagtagaagaacgagtcgctgtctatctgcttgacttagctaaagcgacagggaaggatcactttttcctaccaatgaaaatgaaagaacttgctgcatttatcggtacgacccccgaaactttatctagaaaatttaaattattagaggagaatggttatgtaaaaagagagaatcgggaagtctggatcattgataaagaacagttagaagacatgtaaatacaaaaatgacctccaaatgttggatttttgatcccaatttggaggctagcatgaaattgaacatgctctttttttgttatccttccactaaatctcttctcctataaccgatagcaccaaggacgatcagtgcaaggctgatacaggataatgtaaggaatacggaaagatcgaaagaatcgtttggcatccgtggtacccagctagggaccgctgttttggagaaccattctggtaaatccaaaatcccgccaaagtaattgagcgcaaaggagtaagctaagtagatataagcaaatttacccattcgaggaagccatccgaatagaaagccactcattccgataaacactaaaacagcaggcagaaagttgaatccggctttaagaaacagcaatagatccatatctttcgcatccttcatcgatgccaaagcagaaagtcctagcgcaccagaactaatcagaatcgacaatatagaaaacaggatcgctagtaacagatttgtccaataaagttggttcctagaaatttttgttgcgaacagctgattcatacgtccgtgggtttcttctgtaaataaacgattgatgctagcaattggtaaaatagcagctagacaaatcaagacgaccatgatcgtgcttgtaaagtttttttcaattgagacgccagattggataaacatctgtttcattaagtcgttactttctaaaaactgttgcatattcccgtagatagagccgtatgccgcccccatcaaaccaaaagtgataagccaactgatggtcattcctttatttagatagaataataaaccacgcaaggatagaagagaacgtttagcatacggttttccttcacgttcggggatatagccggtgttcaagtctcgatgttcctctaaaacaaatgaactgattatcaagatgagactgaacaaaaacaaataaagcaaaggaatccagttattagttgtaaatggataggacaaataagaccagcctaaaggattccacatcgaaagggaggaatcagctacatctgttattgctcttagaaggtaaagtccacctaaaaacgctagagacagaccattcgaactggctgcacttggcatcagttgtgaagcaaacagtgcaacggcactccccaaaatccccgtactacctacagatagcccaaaaagccaagcaccttctgcagtgatcgaatctgcttgaaaaaaaatcatcgtacagctgatcgatattgctaaaagcaaattaatcagaatactttcagcgatgacagctaaagagtttgcttgacgtccgactcgaaaggaacgaataagttcaatcagaccaagctcctctttttttctcgtttggctcaccacatgcaaaacagagatcacagcagcaaacaaactgcaaaaaagcaacatttcatttgcatacatcgctcctaaagtatactcagcagcattcgaagcgggagttggtccgaccattgctatcattgccgggttttgcattgtttcgtataatccagctaacccttgtcctgaagtcaattcttcaaacgcagggacaaaaccaccagaaaaagcagtgacaccgactagccatatcaagatctttttccagtcacggctaaggttttgagaaaaaagggtagaccagcgtgaaaatttatcagtcatttcgattcctcctcatccttcatagtgcctcatgaataaatcttcaagagtcggtggaatagattcaaattttttcacacctaatttggaagtttcagctaaaatcacatcgaaagcttcgttgtcagcagcaaattgagcaaggtggcctttttgcacaaaatcatggacaccgttcaattgtgctaagtggctgttatctgcttctgtttctatagtaatggtcgagcgggtcaaatgacgcaattcatcgagtgttccttcttctacgactgttccctcgcggatgatcacgactttatctgccagccgttcgacttcactgagaatatgagaagaaagcaggatggatttgccctgttctttcagtttttcaacttcttcttgaaaaatggtttccatcaagggatctaaaccagaagtaggctcatcaaataaatagagatccgaatcaacagctaaagcagcaatcaagcccactttttgacgatttccttttgaatagttttttgcttttttcttaggatcaagagagaaacgttgaatcagttcgtcctttttttgagcattcccttttccatgaagcttcatgaagagatcgatgatcgctcctccagtcaaatttccccataaagagatgtcacctggaacataagaaagacgttcatggatagataaactatcttctcatacatcttgaccaaaaatcgttgccgttccgccgtctttttttataatccctaaaagtgtccgaatcgtcgtggattttccagaaccatttggtccgataaatccaacgacttcacctgaatgtacggtgaaagagacgtcttttaaagcttcgaaacgaccaaagctctttttcaaatgtgtgactttgacgatttctgccataaaaaccccactcctttttctgaaaatatagactaaaaaagattaatcagtttaataaaatggttttatacctttttataaaacttttttttatattttagtacataatattctttttataaatttctgtcaatgaattcataaacaaggaattgctagcttgatactttctcaatagatagttataataaacctcagaataaatttgaactatatatattataaaagtttaaaattacgggaggctctataaatgaacggttttgaaaagagagcacaagagaaaaagaaagagattttacaagcagcttttgacttgatgaacacagacataggaaccgctggagtgacgatggataaggtagctgagagcgctcaggtaagtaaagcgacgatttttaaatattttggcagcaaggaagggctgatttatgaagtatttttcacatttatgaatgatttagggcaagaagcgaaagcgttgattgcggaaaatcttccatttgaagaaacgctgattgctatgagtgaaaataaaatccgctatctcaatcgagtgaacaaacaattttatatcgatttgatgacatactatacaaaaaaagaaaaaaaagaattttctgacgcgatggatgcgtatacgcaagaaagtttcagtatcatgcttgatcttttccaccgaggacgtaaagaaggaaaagtggatttgaaatattcggatgagtttttgatcctctattttcaagcaatggtagaaggaatttctaagccggagatatacgcaaaactgcttccatatacagcagaatggacagaagtcctgatcaaaggtatcgcgccgaagaagaaataaagcataaaaaaagccgaaactgacgataaaatgtcagttcggctttttttgtttataaatgatgtaaaatcaagcggattcgcgtgcttctttgtcgtagacctcatgaacattgatgaatggatcaagaatagggttttgtccgtctaaatctgattggaaccgaatgccatcaatattgattcgagcatttcgatagaaatccgtacctaattgtccccaagcgggagtagaagcatctacattgcagaaaatatcgaaaccttgactcttcaagtaagcaaatttttgattttctgctgaataaggctgccagtcgctaatatctgcaccaaatggataaatcaggatatttgtttttcctaggataggtgcaacttcttgctgccataattcattgtcttttttgacatcctctaatgaagcttgagtcatattcaagtgtccccaggtatgggaagcaaagctccaaccatctttcttcaactgatcagccacttttttagcttcttcgctctctttttttgttttttcgttatctccgtattgagacttggatgttcgataacctaaaacaccgttgtaacctgtcagggccaaggtgccttttgcgcctcgataagaaaaatcaggatgtttcttgacaaaagcatcgatcagaggaaccatgtcaaagtccccaatttcttccttatcattctctttataaacatttttgatttcattgttatttgatacgactaatcggctaggaaaaccggaattatccatatattcataatagctgacatcatcttgtgaaagaattaatggtttttttccttcaggtagcgcaagcccgttaaaggaaagattcccttgttcgtctttttggatcaaatcattcaaattgactaaaacaaaatcattttgatagagttgttcgattgaacggttgaattcttcaacagttaccatatagtctttgtatccttgagcctgttgagagtggaaggctttttgtgggtccacgatcaagctgtgaaaaaagacgtgagagatctgagtaggatcagaccagtcaattagttgttctttctcctttttcagtgtttgaagaagctgctgtgtttccggagatccgtttttactgtttttctccaataaagcaatcgcttggtcataatcatagctttgtgccagattttttgcttgagtcactagctgttgcttatcatccattggctcttttgtcttttctgttatttttttttcaggaataatcggttctttttttgtgtatgctcggatgacaaaaaaaagacttaaaattaaaataacgacagttaaagcagaagtggctcctaaaataattttttgcttttttttcatatacctcgtcccttactttttcatttttttactcgtaccgttgttcattgtaacgaagaaagaataagaggaaaagtaaagtgacttctcgataaattgcagaaaaaatacagaaaaaatagtttcttttaacaatagttgaaaataaaatgttcgggattagagcggattcaaaaaagaaaaaatgaggaatttaaaaaaaatattctttttctgttgacaaagaaaaagttgcgctctatgatagacacatattaataataacaagacgaagattgaaacgaagtagttgttaaagccaatgtttcagaaagctggtggttgctgcaaaccagtacatgctttaaagcgaattacatttcaggagtctctggcagtgattgccacgcgacagcgttaaatgttcgagaggtatgttggatatctagacatacaaattgggtggtaccgcgagatttcgtcccttggctatatgccaagggactttttttattttccatcccgaagaaatacttaatgacgcatgctagcaggttcctgctttcataaaaaaactacacggaggtcagtaaaatgaatattattgatgaattaacttggcgcgacgccattaatcagcaaacaaacgaagaaagacttcgcgagctcgttgaagaaaagagcatttcactttattgcggcgttgatccaactggtgattcgatgcatatcggacatttgatcccatttatgatgatgaaaagattccaattggcaggccatcatccatatattctgattggcggcggaacaggaacaatcggcgacccaagcggccgtaaaacagaacgtgtgttgcaaacgatggaacaagtacaacataacgtggatgcactttccaatcaaatgagaaaattgtttggtaaagacgcaaatatcacatttgtgaacaactacgactggttatcaaaaatctctttacttgaatttttgagagactacggtaaaaacttcaacatcaacacgatgttagcaaaagatatcgttgccagccgtttggaagtagggatctcattcacagaattcacttaccaaatcctgcaatccatcgactttttacatctgcataaaacatacgatgtacaactacaaatcggtggagcagaccaatggggaaatatcacagctggtttagacttgatccgaaaattagaaggaccagaagcagaagcgttcggtttaacgattccattgatgttgaaagcggacggaacgaaattcggaaaaaccgcaggcggtgccatttggcttgatcctaagaaaacttcaccatttgaattctaccaattctggttgaatcaagatgatcgtgatgtagtgaaatacttgaaattctttacgttcttatctcaagaagaaattgaagaattagcgaaaaaagtagagacagaacctgagaaacgtgaagcacaacgccgtttggcagaagaagttacaagatttgtgcatagtgaagaagacttgaaagaagcgcaaaaaataacgcaagcattgttctctggaaatattaaagaactaaatgcggaagaaatcgcgcaaggattcggtaaaatgccgaacgttgaaatttcaagcacacctgaaaatatcgtggagctacttgtttccacaaaaattgaaccatctaaacgtcaggcacgggaagatgtttcaaacggagctataagtattaacggtgaccgcgttaccgatttaaattttgtcataaatccatccgatgaattcgatggtaagtttgtggttattcgaaaaggtaagaaaaattactttttggccaaagtaattgattagaatttagtaagtttttgccttgaaaaaggggaatactattacaacattccaattttgaaacccatcctaaaatagaacgctggttgtcgttaatacaatctttgcgagggagtttacttttgtaaattccctcgttttttttaattatttcaaaagtgcgaacaattcgaataattgatacatattaaaatacgattaaaaaacggtcggaagcttagtttacagaataggagaacaggtgtaatgtagggctcgacaaaatttaaatattttttttaggagggtttcactatgagtgaatcattgtcgaaagatctaaacctaaatgccctattcattggggacaaagctgagaacggccaaatctataaagctttgttgaatgaattggtggacgaacatttaggctggcgtcaaaactacatgcctcaagacatgcctatcattacgccagaagaaaaaagcagtgctagttttgaacacactgtgaataaaacaaaagatgttctatcagaaatttcagcgcggatgcgtacccattccgttccttggcataatgccggacgctactggggtcatatgaactctgaaacattgatgccatctttactagcgtacaattttgctatgctatggaatggtaataacgttgcttacgaatcttctcctgcaacaagccaaatggaagaagaagtaggcatggaatttgcaaaattaatgagctataaagatggctggggacacatcgttgctgatggttctttagcaaacttagaaggactttggtatgcccgcaacatcaaatcattgccacttgctatgaaagaagtgacacctgaactagttgctggaaaaagcgattgggaattgatgaacttgtcaacagaagaaatcatgaacttgttagacagtgttccagaaaaaatcgacgaaatcaaagctcactcagcacgtagcggaaaacatttagaaaaattaggaaaatggttggttccacaaacaaaacactattcatggctaaaagctgccgacatcatcggtatcggtttagaccaagtaattccagtgccagttgaccataactaccgcatggacatcaacgaacttgaaaaaatcgttcgtggtctagcagctgaaaaaacaccaatcttaggtgtagtcggtgttgtaggatcaacagaagaaggagcaatcgacggtatcgataaaatcgttgcattgcgtcgcgtattagaaaaagacggtatttacttctacttgcatgtagatgctgcttatggcggatacggtcgtgcgattttcttagacgaagacaacaacttcattccattcgaagatttaaaagatgttcattacaaatacaacgtctttacagaaaacaaagattatatcttagaagaagtacacagtgcatataaagcaatcgaagaagcagaatctgtaacgatcgacccacataaaatgggctatgttccatattctgccggtggtatcgtcatcaaagatatccgcatgagagacgttatctcttacttcgcaacatatgtatttgaaaaaggtgcagatatcccagcattacttggagcgtatatcttggaaggttcaaaagcaggggcaacagcagccagcgtttgggcagcacaccatgtcttacctttgaatgtcacaggatacggtaaattgatgggtgcatcaatcgaaggggcacaccgtttctacaacttcttgaatgacttgtcattcaaagtaggtgacaaagaaatcgaagttcatccattaacttatccagatttcaacatggtagactacgtattcaaagaaaaaggcaacgacgatttagttgcgatgaataaattgaaccatgacgtatatgattattcttcatacgtgaaaggaagcatttacggtaatgaattcttaacttcacatactgactttgctatcccagactatggcaacagcccattgcaattcgtgaaccaactaggattctcagatgaagaatggaaccgtgccggaaaagtaactgtattgcgtgccagcgtaatgacaccatacatgaacaaagaagaacactttgaagaatatgctgaaaaaatcaaagcagctcttcaagaaaaattggaaaaaatctacgcagaccaattattggcaagcgaagcaaaataagcaaggtaatcatgttagaaaacagcttgaatgctaactgtttctgacgcatgtttggatctgaagagcaaggggtgacctaagctcttcgatccctttgttttgaggttgtctttgaagaactccttcaagcaatagactcaaagaatcccctcaaatattcgctgaattgtttcgtttattgctgaaactacttcaaagacaccgttattttatccaaaaaatcaaggagagtgtcaacggtgagtaaatctgaagtaagtaaaatgggtcttgggacctttatcggtctgacaatggcactgtgtgcaacggttcggagtattcctacgttagccgcagtcggttggacattgattttttattcaatttttgcagttttgttttttgccggtccgatatcaatggtttccggtgaactttcaacgatgcttcctcaagaaggcggtcctcagttatgggtaaaaacagcactgggcagcaaatggggatttgtcgttgcatggctattatgggtgcaaatgttcccaggtatggtaatggtcgcttctactttaggaccattgttaggaaacacatttggtaatgtagaacttggcaataatcattggttcgttttaggttgtattttagttatttactggatcatcacgatcttgaacttgaaattcgatatggcaaaagtcggcgggaacatcggtgtatggctaggggtatatatcccagtagtcatcatgttcgttttaggtgttttggcagccttcaaagtcggactagtctcaaacggctatctaggtgacttttcatggtcaaaagctttccctgacttggaacatattgattcattgaaatacttagctggtatcacatttatttttgttgggatcgaaatgagttctgtttacatgcctcgtttgaaagacgcaacaaaaaattatacaaaaggcgtatttatcgctttgatcggattagttttattgaatgtcatcaatgcgatgcttgttgccaatgtcgtaccagatggaaaaatggaattagcaaatatcacgcagccaatcttgattgattgccaaatcctaggcttaccagaagtgatcggaaatatcttcagcttcatggtatttattggtgtgcttttacaattatcagcttgggttactggaccatcaaaaacaatcatccaagtagctcgtgaaggattccttccaccaaaattcggattccataaagaaaacaaatacggcgtatctagaaatgtcgttctaacacaatcaatcgttatttcattatttgctttgctttatggtgtaatggatgacgtaagtgctgtattcttgacacttacaaatgctacaactgttatttattgtatcgtgtacattttgattgctgtttcattgcttaaaatgcgtaagaaacatccagaattcgaacgcccttaccgaattggtaaaaacggaaacggcttagcttgggtagtcagctgcatgctgatcttctctatcatcgttgtcgtatttgctacattaggtacagcgacattgagtgatgcattattagtagcagctatcacagtggtcatgttcgttattccattgatcatcaatcacttcaagaaagattcttgggggattgaggtagaaaaaagtttagaagaaaaataaaaaaataagtctttcagccgacgatctgtcgctgatttagtaggaggtcctgccaagtgaatagttttttcatggcagggccttttcatttgaaataggagatcgacgatgaataaaaatatttctttaaaagaaagtatcgctgtattgatcgtgttgttggcactcctaggagtactgatcatcggattccaactctcgccacatatcccgatccttgcagctttcatgtgcttgttgttttatggcagatttaaaaagttctcatgggatgagatccatgacgggatcgtcaaaggaatcactccggggatcatcccaatcctgatttttcttttgattggcgtcttggttgcctcttggattctatctggaaccatccctacgatcatggtttatggtttcaaacttgtctctgtacgtttctttttgccgacagcatttcttgtttgtgcaattgtcggagtgacagtcggcagttcatttacaacgatttcgacgattgggattgcttttttgggaatcggacatttgcttggattcaacgatgcaatgactacaggtgcggtcgtttctggtgcatttttagggaataactgctcgcctttatcggatacgacgaacttggcagctggtatcggtggagtcaatctattcgaacatatcgctggtatgcgttatacggattttccggcattcgtcctttcgttgcttttttatacgatattaggacagaacagtcattcagccgacctagccagtatcaatgaaatgatccaaaatatgaaagcaagcttttggatctctccttggacattgattccgttagttattttatttggcggggcaatcaaaaaaattccagctatccctacattattagcaggatcggcagccgccctcgttctttcctttatccatgagaaaagtttgacaattggaaaagcagcagacatcttgatgaatggttatgtcgcgcatacacctgatcctaagctagatgaactgctttctcgaggcggtatcatgagtatgttgggctcagccagtttgattttactggcattggcattaggtggtttattgatcaaatatttgattgttgagaccatcgtgcaagaattaaaagaaaagatggatcgaccttctcgtttagtcgggtttactgccttgagttgtatcggagtcaatctgatcgttggagagcagtacttgtccatcattcttccaggagaaacattcaaacgctcctttgatgaggttggcttatcaaaaaactatttgacacggacgctagcagattcaggagcaaccgtcaattctcttgtaccgtggggagttagcggcacattcattatggggacgatgaaagttagcgcgttgcattacttgccattcgcttttttctcgatccttgctcctgtctttacaataataggcggttttttattgaatcgccgacatgtgaaaaattgaagaaaagatcaaaaggttgtgactatttttgtcacagccttttttgcgaaactagcgatttatacgattgaaaactatcttttcttcaaaaagaaataataggaatagaagctttgatagttgcgataaaataaaaatggatagataaaattcgagagaaacatgtattgacgtagcagatgaaaggggtagatttgttagtgtatcaggagtgccgttagaagaacaaaaggagagagaagatggaactattagaaaaagaaagtattgatttttatttggagcgtgcttggactgtgttacggtatgcttttttcaaggaagaagagtatgacggactaaatagtcatcaggaggcagttttagaatttctcaattactcaagcagattgtgtgctgggtggtcatggcgaatcaaagaagggcttatagtttctaaaaaaatatatgcacaaaaactttacgaattcagagaagaaaaaatcaactatacggatatccgattttttgacaagatgaaagagtaccctatttatgtaaataaagaaatgatgaaggcgaaaagaatcacgcctggatcattctgggctgaggatagtatctatcgggcttcttttcttgaagcaactcaaggagcagagggaacggaggaagaatttaaccagttgaatgatcgtcttttcccagataaagatcatctgcatatttacctttggaacaatgaatttacgaattattataatgaaggtcgttattgggatggcgcttatgtgtggtcagtgtatgacgaaaaaagaaagcgatttactgttttcgatgctagtttagtgatgatttgattttttgcatatagtgaactggaaaaggagagaaaagatggaattattagaaaaagaaacaagaagattcggttatcagacaagtctatttacatattttgcattttttaaagaaaatcgcagtcaagggttaaaaagtcatcaagaagctataataggttaccttacttactgcaatcgtctgtgggaatgtagtatatggtctttagatatttttgtaagaacaggtaaaaatgtttcttcagaaaaatatgaagaaaaatttcaacaaacaagaaacaatcctattgtttatacggatctaagctcgtttgataatgtacaagggtggcctatccgtgtaaatacttcactaatgaaggcaaaaaaaatcgaacccaaaaatttttttgtacaggatggaaattatgaaacggcttttcttgaccatgaagcagttattcctaaaacacgagctgaatttatacaaatcaataatcaattgtttcctgaaaagaaacagctagagatttattgttgggatactacttttacgaattattatgatgaaggacgacggtggtggggagcttatttatggtcgatttatgatatgaaaagaaaccgttttacagttgttagtatcaacttagtcaaccaagcgtgatactagaggaaccgtttgcgattcctctagtattgttctgtgcaaatcaggagagtagaaatgatataatacttacgttttttaatactgtgtggtgttctttggatatttatttccctgtaatgaatcgtgtcgaattgagaatgaatttacgaattattataataatggtcgttattgggatggcgtttatgtgtggttagtgtatgacgaaaagagaaagcggtttactgttttcgatgctaggttagtgatgatttgattttttgcatatagtgatgaactggaaaaaggagagagaagatggaactattagaaaaagaaagtattgatttttatttggaacgtaatcgaatcccattcacttatgcttttttcaaggaagaagaatatgacgggctaaatagtcatcaggaggcagttttagaatttcttaattgctcaagcagactacaagcttgctggttatggcgaatcggtgattctattgaaaaaggaacgatggtttctaaaaaaacatacgcacaaaaattttatgaattcagagaagaaaaaatcaactatacggatatccgattttttgacaagatgaaagattatcctatttatgtgaataaagaaatgatgaaggcgaaaagagtcacccctaaagcattatgggatgaggatggtatctatcggacttcttttcttaatgcgcctcaaggagcggcaggaacggaagaagaatttaaccagttgaatgatcgtcttttcccagataaagatcatctgcatatttacctttggaataatgaatttacgaattattataataatggtcgttattgggatggtgcttatgtgtggtcagtgtatgacgaaaagagaaagcgattcactgtttttgatgctagtttagtgatgatttgattttttcaggctaaaaataaataaaaattttgaagaggaaggagccgcccttggcggctcctcttttacagttcttcgtaagtcaggataagcagttaggatataatactttcgttttttccatacgatgttgggcattctttggataaccactttggcgtaatagatcgagtcgtattgaatataagtatcatgatttaatctataaaatccccaccctaatgtctttccaagagcaatcgatttatacgatcgatagattacacgattaccatcttgtaaagaacaatcacctagaggtaatttgatcgtaccctctaagtattttttattggcagtatagatcgcgcagttgataaatatcaaagcttgttccgtagtatggaaggcagcggaataggttatttcttttaatcggtctcgtagtgcatccgcagtttgtcccacatgtcgttccatcgtatgccctttcccgccgtctgcataccattcatcatagtacaaatcaagaggggaataccattcgaattcatcgtcatcatcgtcatcccctttgaagtttttgattgcttcaaggacgcgggcaagactcaacgcattccatgcagcgcccattgcgccttcgactaatgttttatctgtaccatcttctacgatgtctccagtttcttcatctaatacacctcttcgcccatcgatcgtgatcgagtcatctattgggatggctgcttcactgtaagcaaaatcgatcgccccccactggtattctggaacggctacgcgagtgtcagcgtacacgaactttcctgttgcatcaaggacaaccgtttgtccgtataaggtagcgattataccagaaggatcgaagctcaatccgttttcagtcggtgccaagacttccgctaagttcttttgtatatcggcagtgcgtgtatgataggcttgcgccatttgctgagccgtctggacagcgacttctcttgagggtgtttcgatcaccccaaattcaaaagtggtgttttgctggatgtattccagaaagtcttcttgagtcgcgatctggctcatcaagacagacatcgggacacttaattcgacttcatggacaaaggaaccgtgactaccccgatggccataattatgaccggagatcgttagtaatgttgtatcactgccgactcgagtttccatgacacgaaccatttccagtaagaagaattgatcttcgatgaacattcgatcagctaccgaggcatcacgtccgattacgccagttcgagcgctttcagtaaaaagagaaccataagagatcagtttacgaaaagccggatggttattgatcgaaaagcgataagcaccatgatccgttgttcctgtcaaatattcctgcatcaatgcatgactggtcacatcttgcgcgtatcttttttgcagaccttgcgagaaattataggtactagtagtagaatcaattcccgaagtggcaaaagcggccaattcttgttgcagggcaggattattggaagataattcatacaagctcgcattcgttttgagtaagtctgcagtggcgacgcctaaggaggaacctaattggtaaaaactataaccaagtcctgctcctaggatagcagaaactactgcaacagaagcagggagggaaaccaatgtagaacttaatgtagcaccaacagcagaaaaaggagagaggaaagaggagaaactgacgccaccggttaaaggaaccaatgctgcgttgtgcggatctggttcttgggtagtgacagggatacgagagatagacgggagttcaggaacaacttcggtcgtcgcatgttgttctgctttaatcgtatacgtttcttgggcgtgcgtttggacaggcgtggcagcaaatggcagaagtgtcaacacaacaaaaaacaaatgagtgagttttttcatgttttctcctttcaagaacacgtgcggctgatcgacaagggggtcttttgcacctccgttcattcgtattcgcttacacatttaattattcttgaaaaaacaaaagaatacaaggcgtaatagaaaaatcaatttaaaaaaatgttttttacattattggtgtttccttcgtgtattctcatggaagacagtagttatgtcaaataatcgtttgttttggatgcataatcgttcacacaactgataaagaaaaagaaggggtagatttatttattttaatattaatgttatttaatatttgcttttaaaacttataaaaataacatattttatgtaaaaaactgaccataggataaatggtcagcaaattcagtgatttaactaagtttcgtgctttctaaaggaacaactgtctctcttttgatcaagcgatgagggatgaccaagcgtacgccgctacttaattcttcatggatcagttcacgtagtttttgcatagcgacacgtcctaattcggagatatcgatatcgatgcttgtaaggtaaggatgtgtcaatgttgagaagatcgagttgttgaagctaatgacggaaagtgtctctggaatgacataaccatacatttgtgccaactgcatcgtgcgaagggcgaagatatcgtcaatgactaccaatgctgtggcttcgttttctttcaacgttttctcaaaggtcagataatcttctgtatgttccagtactacactggaaaacgcaggaaaatcagccatcatcatcgctttttgataaccgaaatatcgttcgaaatacaaactctcatgagtcgtattcgtcacgaataggatattcttatgtccgttctgaatcaaaaattctgttgcttgtttgcctagaagttggttgtcattatctacataaacgatttcgttttcgtgatgataaggctgtccgatcaaagtgaaagggatatggttttggtataaataatcaatgacagggtcttgactatctgaatacactagaataaaaccatctacttgtttttgtagatgcatacgctggacgttctctaacagtaaatcaaaatttttagcagtagcaatcgctgtcgtcatatcataattccgcgcttcttcattgattgcttccatgatctcaagataaaagggattcccgatccgctcttttgaatcaagagggggtaagatcacgccgatggcactggaaatgcgtcttcctagattgcgggcagtcatgttaggaacataacctagttcatccatgatttttcggactttcttctttgttgcttcggaaatactaggatgatcattgataacacgagagacggtcgaggtagcaacaccggcttttttcgccacatcttttacggtaatagccatgataaaaacacctttctcttgttattgtgcagagaaccgataaatcgtctgactgatccgttcttgaccaggatggaggttgatcgatccaaagttggggaaatgaacgatatcagggatttcttgcggttcgattgctaatccgtagtttgaatgcatctgttttccgttgacagagaaatcagcttcaaatccagtcgtagaaaataataccatacttttattggaagttgctatagtcatttgacgaccagaatgcttctcgaataattgtaaggaagttctggaaagcctaggatgatgcaaaagaaatacatcatctagtccagctggataacaagcaaggatttcttgcagtgttggagattttctaaagtcgatgggcaggtcttcttttttcgtccaatttccagtaggtagtttttcttgatctaattcaagtataccatctaagaagactgttaactgatggtcatagatgtctctttttccatttcctgaaaggttgaagtaggcatgattggtcggattgcagatggtttcgaccaggctactggcagaggtcgtcatctctaactcgttttttgtcaaacggtaagtgatcgtagcagtgattggtcctggataggtagaaaattcatcttttaagtaaaagaccacgcctattgatgaaggagttttgaaaacttctacttcccaatactggaaagaccagcctttcgtgccaccgtggatatggtgtggtccgcagtttttttccaatctatgctcaccccaagaagcatctcggatccttccagctacaggtccgacagttgcgccaaaaaagcttttatctgttagaacatcttcgaaacgatcgtaagacaataaaatattttctgattttccttctttgtctggcgcgaagatttgatgcaggcgggcaccatagttgagaagaacgacttctaaatagtcgttcttcaacgtgattttctttatttcagtctctggaactggtacgacggagatttctggattatccatggtcatgccacttttctttcaagtaatcgatcgtaagaaaagtcgtatcagggacaagcgggatctcctctccaaggtcttcagcacgtcccacgccaattggttgggcaccacttgagaggatggcttggataccagcttgcgcgtcttcgatcccgatacattcttctgcttttagtccgacagcttttgctgcaaggagaaagatatctggcgcaggttttccgtttgctgcttctgccgggtcggcaatagcgtcaaagtaaggtgtgagacccattttttcaagtaggaaaggcccatttttacttgcagaagcaagagcgatcttgattttttcttcttttaaagaatctagtaaagggacgaccccagggaagacatcttttggttcgatcgtctggatcatctctaaataataatcattttttctttttgctaattctgcaaattcttcctttgaaaaagagtgttcttttccgccataagctaaaagcaaagagagagagtcttctcggctaacgccttttagctgttcgttgaatgtgcggtcgatcgtaatgccgatttcctgaccaagctttcgccaagcacgataatggaattcggcagtatcggtaatgacgccgtctaaatcgaacaatacccctttaaacatttgcttcctcctttcttagcgttatttctaggcgatcttctaaagtgtaagactgttcatagacgaaaagttccagaggcataccttctaataactcgaaagtaacttgttcatctgtaactgagatgaataataaacgtccgcgataattgatatggaaagaataagcattccaggtttttggcagaaatggtgcgaatttcaattgatcatgggcggttttcatttgtgcaaatccttggacgatcgacaaccagctaccagtcatggaagtgatgtgcaagccgtcttctgtgtcgttattgtaattatccaaatccaagcgagctgttcgttggtacatttctacagctttgttttccattcctaattctgctgctaaaatcgaatggatacttggggaaagggaagactcatggacagtcattggttcatagaaatcaaagtttttttgtttttcttcttttgtaaaagtatcgttgaagaaataaatcccctgtaatacatctgcctgcttgatgaagcaagatctaaggattttgtcccaagaccaatgctggttcaaaggaagatcgcttgtgggaatatcggatacaggcatgagatctttatctaagaatgtgtcatgctggacaaagatccccaattcttcgtccactgggaagtacatgttctctgcgatatctttccatttggctagttcttcttcgctgatagtgatagcagcttctttttgataagttaaataattttctcgcgtgtaacgcaagacccaagctgcgatcgtatttgtataccaattgttattgatgttgttttcatattcatttggtccagtcactccgtggatcatgtatttatttgctcgttttgaaaaatggacacggtctgcccagaagcgggcgatttctgctaaaacttctagaccttcatttttcaaatattctgtatcaccggtgtaattcgtgtaattgtagattgcataggcgattgcaccatttcggtgaatctcctcgaaagtgatttcccactcgttatgacattcgacgccagtgaaggtgaccataggataaagcgcgccttttaatccttgctgctgagcgttgtggatcgcttgcggcagctggttatgccggtatttcagaagattcttagttacttcgggtttggctaaagcgagataaagagggactgcatacgcttctgtatcccagtaagtggcaccgccgtatttttctcctgtgaatcctttgggtccaatattcaatcgttcatcttcgccgtagtaagtagagaatagttggaacaaattgaagcgaataccttgctgtgcttcttcgtctccttcgatgaccacatcggcaagcttccatcgttctgcccaagccgctgtttgttcttcttttgcttggatataattgtttgtctgatttgctaattctgagagggctttttctgcttgctgcgcttctgggatatctcgactagtaagaacgatgatttctttctctactgtccatgtctcgccttgagataattcagcagacaggcaaccatgtaaggctaaagtatcttcgtgatagtcaggaacgactgcttttccgttaacgaaatgacgcattgctgcagtaacagtgaattgttcgatcccgaagttgtttggaatagttttagttgttaaatagccgatttcttctatggttccacgatcgatctcattccaaaaatgttcatcatagttgctgtcttcgttttggacatttccatccaatttcgatacgaggtcgactgttccattaccttcaagcatttctatagtcaaatggatgtaagctgcttcttttttgataatgctcaaaaaacgttcaaatgaaatacgtactttattagtagaagtagtgattgtgaatgtacgagatagcacaccgtttttcatatctagttcccaataaaaatcttctggttccaaagaagccaagtcgatcagctgatcgttgatcgaaatatctattgcgataaagttcaaggcattgatcacttttccaaagtactctggataaccgtttttccaccagccgacacgtgtcttatcaggataccagacacctgccaaataagtaccttgatggtgatcccctgagtaagtttcctcaaagttcccacgcatccccatataaccgtttccaatacttgtcagagattcttgcagtcgaagattttttttatctaattgggtcgtgctgattttccatggatcaatagcaaatagtcgtttgatctgtttcattgttctcctcctaatgagctgttttatacgtttataataaacgcaaccgattgcgcaagtcaatagacaataagaaatatttcaaagaaaaaagcataaaaataaatttttttcgagctatttatagaaggaaacttatgtactataggttttgaagaatggtatagacagaagaatgaaaaataaagcatttacaaaaaagaaaacgtacgctataatacatttaacgaaaccgattgcgtaaaggagctaaacggaatgaaaaagatatttagttttgagttttggcaaaaatttggaaaggctttaatggttgtggtggcagtgatgccggcagctggattgatgatcagtatagggaaatcaattcctttgatcaatcctgagtggacgccgcttgttacaacgggcggagtaatagaaaatattggttgggcaattattggtaatcttcatattttatttgctttagcaataggaggaagttgggcaaaagaacgagcaggtggggcatttgctgctgggatctcatttattctgatcaatcggatcactggggccatctttggtgtcacaagcgacatgcttgcgaatgaagacgcgtttactcacactcttttcggtacgaagattatggttaaagggttctttacaagtgtgttggaagcaccagctttgaatatgggtgtatttgtagggatcatcgctggttttgtcggggcaatggcttataataagtactataattatagaaaattgccggatgctttgtctttcttcaatggaaagcgctttgttccgtttgtcgttatcttatggtcaacgattgtggcattgattcttgctgttgtgtggccaaacgtacaggccggaatcaataattttggtttatggattgcagaatcccaggaaagcgcaccgattctagcaccgtttttatttggtacattggaacgtttgctattaccgttcggattgcatcatatgctgacgattcctatcaactatacacagcttggcggatcgtacgagattctatcaggtgcacaggcaggaacacaagtttttggacaagatccgttatggttagcttgggccactgatttagtgaatcttagaggtgcaggggatatggcgcaatatgaatttgtgctgcataactggacaccggcccgtttcaaagtaggacaaatgattggttcttcgggtattttgatggggatggcatttgcgatgtaccgtaatgtcgatcctgataagaaagcaagatataaatcaatgtatttttcagcagcgttagctgtctttctaacaggtgtaacagaaccattggagttcatgttcatgtttgcggctgtaccattatatgccatttattcagtcattcagggagtggcatttgcaatggcagacattttaccattgcgggtccattcatttggaaatatcgaattgctgacgcggacaccgttagctatcaaagcgggtctaggtgcagatcttatcaacttcgtgttatgtgtaatcgtttttggtgttgttacttatttcttagcaaatttcttaatcaaaaaattcaactttgctacacctgggcgtaacggaaattatgacaatgacagtgaagaaaccactgtatctaacagtggaacaggaacagcagatcagcaagtggtccagatcattcatttgttgggcggaaaagaaaatatcaaagatgtcgatgcctgtatgactcgtttacgtgtaagtgtaaacgatcgggaaaaagttgggactgaagaagcctggaaacgagcaggagcaatggggctaatcgtcaaagacaatggagtccaagcagtttatggaccaaaagcagatgtcttgaaatcagatatcgaagatttgttgcaatcaggagcagagattccagagccgcaaatggtttctacaggaaatggacaagcagatagtaagcattacttaggtatagaacaagaactagtttccgcagcttctggggaagtgattccattagctgaagtaaaagatccagtattctcacaaaaaatgatgggtgatggctttgctgttattccaacgtcaagagaagttgttgcgccgatcgctggaaaagttacaagtattttccctagcaaacatgcaattgggctagaaacgaaagatggcgtcgaagttttgatccatatggggattgatacagtccaaatgaatcagtcagcttttgagattgctgtcaaagaaggacaagaagtaggaacaggaacgaaattagctgagatgaatcttgaggtgatccaaaacgaagaaaaagatccaacgatcatgatcgtatttacgaatgataaagtggaagaagtagtgatcaagcaagtagggacagtggcagctggtaaagtgatcggctccattaaaatataaggggaggttgtgaaatcagcgccctgacctgagtattagagaggcaaaacggaaaaatagctcctcatattttgctgtttttgagctaataccgaaggtcagctgattgaacactgtttactggggaggttgtgacaaaattttgtcacaaccccttttgtttcgaaatgaaaagaaggagaagaaccatgaaattcatgacattgaacacacatagctggcttgagccagaaccagagaaaaaattacaggaattagcagagaagatcctgttagaagattatgaagtgatcgctttacaagaaatcaaccaattgctggaatctgaagaagcagaccctccaaaactaacgaagttctgtccagtagagaatcaagttcctatccgcaaagataattttgcctactgtttagtccagcttttaaaagaacaaggaaaagagtatttttggagttgggaaatgagccacatcggttatgataaatatgaagaaggaaatgcgctgcttacgaaaagaccattggaaagtcaggtcctcaccgtctccgaatctcaaaagaaagaagattatcggacgcgcaagatcttgattggaaaaacaaagatagatgatcaagatatttttgtctctagctgccacttttcttggtggacagataaaaaaagcggcttttattttgagtggaaaaacttggaaaactacttttttgaaacacgcgcaccactttttttcctaggtgatttcaataatccagcagattctgaaggttatcatatagtaaaggaaagtggtcttcttcttcaagattcgtatgttatcgcgaatgaaaaaggcaaggctgctactgtggaaaagaagattgatggttgggaacaaaatacagaaaaattgcgtatagatttcatttttgtccctgaaggagtacaagtaaaaaaatatcaacggatttttgacgggatcgatagcccaatcatcagtgatcactatggggctgaaatcgaaatagatggacgatgaacgaacaaaaatatgacacaaaaaaactaaacaaaataaaactctccgatcgatcctaccgttcggagagtttttttgattggatgtatcatccgttttgactaagcatgtagatgcttgtatctatgataaataaataagcacagcaaggtaaaccagccaatcaaagtaagagaaagaatgaaatagaaatagattggcgttcgatagtgaagcgtgagctcgttgatccctttttgctgattcacaattggggtcccgatatccattaattcataatcagtcaatgtttttccattttgctgtagtacagtccgatcataaacgataacagggatatgaaccgttttgtccccagtatttttccacttgattgtcaaaagaccgcctggatgtgtttttatgaaagttgtttcgttttctaatatttcttcgttatatcggtcgtatttgttgtcttttgtctccttatagattgggagatagtcaggggtggttttttggaaaacgaataagctggtagacatatctttactgaagaatgttttccttgcttcttccggtgtatcgaagagataagtatgtcgactgacaaatgtttcattctcccacttttctagatgctggtataagttttggatcgtctgtgcagaaaaaataagaatacccaatatacctaaaagacggaaccacttttgctcagaccattgatttagtgatagggcaaggtaaagcagaagcaatagcgtaaatgggacgaaaaatcgaaatggaaattgaattaagctaataaaaggtacatttttttcgatcaatgtcgtccatggaatcaagctagtagaaagaaaaaagaaaacaagacttgtatacaacacgattttttggaacaaggtgttcttttgttgaaagaaaataaaaagcaaaaaacctgacaatatcaatatcggaaaggctttagggtaatgaagccaataactgccatctaggtcaatcgccttttgactcatttctctgttaacaaaggggggaagaatcttattcccgctgtaaacaatagctagtcctgcccaaatatttgctgtcaggacaaaataaagcaagaccgacttgatcagttgaagcagtgcttttcctttttcagtctggttaaaaaagtaataaagataaaaaggaatatacatcaaggctaacatgatcgaagacagcagatgaatctgcgtcataagtccaactgagatcgcaactttgatcacaggaaactttttatgaaggacgaaatcaacaatagggatcatgcataaaggatagaaacaagtcccccaactagtgaatccttgattgatagaccaatattgaatagaatacgtactcatgaataaaacggctactggtacacttacccagttccgaacattgacatatctcagtaaaatcagcatagaaaatcctgaaataagataaagaatgaagtttgaaagaatctgatagtgaaaccaactacctgcaagcaacacgatcaatccttgtaaataagcaaaaaatgggccgtaaacggcattaacgatcctaccgctttgctggaatccataaagggaaggaaaataatggaaatccccatgtttgatttgttgcgcagcatcgtagaaccgattgtaatggaagggggcatcagcacccaaaattagtttatgtgtgaataaatgaggcatgagaaataccaaagcaatgaaaaaaattgctaaaaacgggccatattttttcaattgtcgaactcctttgcaaactttagataaattcatcatatatcctatgcggtagggaggcaagaaattagaaaattcatgaaaatatttatgaattttacaagaaaaacacaagtgaaatttctaaggagagaggatgtgacaaagccatgtcgcctcctttgttttgggtaataagctcactagcctagaaaatatgaaaagctattttctgactagcgctcttattactcaaagcataacgcagttttcacaacctcttccttaagcggtcttcaaaagcttgcatctgcggtaataagtccaaccaaacgaaaaatatgaggagctatttttgtttggttgttcttatgacttgatgcaggacagctttttcacaacctctgattcacggtgttccagaagtagcttcttcagaaatctcttcttatttcttgaagctaaccacttctgtcacaacctcatcggctttcattttctatttttttcctgaacccatataataaaagaaagaacaaaaaaacttgcaagggaggaaacatgtgaagcagagaaagcaaaaacagtctcgtcggcttttgtttcgtttatttttattgatatgtatcgccgtagggttattaatcgctttgtatccattttatgtggattctttaaatagtcttatggatcaaaaacgaatggaacaagtacaaaaacgaaccgcagccgaaaatgaagcgcaacgaaagaaaatggaggagcaaaaccaacgattaactgaccaaggattcaatcctggggctgatcctttcgatgaacagaacagaaatgaaagcacgacatccagccaattagaggaatggctgatcggaagtgtcaatatacctaaaatccaaataagtatttcactttatgaccggcttaacggcatgattcttgagaatggagcaggcgtcttacaaggaacttctttcccacttggtggaaattcgacgcattcagtgatttctgctcacagcgggttacccaatcgacgattatttaccgagttaaatcgcttagaacacggagatacgtttattttgactgttttgggggagaaattggcttatcaagttgaaaatatacaagtggtactgccagatgacacgtctgttctaacgattgaagaaggaaaagacttagtcaccttgcttacatgtacaccatatatgatcaacacgcatcgtttgctagtgacgagacatcggattccttatagtgaatcggtaaaaaaggaagaagaaaaaggaaatcaggaaagaaatttgcgacagttgcttattcttgcaggaacgataatagctgtagtcatactgttactgtttattggtcgattgatttatcagtatcggttaagtaaaaaagtgcttgatttttcatttattataagtgattcagcaggaaatccagtaaatggtggctcatttattttgaaacataagaaaaaaacacttactagaaatggtgtgccgttttcagtgcaaagcgatcattatgggaaagtcaagctggatcaattgcctggtgggacttatcgaatcgtatcagttgatgatcctaaagtcgctgcatcttttggtatcagaaaattaaaacaagaaaagatgtacttttttgaggggcgaaaactagtgaaagaacttcaaaaaaatggtttttggtttaaactcaatgactaagtaaggagagaaaaaatgattcgtacaacaacagagttgtctgctgaagaactggaaactgttctatcgatttggctgcatgctaatttggattctcatggattcatctcaccaacttattgggagaatcaagtagaatctgttaggaaagctttaccagatgcggtgatttacttagcagaaatagatcaagaaatcgtcggttttgctggggtgatcgatcagttcatcgcaggaatctttgtaaaaagggaataccggcaacaaagaatcggtacgcaactaatgaaaaaaataaaagaaaccaataaaacattgactttgacagtttatcaaaaaaatcaatcagctattcatttctatcttttacaaggctttaccgttcaaatactgcaaaaagatgaagcagtaaatgaggaggagcttgtgatgcaatggaatcaaaccactgatttttgatgaacagaataacgaaataatgctcccagcctatttttttgcagggagcattatttcattttgaagtcactattttaactgtgtgaagatgcagttgttacaatctttgatattcgtcaatgatgttcccctctaatcttagtatgtttttaagtttagctatcagatattgatggttagttttggataaacgaaatcaattcttcgcccgtcaaaccatagtttacggcaatcaatagttttaaacgtgctttttgactattgatgctgttgcagaaaataatccccatttcttctagttcttttcctccgccttcataatcataaacaggctctgcgattccattgaaacaacgagaaacaagtactacaggaattttttggacaagaagcttttctaaagctgctaaggcttgaggagggagatttccggcacctaaagcttcaatgactagaccgtctactttcgtatgggcgattgcttccaataagtctccttgcatcccagcatatgctttaacaattgggatagtcccatttacagcggaaatatccagccgctttgtttctaaaagttcttgtaagaataagattcgattcttagttactaaaccgattggtcccaatgtaggcgttcggaaagtagcaacatttgtggtgtgggtctttgtcacgtagcgtgcagaatgaatctcatcgttcatgaccactaatacacccttatctaccgcttcttcacagcttgcgacgcgaatagcactttcaaaattatagaggccgtcacttccaagttcgttacttgaacgcattgccccagtcaaaacaattggtaatttgtcaccaatcgttgtatcaagaaaaaaggcagtttcttctaatgtatccgtaccgtgtgtaatcaccactccgaatatacctgattcataagcggacaagatacgttcttttaataccaacatgtgagaaggcatgatgtgtggtgagggaagattgaagatatcttcaactaagagttccacatgctcaggtatcgtgatttctgcatctaataacgggtttgccacatcaggactaacaccgccagtgagcatgttttctttcatggcgatcgttccgccggtgtgcagtacaagtatttttttcattttacagacttccttacgaataattttgcatagccgttaaatcttattgtatactatataaaagagttttgctatcagtgaagaataacaatagccagacttattataaaaaagctactcttacttaaacgaagaagactcgaccttgacctcttaatgcacggagtatttggttgagtttcttttacaaaaaagtagtcaagagaaaacaattacgaaggtggtcgaaaatgatcagaatcggattaacatcgtttaaagaacatgacaaattaactggcaaaaagaataacactctgtatgaatatgccggatttctacccttagtggaattagatactgcttattatgggattcctcgaaagtcctctgttgagaattggataaacgaagtacctgaatcttttcgctttgtagtcaaagtctatcaagggatcagcggtcaaggagattggaagccttattatcagacagaagaagagatgattacgcattttttagatgtcatgtcgccaatggtagaagctggaaagcttttttgctttttaattcaattcccctcttcattcaagtgtacaaaagaaaatgtccaatacttgcgcaaacttagaaagtggtttgagggttatcctgttgctgtagaattgcgggactattcttggtatagcgatgaatttcttgaacgtacgagaaactttatgtctcgagccgctttttctttagtcatcattgatgagccgcagctgctgaatacaacgatcccttttgatccatttgtaaccaatccgaactttgctctttttcgatttcatggcaggaatgctcagggatggcaagcaaatgataaagattggcgcaaaaaaagaacattgtatcgttattcagaaaaagaactacaagaactagcatgtgaagtcaaagcagttgattctaagacaaaagagataggtgtgatttttaataacaattctggcggggatgcggctgaaaatgcattagcactgcaaaaaatattaaatatccagccggatggacttaatccaactcaaatggatctgttttaagggcttattttattcatgaaaggggcgaagtctatgatcaaagctattttttttgatattgacggaacattggtcaccaatcgttcaaaagcattggaatcaacaaaacaagcaattaactatgctcggaaaaacggcattttatgcggtgtagcaacggggcgcagcccaataaagatcaaagaaatcattgatgatttggaattagatatgtatgtcgtgtataatggtcaactggtttttactgcagatcgaacgattatcgaccacccttttgaacaaaaagtattggaacatattgttgaatttgcagatgctaaccatcgacaaatcgtttttggtgcgagaaatcggctagatggatcaacaacgatgctattaggacaatcgatttttatcaagcggctagtcagctttttaccgcgtaaattcccggtacgtctgatgaaaaaagtcctccagctttttagccctcatcggcaaaaggaccgttatgaaacattagagatattaaaagaaccaatttaccaatgtatactgcttagtccggagtcagaacagaaaaagttagaacatctatttcccgagtgtaccttccaacgttcaaatacgtatactgtagatatcatcccaaaaggtggttcaaaattgctaggcatccaagctttcgcaaatgctgtcggaattgagatggaagaaatcatggcattcggcgaccattacaatgatatcgagatgctgaaaggtgtaggaattggagtggctatgggaaatgctcagattgaagtaaaacatgccgcagattttgtgacccaatcaaatgaagaagatggcatatacgaaggactgaagcactttggtctgatttattagacaatgaaagaaggaaaacattagtatggaatcagagacaccttttcaaaaagtagaagcatttcacaaaatttttgatccaagaagaccagaaatccccacagcttttactgcgatggaggctcatacacgtgctgcattcaaaatagaagaacttgttgaatttgttgcagctacctcaccaagtaaagaacaactacatgaagctgttactctgctacacgaagcattagataaagcagaagaaaaaatacttgataaaacagagtggggaagtgacccactgattgaacaagtagatgcactgacagatatcctttactttacttacggttctttttcattattgggaatagcgcctgatcgaatatttgatatcgtccatcaggcaaatatgggaaaattgtttccagatggaaaacctcattatgatcctgtaacaaataaagtattgaaacctgagaactggcagatggagtacgcgccagagcctaaaatcgcggcagaaatccaacgacagattcaagaagctcttgctaggaaaagctctgctgataggagtgcatgcacaaacgaaacagagtgatcagtacgtcactatttttgttatctttatacgatgaaaaacaaaagattttcgtttaagttagtgaatgcatgaaaatagtatgctataatctagaatagatgtcttttgcacgagagacgtattatttggatttatgccaagcagaacgccatctgttgcataaaaagatgcatactgaaaacggaggaaccataaatgggaaataatgttatcatcggaatcgtcattgcaatcattatagtcgccattgtcgtctttttggttagttacttgatgaagaaaaaaaaccaagatcgattggatgccttagaaaaacgcaaggaagaattatttgacttgccagtgattgaagaagtcgatgatgttaaaaaaatgcatctggttgggcaaagccaaaatacctttcgtgaatggagtcaaaagtggaatgacatatctacttcctcattcgctgaattagaaagtcaaatttttgaagtggaaaacctcaatgaaagttttcggttcttaaaaggaaaaaaagcagttgttgaagcagaagcaacaatggaccaaatggagaaacaagtaacggaaatccgtgaaggtctgaaggaattgcgagaaacagaagaacgcaactcattagctgtccagcaggcgcttgatgtctatgaagaactgaaagaaaaagtcagagaagacgggcatgaatatggaccagctctttttgaattgcaaaaacagatcaagatgatcgaaaaagaatttacgcaattcgtgactttaaatacttccggcgatcctgtagaggcccgcgaggttttagataaagcagaaaaacatacgtatgaagtggaagctctgatgaaaaaaattccaccactgtatgaagatctccatacgactttccctgaacaacttgaagaaatcagtgatacttatgagaaattaatggaagaacaatatgtattccctgaagaagatcttgctgaagatatcgcaaaagtaagtcgaagaattgaaaattcattagccaatcttgaaaaaacagaagttgaaacggtcgaattcgaaaaccgagaaacagctgatttgattgattcgctatatgacatcttagaacgagaaatggaagctcagagatatgtaaaaactaaccaatcaacgattgcagagtatatcaaacatacaacgaagaataaccgtcaattattgattgagttggatcacaccgctcaaagctatacattgaatcacaatgaaattggtcgtgtacgaggtttccaaactgaagtggaagaaatggaacgtcaaaatgaacagatgattccacagatccgccaacacgaaatcccttattcagaagtgcgtacgttctataaaacagtcttcaaggtcttagaagatatcgaaacgcaacaagtagagatcgacgactcattacatgaattgagaaaaggcgaaaaagaagcgcaagaaaagatcgatacattcgaatttaaattgcgtagtttgaaacgttttgtagagaaacaacgtttgcctggcttgccgaatgattacctagaattcttttttgttgctactgatcgtattgaagaactaagtgttgtcttgaataaaattcgagtaaacatggaggaagtcaatcgtttagttgctctatgcgaagaagatctagaattattagataagaagacacatgatctagtagatgcagcagcactaacggagcaaatgctccaatatgcaaaccgttatcgtcatacacacgaagaagttcgagaagcgattgataaaagttactatttattcaataaagaatatcattatcaagaagcattagacgaaattggtacagcattagagcgagtagaaccaggtgctttcaaacgcatcgaagatttttattttaatcatccagacttagtataaagcaaaaaagtagcaatcatgcaagaacaagacaaccatccgtcttgttcttgtcttttttttatgtctatctgaaagaggaaacaagtgaaaattccacctgctcttgaaagcaccttggacaaccgttataatagaaaagaatttcaaaaaagaggggtttcttatgatatattttgataacagtgcaacgaccccaatctttccgcaaagcttagatgcatatgtaaaaaccagtcagcggattattgggaatccatcaagtcttcatgatttgggcaatcaagctaatcggttgttgcagcaagcaagaaagcagatcgctgatttgatccatgcagagccagaagaaatcttttttacttcaggaggaacagaaggagataactgggtattaaaaggaacgatgattgaaaaaagagagtatgggaatcatatgatcatttcaggaatcgaacatccggcagtcagtgagacggccgaacaattaaaagaattaggaatcgaagtaagtatcgccccagtagataaacgcggatttgtacgtgttgacgaattgaaaaaattaataagaaaagagacagttttggtctctgttatggctgtgaataatgaagtaggatcgattcagcccatccaggaaatcagtgatcttttggatgatttccctaaaattcatttccatgtagatgctgttcaggcaatcggaaaagtaccattctcgcaatggttgacagggagagtggattttgcaacattttcagcccataaattccatggcccacggggaactggtttcatttattggaaaaagggtcgtcgtttagcaccattactgacaggtggaggtcaggaaagaaatcaacgaagtgggacagaaaatgttccaggtattgtggctatggctaaagctttacgtttatcattagagataaaggaacaaaaacctgagcagacacaacgcttaaaagaagctttaatcaatgcgttgaagtcttatgataaagtgacgatcttttcagaaggaaccgactatgcgccgcacattttatgttttgctctaaaaggaattcgtggtgaagttctcgtccatgctttagaggaaaaacaaatatttgtttctactactagtgcctgctcctcacgtaaacatatggcaagcagtacattgcacgcgatgcatgtaccaaatgatttggctacatctgctattcgaatcagcctagatgaaaataattcattagcagaagtggagcaatttatgattattttcaagcagctttataagaaattttctgtaatcaattaaaagaggagtgttcttgtgaaatacagtgaaattatggtccgttatggagagctttcgacaaaaggaaagaatcgaaaaagctttatcatgcaactagcacaaaatgtcagacaagctttgaaagaatttccagaaatcaaaatccatgctgatcgcgaccggatgcatcttttgttgaatggtgcagacagtcagctagttattccaaaactagcaaaaatatttgggatccaaaatttttctccgagtattcgggtagaaaaagatgttgaagttttgaaacaagctgttcaagacatcatgaaagaaatttatacagggaaagaaacatttaaaattatcgctaaaagaagcgatcaccaatttgaattgacaagtaatgaattgaatcaaacattaggcaatgctgtttttgatattttccctcatatccaagttcaaatgcgtcagcccgatattccattacgtgtagagattcgtcgtgacggcgcttatctgtcgtatgaaacgatcaaaggagctggcgggttgcctgtaggaacaagcggaaaaggaatgctcatgctttctggcgggattgattctcctgttgcaggatattttgcaatgaagcggggagtggaaatcgaagctgttcattttgctagtccgccgtatacaagtgaacaagcactgcaaaaagcaaaagacttaacagcgaaactagcgccttatgtaggaacaattcattttattgaagtgccatttaccgagattcaagaagaaatcaaaaaatcagtgccacaaggatattggatgacgatcactcgtcgaatgatgttgcggttgaccgatgaaattcgccgtattcgtcatggtctagttattttgaatggcgaatcattaggtcaagtggcttcgcaaaccttgcaaagtatggtggctatcaatgaagtaacgaatacgccaatcattcggcctgtagcgacaatggataaacttgaaatcattgaagtagcggaacagatcgatacatttaatctttctatccaaccttttgaagactgctgtacgatttttgcgcctccacagccaaaaacacgccctcaactggaaaaggtccatcaatatgaagagcgtttagcaatagatgaaatgatccaacgtgcattagctggtttgaagatggaagagatacaagcagaatcttctaatgaaaaaactgaagaattttcagaattgctataagtggttgtgaaattagtgttttgaactaatgtcgaagattagctgataaatgataaaaaaatttcccatgaaatagcgacccaaatagttaatttttgggtcgttttatttgtctcacacccttttccttcctacctgtaaccttgctcccgtgttagaaacatgttacactaaatatgtgaaattattaacaaggagcgtcgttatgcgagaaaaaacagatacactgccaaaagcaactgcgaaaaggttacctttatatttacgctacttaaagatgctggatgactcaggcataagtagaatcaaatcaaatgagttcagcgaaatcacccaaattccttctgcaacgatccgcagagacttctcgcaattaggcgagctaggcagaagcggatatggctatgatgtccctttccttatcgatgtattcaataatatccttaatactaaagaagaaaaacgaatcgcattagttggatacggaaatcttggcaaagcattgaaacacaacaattttagaagaaatgaaaatctaaatatcgtgtgcgtctttgataatgatccagcactgatcaatcgagtcattgatggagaaatgatctatccgattgatcgtttcgcagagatagccaaagcaaaaaatgtgacagtagcaatctctacggtaccaagtaaatattcacaatctgctattgatgaaattgtcaaagggaatgtaaccgctatccttaactttgcacctgaccgagtaactgtcccagcttatgtcaatgttcaatacattgatttgacaaccgagttacagacgcttatttactttgatgagaattactcagaagttttttcttaggaaaatttgagtaggcttattgatcttgcaaggatccgtcgtaattctttcaaaaattttttaatactaaatgaagtggttttttcacgaccacttgttgactaaaaaaaaaaaccattgtagaatgaagcataacgctgaacaagaggagtaactggcacattcattcttagagagagaactatctgctgaaaggttctcaatgacaaccagtgaaggtagcttgggagtttctgtcttgaatggagtagagatagacgagtcgtgatcgttaactcacttgagaggcaataatgattgattattgcaatttaggtggtaccgcgtaaatcatacgtcctaaaatacgaaagtattttaggacgttttttagtttaaaggaggaaaacagcatgacggaagaaaataatctatcaacaaaatataacccgcaagaagttgaagctggacgttatcagcattggttagaacaagatttgtttaaaccgagtggagataaaaaagcaaaaccttattcaatcgtgatcccacccccaaatgttaccggaaaacttcatttagggcatgcttgggatacgaccttgcaagatatgctgattcgtcaaaagagaatgcaaggatatgatactttatggttgcctggtatggaccatgcaggaatcgcgacacaagcaaaggtagaagcaaagcttagagagcaaggaatttctcgctatgatctaggtcgtgaaaagttcatcgatcaagtgtgggaatggaaagaagagtatgcaagtcatatccgtgaacagtgggctaaaatgggattatctttagattacagcagagaacgttttacattagatgacggattatctgaagcagtacgtaaagtttttgttaccttatatgaaaaagggttgatctatcgcggtgaatacatcatcaattgggaccctcaagcacgaacagctctatctgatatcgaagttattcataaagacattgaaggcgccttttaccatatgagctatgaactggcagatggatcaggcgtagtagaaattgcgacgacccggccagaaacgatgttgggagatacggcgattgctgttcacccagaagacgagcgttatcaagcgctgatcggcaaaaaagtgattctacctttagtcaataaagaaatcccaatcattgcagatgaatatgtagatatggagtttgggacaggtgtagtaaaaatcactccagcacatgatccaaacgactttgaggtaggtaatcgtcatgatctcccacgagtgaatgtgatggatgatgatggcacgatgaatgaactagcaggaaaatatgctggaatggatcgttttgctgctcgtaaagcaatcgtgcaagatctaaaagaaatcggccgattgatcaaaatcgatacgatggtccatagtgtgggacattccgagcggacaggtgtcgttgtcgaacctcgattgtctactcaatggtttgtaaaaatggcgccgttagcaaaaaaagccattgataaccaagaaacagatcaagcagtggaattcttccctccaagattcaatcaaacatttttacgttggatggaaaatgtccatgactgggtaatttcacgacaattatggtggggacatcaaatccctgcatggtatcacaaagaaacaggcgaaatgtatgtaggaatggaagcaccagctgatagtgaaaactgggtccaagatccggatgttttagacacttggtttagttcagcattgtggcctttttcaacgatgggctggccagacacggaaagcgaagattataagcggtacttccctactagcaccttagtaactggttatgacatcattttcttctgggtaagccgaatgatcttccaaagtttggaatttactggcgaacgaccatttgagaatgtcttgatccatggattgattcgtgacgaacaagggcggaagatgagtaaatcattaggtaatgggatcgatccgatggaagtaatcgaaaagtatggagcagatgctcttcgttggttcttatcgaatggttctgcaccaggacaagatgttcgcttcagctatgaaaaaatggatgcttcatggaactttatcaataaaatctggaatgcttcacgtttcgttatcatgaatatcgaaggtatgaccgtagaagagatcgatttatctggagaaaaatcagtggctgaccgttggatttttacacgtttgaacgaaacagtcgcacgtgtaactgaattatttgatcgttttgaatttggtgaagccggtagacaactgtataactttatctgggatgatttttgtgactggtatatcgaaatgagcaaagaagtactttatggagatgatgctgtttcaaaacaaacaacacgtagtatcctagtccataccttggatcagattttgcgtttgttgcatccaatcatgccattcgtcacagaagaaatatgggaacatattcctcatcaaggaaattctctagtagtagcagaatatcctgtggtacgtccagagtttgacgatgaaactgcttctaaaggaatggaagtattgaaggaattgattcgagccgttcgaaatattcgttcagaagtgaatacaccattgtctaaaccaattacgctattaatcaaaacaaacgatgctaaaatcgatcaatttttagttgaaaatacaagctacatcgaacgcttctgcaacccagaagagttgacgatatcaagtgagatcactgcaccagatctagcgatgtcagctgttctgacaggtgcagaaatcttcttgccgttagcaggattaatcaatatcgaagaggaaatcaaacgattagaaaaagaactggaaaaatggacaagcgaagtgaaacgtgtccaaggaaaactttctaatgaacggtttgtttctaatgcgccggaagaagtagtagaggcagaacgtgcaaaagaaaaagattatttagagaagcaaacggctgtcaaagaacgaatcgaaagtttgcgtactattcaataaaagcggggaataccacttattccgaataaggggatgtgacatgattattgtcgcatcctcttttttagtctactctgattacttagaaaaaagagcgatttatcatgtatccggagcagatttttttctctatcgtccttttatttttcttatgtcttctatttgttataataaaagagaaatgggggaattgttgatgacgattgaagaagcaatagaatggatccatagtcgattaccatttggttcacgtcctggtcttgaccgagtcgaagctttattagaagtggtaggtcatccggagaggaaagtaaaaacgatccatatcgctggaacaaacggaaaagggtctactgtagcctatttgagaagcctattagaagaagctggtctgatagttggaacgtttacttcaccttatatcgaaacgttcaatgaacggattgcaatcaatggcaaaagtatcccagacaatgacttgatccagcttgtaaaaaaatatcagccgctgatcaaacaacttgatcaatttgaagcagtagctggtatcactgaatttgagacattaacagcaatggcatttgattattttttgatgaagaaagtagacgtagcgattattgaagtgggcttaggtggcttattggattctaccaatgtagctgtaccgatgctaactggaataacaacgattgggcttgatcataccgagatacttggagagacgattggagaaatcgctgcgcaaaaagcaggaatcatcaaacaaggcgttccagttgtcacaggaaacatcggcccagaagcttttaatgtcatcaaacaaacagctaaagaaaaaaatgcgatgctttatgtatacggggaaaattataaaataaactatctgcatcctgatgagacttggggagaagtatttgaattctttaatgaagcagggaaaatccctcaactaaccacgccgcttttagggcaacatcaagctgaaaatgcaggagtagccatcgaattgtattttgtttactgtcaattggaaaagctgcctttccgagaaaaagatgttttgaaggggttgaagaaatctcgatggccaggaagaatggagcgtttgagtaacgagccattagttgttttagatggtgcccataatacgcatgcaatgaaccggcttgttgagaatttgaaaaaagaattcaaaggatatcaaatcaacattttgttttccgccttacggactaaaaatgttagagaaatgctagaacgattgcagcaagtaccaaatgtccatatttatttgacgacctttgaacatccaaaagccatcgaattaagtgaagtatcagatttagcaagtgaaagagtatcaattgtttcattgtggcaattcggattagcagatatattggaaaagatgacaaatgaagatgtattagttgtgaccggttcgctttatttcatttcagaagttcgtcatttattaatacaattaggaggagaccatgaagtataatgcagtgatttttgatatggatggtttattgtttgacacagagttagtatattacgaggcttcacaagtagtagcagataggatgggttttccatatgataaagacctgtatttaaaattcttaggtgtttccgatgaagaagtgtgggcgaattatcatatgatttttgcggaattcggcaaaacaagcgtacaaagatttatagatgattcataccaggaaacgcttgagcgcttttcacaaggagctgtacaaatgaagccaggggtgttggaactcctctcttttttagaagaacatcagattcccaaagttgtcgcttccagtaaccaacgagctgtcattgaacttttattgaagaagaacaatctgtttgaacgatttgagacgattatttccgcagagaatgtccaacgagcaaaaccagatccggaaatttttttattagccaatcagaaattaggtacagctaagaaagaaacattgattttagaagattcacaaaatggtattttagcagcttctgcggctgagatccctgtagtcatggtgccagatttgcttccgccttcccaagaattgatcaaaaaaacggctggggtcgtttcttctttgcatgaaatccctgcattgataaaataaaaatccatctcttttcgtatcttattttagaaaagatagaaaggagatgtttttttggaaaaacgattgatgaaagaagtaccaactagctctttaccaagagaacgtatggaattttatggagctgaagctttatcggatcaggagcttttagccattttactgcgtactggtcaacaccctcatagtgtgatgtcgattgctggcaatctgttaaaaacgtttggtggattggcttctttacgacaggcgactttgcatgagttagaagagattcgagggataggacgtgtgaaagcaatcgaaatcaaagccttgatcgagttaggccgccgcattcagacggaccaagaaagagcagctccggccattcgtactagccatgaactggcacaacaattgattctggaaatgaaagattacaaacaggaacatttgatttgtatttatttggacacgaagaatcaagtgatcttaaaaaagacagtgttcatcggttcgctgaatcagtcagtcgctcatcctagagaaatatttcattatgctgtacgttattgcgcggcaagaatcgttttagcacataatcatccgtctggtaatgttattccatcacaacaggatatgaattttactaaaaggatacaaaagtgtggagaaatgatgggtatcactgtactggatcatttgatcatcggacgtaaacgatattttagtttgagagaagaaggattaatggaagagaagtaagttgctttcttgcaaaaaaaatgaagcaagtgtacaattatattgtaattttgtttgggaatagaagttgaaacatctgttgcacctctatcgtacacgagcaatgttacaatttaaataagtgcttttggcacgaggaggatattattatggaaaacggaacagtaaaatggttcaacgctgaaaaaggatttggatttatctcacgtgaagatggaagcgacgtattcgttcacttctctgctatccaaggtgacggattcaaaacattagaagaaggtcaagcagtgactttcgacgttgaagaatcagaccgtggcccacaagctgcaaacgttgtaaaagcttaattttatctgtaaatcaaattgatggtaggcatcaatttttacgagagaacaaagcgagtaacaaaaatacctgccacaagaggaaatttctcttgtggcaggtatttttgtatgaaaaagtaaataaattttaagaggttgtgaaaaagctgccctgtatcaagcaataagaacagccaaataaaaacaacttgtcctgttttccgtttggtttctcttatactcaggtcagggcactaatttcacaacctcttacttattcttcatctggtgtcatgaccatcggtaaaatcattggatgcctttctgtacgttcgaataagaatggctgaagcgcgccagtcatcgcttctttcaatttatattctgaacagtcaggtccatttaaacattctcttaaagcatggaataagattcgctgagcttcattgatcatttctcctgattctcgcatgtaaacaaatccacgagagagaatatctggaccagctaagatttcttttttcttgatatctactgttgcaacagctaatacaagaccttcttctgaaagcaagtgacggtcacgtaaaacgacattaccgatatcaccgattccgctaccatcgatatacacatctccagccacaaaatgcccagcaggacgtgcagaatcgctagttaacgctaaaacatcgccattttccatgatgaagcagttttctgcaggaacacctacatcttgtgctagagaagcatggactttcagcatgcggaattctccatggacagggataaaatattttggtttcatcaagcgaagcatcaatttttgttcttcttgtccaccgtgaccagaagtatggatgttattgatttttccatggattacttctgcgccagcttcagacagcaagttgatcaaatgattgacacttgtcgtattaccagggataggtgaacttgaaaagatcactgtatcgtctggctggatttggatttgacggtgggtaccatttgcaatacggctcaaagcggccatcgcttccccttgagaacctgtacataggatcatcgtttcgttagcaggcaagcgattgatttcatgtgcatctacaaatgtgccgtctggaactttgatatatcctaaacgttggccattgacaatggcattttccatgctacgtccgaaaacagcgattttacgaccagtcgccacagcggcatctgctgcttgctgcaaacggaagatattagaagcaaagctggcaaaaataatacgaccttcgatttttgaaaagatcttcaagatagaatgaccaatcgttttttctgatttagtaaatgttggaatctcagcatttgtactatcagataaaaggcacaagacaccttcttccccgatacgagccattttatgcaagtttgctggttcgccaacgggagtgaaatcaaacttgaagtctccagtcgctacgatattaccagaaggtgttttcaccacgattcctaatgcgtctgggatactatgagtcgttctgaaaaagctgacagaagtttttctaaaacgaatgatcgtatcttcattgatttcatgaagctctgcctctcgaagcaagccatgctcatctaatttgttcgtgatcaacgctaatgcgagaggaccagcatagataggaatatttgcttgttttagcaagtagggtattccgccgatgtggtcttcgtgcccgtgagtaatcactagggcttttactttgtgcaagttttgtatgatgtagctgtagtcgggaatgacatagtcaattccaagtagatcgtcttccgggaacttgatcccggcatcaatcaaaatgatttcatcttggaattgtaccccatacgtatttttcccgatttcacctaatccaccaatagcaaagacgcctgtctcattatttttgatggaaagtttcatattaaaactccactaatgagaaatcagcattttctttttcgtattctagatgacttccttctagaagttgaacgaattcaatattgtatggggtattttcttccacacgttggcgagcgtctacatcgctttttgcctcaatgtaaagagattttgtttcttcccgtttagggttacgtacttttgtttcttgataataaactttatagatcattgttttgtctcctttatctgcgtaaagcagtgatttagctagttgatttttttagacaacacaaaacgaggggacaagccacctagtttttcatatgctttgactagaatactggattcgagtcaaagagacaagcctcgtttttgctcatctgttcggatattttttcaaccgtaccttctgtataaaaaatatacaacaattaattgttattctagcataaaacagcaaataagtatagaaatcaactagattgaaagaaaaaatcaacgtttatcattttactataattataatgacttttttatgagagaagtgttctattaataggttcgttgtgctatcatttttagtaatgaaaatgtaacaaaagattaaaaggagatgagaaagtgaaactaatgtggcattataccatgcgttataagaaattcttgtttttcaatttcatatgcgtattcggttttattttgattgaattaggacttcctacgattttagcacgtatgattgatgtaggaatccgcaatgatgattttgattatgtgaaacagcaagggatatttatgatcgttattaccgtaatcggtattattttgaatatcttgttaggttattttggttcgaggatcacgaccaatatcgtagcagatattcgagatgatttgttcgaaaagatccaaagctattcgcatcaggagtacgaaaatttaggcgtatcttccttgattactcgtacaacaaatgatgcttatcagatcatgttgttcctgcaaaatattttgcgtatcggtttcatggcgccgatgatgttcgttgtcagtttgtacatggtcatgcgtacaagtgtgacactcagcttgtatgtagtaggcgcattgcctttgctattattggcggtcgtagcgattgctaaggtgtctgagccgttatctaaaaaacaacaaaaaaacttagataaaatcaatagtatcttgcgggaaaacctttcaggattgcgtgtgattcgtgcattcgttaatgaaaagtttgaagaaaaacgctttgctgtagtcaacgagaattatgctgctagttcgaaaagcttgttccgtttgatggctgttgcacaaccaggtttttatttcttatttaatatcgtgatggtattgatcatttggagcggggcagtgcaaatcgatgctggcgaacttcgggtaggagatttgattgcatttatcgagtatatattccatgccttattctcattcatgttatttgccagtgtgttcatgatgtatccaagagcagccgtttcagctggacgtatccaagaggcactagatgccaaaccttcgattgtagaagatccaaatggtatatcggatacgaagactaaagggtatatcgaatttcaaaatgtaacatttgcttatccaggccattcgcaagagccagtgattcgaaatgtcagttttacagcctctccaggagaaaccgttgcttttattggaagtaccggtagcggaaaatctacgttgattcaattgattcctcgcttttatgatgtgagtgaaggaaagatcttggtcgatggagtagacgtgagagattatcggttaagcaagttgcgagataagattgggtttattccgcaaaaagcgctgctatttactggaacgattgccgataatttgcgatacgggaaagaagatgccacacaagaagaaatggaacgtgcagctgagattgctcaagcttcagaattcatttctcgaaaaccagatggatttgacgaacatttatcagaaggtggttccaatttttcaggtggacaaaaacaacgattggcaatagccagagccatcatacgccgtccggaaatctatatttttgatgacagcttttctgcattagattatcaaacggatgcgaagttacgtgctcgtctgaaaaaagaaacaacagagtctactgtgttgatcgtagcacaacgtgtgggaacgatcatgcatgcagataagatcatcgtattaaatgaaggagaagtcgtcggtatggggacacatcgggagttgttggaaaaatgcccgatttattatgatattgccgcttctcaattatcaaaggaggaactagcatgaaaaaaaccttttcttccttaaaacgtttagctcgatatatcagaccgtatcgtgggacatttcttctagtgatcctatttacagttctgacagtgggtttcaacgtggctttgccatatgttacaggacttcctactacagaaatcagtcgtaatattgccaatggcgaatcaatcaatttttcttatatattcaaatgtcttatttggatcacagtggtcggaatagggtattgtatttcgcaattgctttctggggttttgatgacaaatgtcgttcaaagtgccatgcatgatttgcgaagagacatagaagaaaaaatcaatcgccttccggtttcttatttcgataaaaaccaacaaggaaatattttgtctcgtgtgacgaatgatgtagatgcagtcagcggtgctttacaacaagcttttattggaatcgtaaatgcgatattgggaattacgttggctgcagcaatgatgttttatatccagccgatgatggcgctgatctctatgatcatgattccaacatcgatctggatctccaaacgagtaatcaatgcttcgcagaaatattttcaaagcatgcagaattcgcttggtgagctaaacggctacgttcaagaaaatatgacaggtttcagtgtattgaaagtatacggacgcgaaaaagaaacattggaaggattcaaaaaagtaaatcacagcttgaaatactttgggttccgcgcagcgttcatttctgggttgatgatgccattagttcaactaactgcctatgctacttatattggtatggctgttctaggaagtttctatgttattactggggcgatcgttgttggtcaacttcaggcattcatccaatatatttggcaaatcagccagccgatggggaacgtgacccaattgtcttctgttttgcaaagtgcatcagcggcaacaaaacgtgtattcgagattttagatgagccagaagaaaaagaaaacaaagtagatgtttcactgccagaaacgattttaggagatgtgacattcgatcatgtcgattttgcgtatgatccgaagaaaccattgattcaagatttgaactttgaagtgaaagcaggtcaaaccgtggctgtcgtcggtccgaccggtgccggcaagacgaccttgatcaatctattgatgcgtttttacgacgtagacaaaggagctatcaggatcgacgggattgataccaaatcaatgagccgcagtgacgtccgttcgctatttggtatggtcttacaagatgcatggctctatcaaggaacgattgccgataatatccgtttcggaaagcttgatgcgacagattatgaagtagtagatgctgcaaaaacagcaaacgtagaccattttatccggacaatgccagatggatatgagatgcccataaatgctgagggagacaatgtgtctttaggacaaaaacagttactcacgattgcccgagcagtggtttcagatcctaaaattttgattttggatgaagcgacaagttcagtagacactcgtttagaagcgttgattcaaaaagcgatggatcgcgtgatggaggggcggacaagttttgtcattgctcaccgtttatcgacgatacgcgatgcagatctgattctagtgatggatcaaggtcagatcattgaaaaaggaacacatgagagtttattggcacaaggcggattttatgaaaaactgtataacagccaatttgctgaggaagcaggataaatcatagaaggataaaacagtttgaaacttattttttgttctcctttcttgataatggtaaagtaaggttatcaaaaaaagtgagggcacggagatggaacagtttttaaatgaaaaaatcactgaagccaaaagagaaattgatcgtttaacgcacgtctgtcagacaaaaccacttgattcagctgatttttttgaaaatgagtttcaaatcgaacgcttggcagcacaaatcgaagtgtacgaattagttttgaagaaagtaatagaagaaaatatagaggtacaataaacaggtaaaacgtcagtttaccagatagcgcaaataggcatctggactgagcaggttttacctgtttttttcttataaaataaatatatgctatgatacatttattcaataggattagtttctacaaaaaacgaaaggagaaaatagagatggaacggtttatagcatcaaatgctacagtgattggtgacgtgacattgtcagaagatgtgacgatctggtatcaagcagttttacgcggggacagtaattggataaaagtaggacaaagaacgaatatccaagatggtacaatcgtccatgtcgatcatgatgcacctgtggatattgcggagaatgtgacggtaggacatcagtgcatgctacatggctgtacaatcgaaaaaggggcgctgatcgggatgggaaccacgatattgaatcatgcggttattggtgagaatagtttgattggtgctggatcattagtaacagaaggaaaagttattcctcctaatgtcttggcgtttggtcgcccagctaaagtgatccgacctttaacaaaagaagaaatccaaaaaaacaaagaaaacatccagcattatgtcgaaataggtcggatgcatgcgcaaggaaaattcaaggagcaaagataggcagtagcatccataaaaataaaaaaaggatggtcagtttgagctggccatcctttttttggtttagataagagagcttaaaaagcttcctttgaaacagattaatttaatgaagaactgttttccatgacttcatcaatcaatccatatgcttttgcttgttcagctgtcatatagttgtcacggtctgtatctttttcaatcacttcaagcggttggccagtgcgttcagctaaaattttgtttaagcgttcgcgtgtttgtaaaatatgacgtgccgcaatttcgatttcggttgcttgaccttgagcgccgccaagaggttgatggatcataatctcagcatttggtaaagcaaatcgtttcccttttgtaccagctgtcagcaagaagcttcccattgaagcagccatacccataacgattgtttggacatcagctttgacaaagttcattgtgtcgtagatagccatacctgctgtaactgaaccaccaggagaattgatataaagatagatatctttttcagaatcttgagcatctaagaaaagcaattgggcgatgatcgaattagcaagatcatcagttacttggccgcttaacatgatgatacggtctttcaataaacgtgagtagatatcataagctctttcgcctcgtgatgattgttcaatgactgtaggaattaaattcataatagagttcctccttggtttcgtttagaaatagtgtaccataatttagtttctaatacctaaaaagtagtatacatttttggtcaaaaaaggtcaaataaaaaacttaggcaaattagtcgcataaacctgctttatggtatgataagcagagaagcaaaacaaggaggaacaacagattgatagttggtattaccggtcttatcggcgtgttgacgggtgctgtagttgtctatatcggcatgatactgcaaatgcgtcacttggaaaataaagaacagcgtagacgtgaattggaattgaaagtcaaagaaatcgagacgctgaaccaattaaataaaaagatcaacgagatcttgcaaaaacggacgacgctgatggaagaatatgtcagctttgatacattcgatgattgttatatcacgattgacgattttgcatatctccaatcattttcagcgcagaatagtttttatctgccaaattatattttagacgagctgtttaagaacatctcccatcgaaaagtgattttatctccagatgaaacaatgaagattggtggatatgcttataaaggcggacgcgtgattttagagaattttacggatagtttgactgaaatgatcaatgaaaaaaaagcacagttgaagactatgacgcgccagccgattggtttcttctcgaaagatgatgtttggagctgatattttgaagtattgccgttgcacatgagagcgtggcaatgctttctttttttcttaatgatacaatagaattgaacggagtgaagaaagatgttacaaatctatgctcatcgcggaagcagcggtacccacccagaaaatacgcttcctgcatttgcagaagctgtacgagtgggtgcagatggtatcgaactagatgttcatctaagcaaagatggttatttgatcgttatgcatgatgaagaagtggatcggacgactaacggtaaagggctgattcgagaaaaaacattggaagaactcaaaaaattgaatgcaggaggcaaattcagcaaagaatttccagcagctaaagtccctgaattgaaagaagttttaggactgcttctccaaaaaaattaccgagggatgctaatgattgaaattaaaactgatcagtatgaatatcccggtatcgaagaaaaattagccgaaacattaaaaagcagagattggccttttcaacatgcatattgcagctttcatttggcttctttggaaaaaatcgcgttattggaaccagagatacagctggacttattgatgagtacttctgataaaaagatccaactagcagcagaaaccccttatatagaaggagtacatccaaaaaatacttggttgttcgaacatcctgtccaggcagctgattttccaaaagcaattcgtgcatggacgatcaatgatgaagaagaaatggccaaatgtcaagaactcaaaatagatggaataataactgattttccggagaaagctcttcggtggaaacaatcaacgaaaagtaggtaaaatatggaaaaagtattagtgatcgtcggtccgacagcagtcggtaaaacagcgctaagtgtggaactcgcacaactatttagaggagagatcatcagcggtgattcattgcaaatctataaaaatctggatatcggtacagcaaaaatcaaagaagaagagatgaatgatgttccgcatcatttgattgatgtgatcgaacctactcaacattactcagccgctgattttcagcgttcaggtcgacaattgattactgagattgcgaaccgagagcatctacctatcatagctggtggcacgggtctgtatatccaatctcttctatacgattaccagttaggggcgacagaagaagcgaatcctgagattagaaaaaagtatgaaacgttagccgagacaattggttcccaagcgttatggaatcagttgaaagaaaaagatccggcagctgctgagaaaatccactggaacaatcaacgcaaagtgataagagctctggaagttttggagacgacagggcatagtatcacggcacctaaagaagagccaaagcgattatatgattacctaatgattgggttagatacgaagcgtgatatcctgtatgatcgaatcaatcacagagtcgatttgatgctagcagaaggcttggtagcagaagcacgtaaggtatatgagcttggagaagtccaagccagtcaagggattggatataaagaattttttccttattttgaagggaaagaaacattggaagaagcaacagaacaagtcaaactacattcgagaagatacgcgaaacgtcagttaacgtggtttcggaaccgtttggatgcacagtggtttgatcttataagtgagccaaatcaaaaaagtcagattgagcaaacaatcaaaaaatggctggaggcggaataaaatggaagaaaaagtaatcatcgtaggggtagaaaccgaagcaaaccagcgttacttttcagagtcaatggaagagctagttcagctgacgaacaccgcatcaggagaagtcgtattcacaattacacagaagagaccacaagtagatcggcaaacgattatcgggaaagggaaattacaagaattagttcaaaaagcagatgcgcatgaagcagatttgatcatctttaatcatgaactgactccgagacagagtcaactgattacggatgctgttggccttccggtgattgatcgagtacagctgatcctagatatttttgcgatgcgtgctcgttcgaaagaaggaaagctgcaagttgaacttgctcagttagaatatcttctgcctcgtttagtggggcaagggaaaacattgtctcgtcttggtggtgggattggaacaagaggaccaggtgaaacaaagttagaaacagaccgccgacatatacggaataaaatttttgctgttaagaaagaattgaaagaagtagaagcccatcgagagcgcaatcgtcaaaaaagaaaaaacagtgagatttttcagattggtcttataggctacacgaatgctggaaaatcaaccatcttgaatttattgacacaagcggatacttattcaaaagatcagttgtttgcaacgttagatccattgactaaaagatggcgttttgctgaaggatttgagattacagtaacagataccgtcgggttcatccaagatctgcctacgcaactgatcgatgctttccattctacgctagaagaaagtcagaatatggatcttttgttgcatgtagtcgatgccagttctccagatcgcattttacaggagcagactgtactaaaattgatggatgaattgaatatgaaagaaatgccgatactgactgtttacaataaggcagaccagattgatccagcgatgtttacgcccacattattccctaatgtcttgatttctgctcaaacgaaagaagggaagacggcattgatcgaagcaatcaagcgtcaactgatggaactgatgacaccttatacactgtctgtgccaagcaatgaaggacagaaattaagtgagttgagaagacaaacgatggttttggacgaagcctacatggaagaatcaaacgagtatgaagtgagaggctttgcaaaaaatgattcaaaatggttgagaaaaagcaaataaaattttgtttttttacaataaaaatcactgagaaagaatagcatagtacaataaaagtaaaaggtatctggtacgaaaatcaactagatacctttttttgcgttcatgttttttgttattttataaaaaaatagaggtctcatgttagaaaacctaacatatgcagttgacaatattttttttaattggtacactttagccaacttataaaacgaaaggggacgtctgatgggagaaaaggaattgcgccgatctatgtccgtatttccaattggtacagttatgaagctgactgatttatctgctcggcaaattcgctactatgaagaacaagatttagttcatccggaacgaagtgaaggaaatcgccgcatgtattcgttgaatgatatcgatatgctgcttgagatcaaagattatctttcagacgggttaaacatggctgggatcaaacgtgtatacgaaatggcacaggcgaaaaaacaagaagcaaaaagcaagaagccgttgacagatcatgacgttcgacaaatttttcgtgatgagattttggcgcaaggtgggttaagcaaaacaggtcattatcagtcgcaaggattgcaaagacaattctttgactgaataaattaaaaaaggaagagggataccatggtaaagaaacagataacaggtgaagagatcaaacgaatcattgaggaagaaaatgtacgatttttacgattgatgttcacagacatcttaggtacgattaaaaatgtagaagttccagtgagccagatcgacaaagtgttagaaaacaaaatgatgtttgacggttcttcgattgaaggatttgttcgaattgaagaaagcgatatgtatttgtatccagatctctccacttggatgatcttcccatgggaaagtgctcatggaaaagttgctcgtttaatttgtgatatctataatccagatgggacaccatttgccggtgatcctcgtgggaatttgaaacgagcattgaaagacatgcgcgaccttggttttacctctttcaatttaggacctgaaccagaatttttcttatttaaattagacgaagacggtgggatcacaacgaccttgaatgataaaggtggttattttgattttgcaccaacagatttaggtgaaaattgccgccgtgacatcgtgttggaattagaaagcttaggctttgaagtagaagcttcacatcatgaagtagcgccaggacagcatgaaattgactttaaatatgcggatgtagtagatgcttgtgataatatccaaaccttcaagctcgttgtcaaaacgattgcacgcaagcacggacttcacgcaactttcatgccgaaaccgttatttggaatcaatggttctggtatgcattgcaatatgtctttattcaatgatgaaggaaatgtcttctatgataaagacggtgaattggaactaagtgaaacagcgtatcatttcttaggcggtttgctgaaacatgctcgtgcctatacagccgtttgcaatccaacagtcaattcttataaacgtctcgttccaggttatgaagcgcctgtttatgtcgcatggagcggtcgtaatcgttcgccattagtacgtgtaccagaatctcgcggtttgtccacacgtctggaattgcgttcagttgatccatctgcaaacccatacttggcaatggcagtattattgcaagcaggactagacggtatccgtaatcagatcacaccgccagccgctgttgaccgtaacatttatgtcatggatgaggaagaaagagaagctgcacatatccaagacttaccttcaactatccataatgctatcaaggaattacgtaaggataatgtaatgattgatgcattaggacaacatatcttctcaaattttgttgaagcaaaacgtctcgaatgggcggcattcagacaaactgtttccgagtgggaaagagaacaatatctagaactttattaaaagaggaatgccgtgaattagaggttgtgaaatcagcggtttgacctgagtattagagaaacaaacggcaaaatagttcctcatattttgccgttttttgagctaataccgagggtcagctgattgaacaccgtttagtggagaggttgtgaaaaagctgccctgcatcaagtaataagaacagccaagcaaaaacagctacttatgtttttgacttggttggacttattaccgcagatgcaagtctttgaacaccgtttatcaagaggttgtgaaaaagacgtttagtttcgagtattaagaaaaattttgtgaaaatggttcctcaaatttttgcataaatttggcttaataccgagaaactggcttttgaacaccgtttatttagaaataaagggggcacgacgtttgtcgcacctccttattttttatctattgtttcacttaaaatttttcagtaaagatttcctgatttgcttaagtttaacgttagctatgtttatctaaagcctattatgtgggttaaatttttttgcactcataaaggacttaagaaataatttctcaaaggatatcgaaaaagaaaaattgtaagcggatagccttcatttgagtacttgactttccctcagtcagcttgtattatacaccttgggcacccttttaaagggtcagaagtttacagaaatttcggctccctattcttattgaagaatagggagctttgtttattttctgagacttttcctgcacataaattaaaaaggagtttttgaacttatgacaaaatatatttttgtgaccggcggtgtcgtttcatcaatcggaaaagggattgttgcagcttctttaggacgcttattgaaaaaccgcggcttaaaagtaactatccaaaaatttgatccatacatcaatgtggatccagggacgatgagcccatatcagcacggagaagtattcgtaacagatgatggtgctgaaacagatttggatctgggccactacgaacgttttattgacatcaatttgaacaaatactccaacgtgacgacaggaaaaatctattctgaagttttgcgtaaagaacgtaagggcgaatacttgggagcaacagttcaagttattcctcatattacaaatgagatcaaagaaaaaatcatgcgagcagctaaaatgactgattcagatgtgatcattacagaagtaggaggaacagtaggggatatagaatctttgccattccttgaagcacttcgtcaaatgaaggcagatgtcggtacagataatgttatgtatatccatacaacattgatcccttacttgaaagctgctggagaaatgaaaactaaaccaacgcagcacagtgtaaaagagctacgcggtttaggtatccaaccgaatattttggtggtacgtacagagcaacctgtttctcaaagcgtgaaaaacaaattggcacaattttgtgatgtcgagccagaagcagtcatcgagtcgccagatgtagatacactttactccatcccgttagttttacaagcacaaggaatggatcaaatcgtttgcgaccatttgaaattagatacaccagaagcagacatgacagaatggaaagaattagaagaacgtgtcttgaacttgaagaaaaaagtacggatcgcacttgtcggtaaatacgtcgagttaccagatgcatatatctcagtagttgaagcattgaaacattctggattcgcctataattcagatatcgagatcgattggatcaaagcacaagaattaacgagagaaaatgtagaagaacgtttgaaagatgcagatggaatcttagttcctggcggtttcggcgatcgcggagtagaagggaaaatcgaagcaattcgttatgctcgcgaaaatgacgttccatttttagggatttgtcttggtatgcagatggcttgtgtcgaatttgcacgtaacgtcgttgggttggaagatgcggcatcagctgaaacgaatccagatacagcaaacaacattattgatttaatggctgatcaggaaaacatcgagaatttgggtggaactttacgccttggattatacccatgcaaaatcaaaaaaggaacgaagacggctgaagcatatgatggagctgatgttgtgcaagaacgtcaccgtcaccgctatgagttcaacaacaaatatcgtcaaatgtttgaagaacaaggactagtcttttcaggtgtctcaccagacaaccgtttagtagaaatcgtagaactgccagagaagaaattctttgtgggatgccaattccacccagaattgatttctcgtccaaatcgtccgcaaaaattaatcaaagcatttgtcggagcatcattagcagatcatgaaacaaaataattttttagcttgatagaaagagaaaagtagcaagagaaggggataagcaattttcttgttacttttctctttttctgatttgttattatttataggaaaaaagataggaagtaaaagactttttttgagtaaagagcgattaagcattttattttttgcaaaaaacttcttgaaaattttcattttcattgattttagtagaaaactaccgaaatgtttggtaaaatagggtcgttggttaagaattgtcttaacaaatttagttttacaaaacttaggaggaattttattatgccagtagtatcaggagctgaatttttaaaagctgctcgtaaaggcggttacgctgtcggcgggttcaacacaaacaacttggaatggactcaagcaattcttgaagcggctgaagcaaaacaagcaccagtacttatccaaacatcaatgggtgcagctaaatacatgggtggttacaaaatctgtaaagatttgatcactgatttagttgaagcaatgaacatcactgttccagttgctatccacttagaccatggtgactacgaagctgctttggaatgtatcgaactaggctatacttcagtaatgttcgatggttcacatctaccattcgaagaaaacttgaaattagctaaagacgttgttgaaaaagcacacgcaaaaggtatctcagttgaatgtgaagttggttcaatcggcggagaagaagacggaatcattggtaacggcgaattagctgacatcgaagaatgcaaacaaatggttgctacaggtatcgactacttagcttgcggtatcggtaacatccacggtcaatatccagaaaactggaaaggattagcatttgaccacttacaagcaattgctgatgctgtaggtccagacatgcctttagtattacatggcggatcaggtattcctcaagatcaaatcgaaaaagctatctcaatgggtatctcaaaagtaaatgttaacactgaattccagttatcatttgctgcagctactcgtaaatatatcgaagctggtaaagataaagaaggtaaaggattcgaccctcgtaaattattagctccaggtaaagcagcaatcgttgaagatgcgaaagctcatatcgactggtttggttcagctaacaaagcgtaagcatccacataacagatacgatgtataggaatggagaacgacttttgaagtcgttctccattcttttttacttaaaacggcagaccatgctcgtttcttttttttatctatgataaaatacaagcatatccatgaaaaaagattaataaacaaggtggaaacagatgaaaaaaatcgtaatcaaaggaaaccgacctttagctggcgaagtaacgatcagcggtgcaaaaaatagtgcagtcgcattgattccagctgcaatcttagctgattccccagtgatcttggaaggtgtgccggacatacaagatgttcattcattaattgaaattttagagattatgggcgcaacggtccatttttccaacaacatactagaaattgaccctcgagaaatcgtatcggttccgatgccgcacggaaaaatcaatagtttgcgtgcgtcttattattttatgggaacactgcttggtaaatttggggaagcggtggtaggcctgccaggaggctgttatttaggtcctagaccgattgatctacacgtcaaaggatttgaagctctaggtgctgaagtgacaaatgaacatggtgccatgtatttacggacagaaaatgaagggttgcatggcaatcggatttttatggacgtggtttcagtcggagctacaatcaatgtgatgttagctgctgtaaaagcaaagggacagacagtaattgaaaacgctgcacgagaaccggaaatcatcgatgtggcaactttactgaataatatgggggcaaaagttcgaggagcgggtacagatgtgatccgtatcgaaggagtcgaagcattacatggctgtcgtcatttcatgattcctgaccgtatcgaagcaggaacttatctggcattagcagctgcagcaggaaaaggtatcaaagtgaaaaatgtgatttttgaacatttggaaagttttatagcaaaattgcaggaaattggcgtccatatgaaaatcagcgaagatgaaatcgaagtttacccctcaaaagaattaaaagccgcaaatatcatgacctatccttatccaggatttgccacagatctgcagcaaccactcactgcgttgctattgatgaccgcaggcacttcagaaatcatcgatacgatctatgcgaaacgggtgaatcacgtgcctgaattagctcgaatgggcgctgatattaccgtggaaggaaatatgatcatcgtgaatggtccaaataaacttcacggaacagaagtcgtggcttccgatcttcgggcaggtgcttgtttagtgattgccggactattagcagaaggaacaacgacgatttataacgtagattatatcttacgcggttatgatcatattatcgagaaactaacagccttaggggcatcaatcgaaatgatagaggaagtgggagctgaatgagcgattatttgacaatggcagaactagagaacaaaacgttaaaagaagtttatagttatgccaaagaatttaaaattccttattacagtaagatgaacaaaaaggaattatctctagctgtgattcgtgcacaagctgagaaacaaggattttattatatggaagggatattagatatcgttggtcaagatggttacggttttttacggccaattaattatggaccaagtgcagaagatatctatatttctgcctcacaaatcagacgattcagtttgagaaatggggacaaagtggcaggaaaagcccgtccgcctaaagaatcggaacgttattatggtttgatgcacgtggaaagcgttaatggaaaagatccggaagaagcaaaagaacgtccgcattttccagccttaacacctctttatccgcaaagacagcttcaactggaaacaacaccgcaaagactatctacccgaatgatcgatatcttctctccaatcggttttggtcagcgtggattgatcgtcgcaccaccaaaagcagggaaaacttctgtattaaaagaaatcgcaaatggtatcaccgaaaactatccggaagtagaattgatcgttctgctgattgatgaacgtccggaagaagtaacggatttagaacgaagcgtgaaaggcgacgtggtatcttctacatttgatctgcagccgcaaaaccatactcgagtttctgaattagtattggaacgtgcaatgcgtttagtcgaagataaacgagatgtcgttatcttgatggatagtattactagacttgctcgggcctataacttagtcgttccaccaagcggacgtacattgagtggcgggattgacccagccgcattgtataaacctaagaaatttttcggggcggcaagaaacatcgaagaaggtggcagtttgacgattttagcgaccgctttagtcgatacaggaagccgcatggatgacgtgatctatgaagaattcaaaggaactggaaatctagaattacaactttcacgcgagttatccgaacgtcggatcttcccagccatcgatatcaaaaaatcaggtacccgaaaagaagaattattgatgccaagtgaagaactagaagaaatttggaaacttcgaaaaaatatgactggagattcattagaatatacggaacaactgatccgctttttgcgtaaaacaaaaaacaatcagcaatttttcaaagaatttcaagatgtctcctttggtaaaaaaaatccgaccagaaatctgaaaagataattgcaaccttgactgaaacatgttaagatgttaatgttgtaaatcgacaaatcaactctggttcagcaaatggagcagggcaaaggagcgaaaaaatcatgaaagaaaacatccatccagattaccacccagtagtattcatggattcaacaactggtttcaaattcttgtcaggttcaacaaaaacttcacaagaaacagttgaatgggaagacggtaatacatacccagtcatccgtgtcgaagtaacttctgactcacatccattctacactggacgtcaaaaattcacacaagcagacggacgtgtggaccgtttcaacaaaaaatacggtctcaaagacgcaaacgctgcggaataataaaaacgctgataattcaacgtttagcagactatccgatagggatagtctgttttttttcgtttttgaccataatgaatagatggatatcgttactcaaaaatgggtgggatacagtaaattttttcgaattttattaaatcaaatttaaattcattgattaaactatccatctctaataattctagtccttgtaaaattttcattattcgcttccgtcctttgatgctatctccttctatatgacagattaatgccttataaaattgaatggatatctgagtatcttttgcaaacaataatctatgatgagtagcttcaaatttttgtaagtattgtttagaaaagtgaatatttttgcgttctaacattaaaagaaaagcattattataaagactggataatatcggatgaaatatttcaaaatcattgtatttttcaattttgcgttcgatttctgtaagcctttgggaaatatagtttgtatcaaaaagaaatagtaatgagctaaaactgatcatttcaaatcttccccactcatttactttttctaaataattggcaaagtgatccaagtgttttttatcatttttattcagcttacgtttttctatgggcagagtataccaatcaaaagtttttatgattaaatagttgcgaatatcaacaatgtctcgtgtagtatttgctttttttcgaatgatttctaaagtatacttccgtgaacctctattctctttagtagctttaataaaatcttttatctttttatttttctttcgtatgctatcaagttctagatataagacaaattcatccatggttatattcaatttatcaagaaattccaataaaataacaaaaggtatgctattttttccagtttcataactagacaatgtatttcttgttgttatattatgagctaatttttttgagagatacctatttctacacacaacttcttaagtaattccccgctatccatatcaccgctccgttcttttataattgttatgcgcaaattaatcacaaaatgaaaataatacgtatttttaatcataataacatagtagataaaataaaaacacgggaggtgtgtatttaatattgaaaatcggggataggttgttatttgggtggtggatagattgtcgatcgattatttatcccagttctaaatgtttctgcaagcaaagtagttaattctaagacaacaaatgaaaaaatgatttcagattttacggatgaaaaattagatatattcacgaagttgtttgatattacggaaactacaaagttagtaagtacaatagtaactaatgatatgaagtcaagatttcaaatgaattacgcaatagaaatatgattattcatgtaccaaaaagctcattggatttaacaaacgcaaaagttctacaagttacagaaaattcaaaggatttttatacgatcacagtgcccatagtaggcgatgactataatttatttagtaatttgacggttacttatagtcagaatggagaaaatgaaggatatcaagaaactattattagtcgagggttgaacaataaaattcaaattgaatcttatgtaaacggtaaattgatgaaatctgatttacttaatgaagagtttttatctaacgagcaaattaagaaggacatgcaaaatgtacaaaaacaaggagctttgttacctcagagtagaggtgttgctgctaaaattgcttgtattgttgttgttcttggtattagtaaatacgttgcgactatcattgcaggagcttgtgttggttcgtgcccagctataccagttatttgtgctgcttgtattggaggtttcgtagctttaggcactgggacgatgagttctgtagtggcttgttttaaactttgattggattgatgagatgtgaaaaagtcgattaaaactagcagaataattatatcgtttctatgtctctttgtagtagcattctcgttgattttttttcaaacgggcagatttggtatgaataatattctacctgagataaagacagaagtgttaaaatcaaagcttgaaggttctgatactttcttattatatgtaggtagaccgacttgcattcaatgccaagaaattgaacctacccttcgaaacatattaaaaagtgtaggagtaaaagccagctactatagaactgatatagctcgaaacgaagatgaaaagagcttagaggaagtagctaaaaagcttgatttaactgtagtaccctcattattaatgatttctaaaggtgttttagttgatagattagatggtgtttacactgcaaaagctatttctgaatttttagaaaataataaaactatttttgaggaggatgcatagttgtttatccctatatatagcatgatacttctaggcttatttttagtattttgtctttacgctctgaaaatacttcaaaaaaataatgatgatacgcgacgacaaatagcacaattaagaaaagatattgagttgatcttggaaaaaattagggaaaataattaaaatggtggatttacgttacttagagaattattctaagcaagtgcttttgttagcggtttcgtttgcctatggatactttgtcagtcctagcgaattaaaattaagtaatttcaattttcgtacattgacaaatgagtgcgagaacaaatttatttttagcttatctacggatagtcaaactattgataggttatccaaagcatatggacaaaagtatctaaacttggattttcttgaaaatcaagggaaaacttcatggtgtgcagcatacgctactacagctattatccgttatcaaactaggaaaagttttcctactgcacgacagatgatgacaactttgtatccaagttcatccaatttagcagatgaatctgcctcaaatatccaatgtattagctacgctaattcttatggatttcatagtatttcaaatagatgggggacagctacagcagaaggaacgatgcttgaaattaatgcgaatcggccatattgggtatctgcgctaaaacaaactagagggaaggataggtatgcgtttgttgttagagggtacgctaactttgatttttataaaacgatttccgtatggaatccatggagtaattcaagctatggatatgatctactggacccttccagtcatttgattagtactcatggggtggtattcaaacaagattcaggattattttcttggcattatctataaatagcattaggggtgttaggagtgaagtataaaaaaatttcttctcttattctagtaacaatattattatgtacggcttgttcttctcccgctagtcaaccgaagaaaaaagaactagaattatcaaaggaagaatgggagcagctaacttttttttgtggagaatgggtatatacgggagatgaatcaatgtggacaatcaacattgataaacattcaatagacatttcgtatgataaacaccagtttaatggtgctttcacaggcataaaagtaaatgatgggttgacgatatattgtgaagataatcaatgggcctacacattggataagagagatgatgagcgtatattcgttatacgcagtaagctagattctggaacgacttcaaatgcgatgggaatagagttaataaaaaagtaaagaaattagaataattataaatgagagcaaatttaagagtttgctataagacaagtgataaaaacaccttatattaacaaaatgaagaggggttatttcgaagtaaaaaaccatttacctaaaaatagaaaacaagcagaccggcttgccgttttagttacacagcaaaaaatcgcacataaattcatgcatcaagccattgcttttcatgaaatcgattatctggtgacaagtaacgaactggcaaaagaacagtatgagaaagtaaaggaacaccatatcgaatgtctgtatggatgaattattgcgtgaatattctaaggtgttttcccattttttcattttcttagataggaccttatctttgctcgcttctcttagccgatggtataataacgaaaaggttatcttgttagataaccttacttttttatccagaagaaaggagtgcagaaaatgaaacatgtgaaggcgttggtagtgaaggcaatcatgatctgggcaattctttgggtcgtgctgaccggtttatacggtgttagctttatggattcaacgattgttggggtaattatcgtagtgatgatctatgtgctaggggatctgttgatcttacgtaaagtaggaaacatcgcagcaacgatcgcagatgctggttcagctgcagttatcttgtggctctatctatactttatgaatgatacagtcgatatttggatgaaagtcttgattcctgctctattgattggtgtggcagaatggttcttccacaagtggttgctaagtcaaggaatcgtaccagatgaacggaaaatggaataaatcaacagttaaactattcttatcgataaatgaaagctttaaaaataaatagatgtttaattaagaataatcataaactatttttactcaaaaaaccgctcagatcattttcagatctgaacggtttttttatctattcatcaagatcaaatttcatttttcaatgattcaatcaattcgccctctgcttcatgactatgttttcggccattaacaagatagagtgctgtacataccaatggaatgactccggcaatcacatacaatcctctaaatgaagtaagagattttagcatccccatcaaataaggaccaacgcctaagcctaggtctaaaccaataaagtaggtagacaaagcaatactgatgcggtgttcttttacgatcttcaaacagacagcttgtccatttgacatgaacgtaccataacctaaaccgactaatgctccagaaataagcaatgtcacactattcgtcgttacactcagtaaaaataatcctgctgttaagaataaatagctaggatacatcacgtattgttctcctttgacatcgaaaatccttccagtcaatggacgtgtaaatgtgatgaccaaagcatatacgacgaagaaaaatgacccagcagcaactaagtggattacttttgtataagaagataaaaatgataaaacacttgaataagaaagacccatcaaaaaggcgattcctgtaatgaaaagtgctttcttttcaataaaactattgatattccatgaacgaagagatgttttttgttcttcagataatggaatattttttacaggaaagacaaggcaggcaattgtaacaaagaagaccagtacaattgaaaaccaaataatgaaacgaaagtcagtcatattcagcaaaatcattcctaaaaatggtccaacagcggcagctaaactagtacttaatccgtaataattgatgccttccccttttttagatgcagggatatatgcagtaacaatagcatttgtagctgtagaaactgtaccgtaaccaaatccattcaagaatcgaactaaatacaatgccccgatagttggtgtataaagataagctaatgttgtcagaagatagaaaatcgcgccgcctcttaaggtaaacttccgaccaaatagttctaactgtttccccatgaataagcgtgccagcaatgttccgatgatatatattccagaagcaaaacctgcttggctcaagctggcgtgtaatgtgtcttgcgcaatgactgccatgatgaccatcaacagataataaatcaggtagacaataaaattgatcaatgtgattccgataaaatatttattaaataatttcttttccatgtatgttatacattccccttaagctgaatatgcttttaatttttgtatttgaacttctacatcgtgataattggatggatagcgatcaacaagttggcgaataaataaatcccgtgtagacataaacaggtttaaaaattcttcgcattcgtttgttggattctcatccactgctttgatcaattcgatcgagttttgatacgcatcatttaaaaagactaaagaagctttcatgtcaaatcttgtttgatatgctgtttctaatcgattaatgattgtgttcatccagtaattcatgttttttccctctattcttaaaaaattttacttctgcagtataacgaataaaaaaaaggaaaaaaatcgcataagtgatggaaaaaggtacttaacaaatgttaatatcattagtaaaatacctttggactttaaaaagttttaaagtactgtatgatctttttagatgaaagtttggatgggggagcatcattggatagtagagtcttaaaggaatatttggataaaaatgattttccgattatacgcaaaggatatcataaatatttgacattcgaagggatggaagattcccatacgtatatcttgaaagagggaacggtaaaagcaagtgttatttcaaatgatgggagagaatttaaccttcgctatatcaaagatcttgaaatcgtctctcttttaaaagacgaatattcacaattcatcgattcgccgtataatattcgagttgaatcagaatatgcagagttttatcgaatcaatcgtgtgagattttggcaaaatatcaaccaagatccaaagctacaacactatgtaaaagagtattaccgctatcgcttgctttattcgatgaaaaaaatgcaacaaatgctgttaaatggaaaactgggagctgtttgtacgcaactttacgaattatatgatttattcggtgtgcgaacagaagaggggatgctgatcgatttttcgatcacaaatgaagaaatcgccaaattttgtggtatttcaactgctagcagtgtgaacagaattttaaagcagttgaaaaaagatggtattatcacagtgaaagatcatcgtatcgttattttgaatatggacttgttagaagacaatattatcttttgatgaacaaagaggttgtgacagaagtgggcagcttcaagaaacaagaaggaatttccgaaaattgttactcaaattttttgacaaatttcggcttattttcgaagaagctacttctggaacaccgtgaataagaggttgtgaaatcagcgttttgagctaataccgagggtcagctgattgaacaccgtttaccaagaggttgtaaaaaagctgttctgcatcaagtaataagaacagccaagtaaaaacagctcctaatgtttttaacttggctggacttattaccgcagatgtaagcttttgaacaccgtttattcgcaacaaaagggctgtgacacgatttttgtcacagcctctttttgcgaactttcatttagctatttttagaaacttcttccgccaccgccaaaagtcccgccaccgctagagtgggtagtacttccgccaccgccgcttccaggaggtgggcttttggggattcttcttgtcgtgacaaaagaatttgtcagacgatcggttttttcagttaatttgatactggatttttctcggaacggatatttgtagatgcctgatttcaattgataacgcgaaacagtcacaaaataaaagacaagactaaggataagagccaaaacaacagcaatgatgatttccactgtcgtcaaaactttatagcgtgtgattttgccagtttcttcatctacacgataatgacctcctggaactccgtcttccacatatgtggctgatttagacaagtacgcttttgcagcatcgtagtaggcagcattcgtcatctgatcataaacatcatctaagatcgaatcgattctactgtcagtcaaataatcgatcatattaccagaagtcgaaatgtagatttcacgctgccccatatccaatagcaaaactgagccattttgatcatttccgactgcctttcttaagtaattatcggcaaagtctcttggttcttctgaattagaagtagttgtgacgattaagacacgtcccttgattttttcattcagtttttctgcctgttgttccaaagagtggatttgatctgtagtgaacaacccagcctcgtcatttaccgttgctgtatccgcatgagtagccaccggccaactaacacttactagcaaaagaaagaacaaaaagaattttttcatcatatcaagtaacctccgatcagaaagaggatcgctagtccagcgaaaatcccaagagcagtcagtcctaattttttctggctaatcggcaggacaccgctgacttttcctgtttgtccattcattgcataatagtagacttttttacttgagtcattgcttcgataagtaacgagccataccggcaacaatacgtaattatttacttcatttgtgattgaagcagaggttcggacacctgtcaatgttgtatacccattggcagtatcttttaacagcttctctgaatagtcttttaattcagactgaatttgcgatttgattgcctcgtattcgatatctcttttttctgcttggaacccggctaaatactggcttttaaaatcaattgctttatctaacgggaaaggttgcacgccttcgaccatcttttgttgcgtattttttgataaggcattttttactagttctttaaaagaaagcttgcctgctcttgaaacagcaaattgcttcgtttctgtgtattcgatgtcacctattcgccaaatgcggataacggtgccgtttgcctgcattgtgccatctacttcagcatctgtagcccaataagggaaatatacacccgtcaacttatcgatttgatccttattgaaaaaagcttttggaacaaaccattttttcttggtccaagcgagaaatctattgattgcttcttctttctcgacagcaaaaggaagtactttatttggcaagaattctccgcttaaacgtcccgatagtacaacgggattatggcagtagtaacaataagtcgcagcagtggtcgcatcggtcacaatctctgcaccacagttgggacaaaggaaaagatccatcgatacagtattacctgcagcttcgtccgctgtatctgaaaaaccgcctgcctcgtcaaacgctttgcgctcggcttcactcatgttggtaagctgttcttgggctgtaaaagtaaaatcttctgtagacgaaggttcttctttgctctcttcgccagccatacgcgcttctttttgcttctgctcatattggctgacttcttcttcggtataaatattcaggcagtattcgcaatgaaatttttggtctttaggatcaaaagtcaacggaccgccgcaattaggacatttatgtgtaagaacatccatcagctgcacacctttctcaataaattaatcaacggggattcctttaaacggtttgccgcagtttggacagaatttagggatgccgttggaaagatccacaatctcgttgcattcgctgcaacgcatctgtagcttaggctgagcgttttctactggtttggcagcgccacagttggaacagaattttccggaattttctgtcccacagactggacacgtccaagtatctacattcccttgtgcggcttgttgattttgtttttcagcttgttgcttgatttgttcttggttgttttgagccgcttgggaaaggtaagagccatttgcattcattcccatccctacgcccataaagccagtcattgctcctgcttcattttttccagctgcttccattccacgggcaatggaaccttgcacgtatccttcacgtacgctaggatcacctagcatcgccccttcgttacgcatattgattagtttcacagaatcatctgtgtaagaaatgctggccacagcgacagagacgatctccatccctcgcaactcgcgccaagaatcatccaatgcagtatccatgtatttgcttaactccaaactcttagatgggacataagaaatccgttgtccatccgcagacatctgattgattgctgattgcaatgctgttaggaattcagctaagtattgctcattgatatcattgatttctacttgtgttttgtttttaggaattgcgtttgtataaaataaaatcgggtcaacgacatgaatagaataagtgccatgtgcccgtaagaataattctgcgttatagaaattatcaaagtagttcaatggcgcactcgtaccgaatttgattccctttatttcttggagattgatataaaaaacttgttgtttctgcggtgtaacgccaccaaatttaaatcggtcaaatgtttcagcaattgcttctttcagtgttccgttgaacatggaaggagctgcgtcatttttaatggtgtaataaccttcctcagcggtataatcgatgatttttccaccatcgaccaaaagcatcatcatgtttggatagacatggacgactgttccgtctgtcaaaacatcttctgttcctttacgattggagccacgtttgtcatctttacgaactttgacacctttcgtcataaccgttgtatcactcatattgtctggttcgatgacttctagccattgatctgccagaccgccgccgaccatacttgttgctgctttgataagacccataaaaaattcctcctctgattcagctaatgccaaacaattattgtttatttattataccataggaagaagtgaaacttctcggactagagacggaattgaaatggaaacttgcgtattgattaaatacctgaaaaagccgagaaggatagtagtttttttacccaatatcacgtataataagagatagtgaattttttaaaaaagggggatccttatggcatatcaagcactttatcgagtctggcgttcgcagcgtttcgaagacatcgttggacaaaaagctgtgacacagacactaaaaaatgctattgtttcccacaagacctcacatgcctatttgtttacaggacccagaggaaccggaaagacaagtgcagcaaagattttcgcaaaagcaatcaactgtccgaacagtaaagacggtgaaccatgcaacgaatgcgaaatgtgtcgatcaatcactgctggtacgcaagaagatgtgatcgaaatcgatgctgccagcaataacggagtcgaagaaatccgatttatccgtgatcgggcaaactatgcgcctacaaaggcagcgtacaaagtgtacattattgatgaggtacatatgctttcaacaggagctttcaatgccttgttgaaaacattggaagagccaaaagaaagtgtcatattcatcttagcaacgaccgaacctcacaaaataccagctacgatcatttcacgaacccaacgatttgattttaaacggatcaatacggcagatattgtcgaacatcttgaatttatcttaaaagaatcgactatcaactatgaaccagctgcattgaatgtgattgcccgttccgcagaaggcgggatgcgggatgcattgagtattcttgatcaggcaatctcatttagtgaaggaacgattactttagatgatgccatgcaagtaacaggcagcttgacagacgaaatgatggacagctacttgagtgcttgcgtgaaaaaagaagtaccagaagcattggaagcgttgaatcaaattctcgcagccggcaaagaatcacgtcgctttctagaggatatgttacaatactgccgtgatctgctgatgtatcagcaagcgcccaatctagttgaagaacaatcaagtacgatcagaagtacatttacggaattggcacaaactgtttcagcggatcagctattttcaatgataaagattttgagcgatacacaaaatgaaatccgatttactaatagtgccgctatttatttggaagtcgctacagtcaaactcgcacagctaccctctgcttctgttccttcagcaaaaatggcattagcagatgatcagatagtaaaacagctgcaacaagagatcaaggaactgagaaacgaaatcaaagaacttcgcagtaacacaggaactgtgaatacaaaagtacagccagtacagcagacgaatcacaaaaaacaaacaagtacgtatcgggtaccgacggaacgggtatataaagttctgcgggaagcgacaagacagcatctgaaccaagtaaaagaagtatgggaagatttgctgatgagcctctctgtcactcagcgggcaatgcttaaagcaagtgaaccagttgcagctggccctacaggattagtgattgcatttgattatgagattgtttgtcaaagagcagcaaacgacgaagaactgcagctttcggtacacaataatttaagccgaatgatcaaagactatgcgcctgatccggtttatatcacaagagaaagttggccggaacttcgaaaaaattatttgacgcaagcacaagaagagggagcagaaaattcttttgcttctgaagagtcagaaggagaaatcgaattactccctcaagaacaggaagtaccagaagaaacacttgtagtaaaagcagaggaattttttggttccgaggctgttacagtagtagatgattaagaaaaaaggagtagataattatgatgcgtggaatgggcaatatgcaaggcatgatgaaacaagtacaaaaaatgcaaaaagaaatggcggaagcacaagagctgctaaataaaacagaatttacaggtaaagccactaatgaattggtcaaagccgtatttacaggtgatcgccgtatgaaggatatccaaatcaatgaagaagtcgttgatcctgatgatattgagatgcttcaagatcttgtcgtaatggcagtcaatgacgcaatcgcacaaattgatgtggaaactgagaaaaaattagggaaatacgcaaaaggtttaccaggattttagttttaaactgaaggagtaatgaatatgcaatatccagaaccaattgcgaaactgatcgacagctatatgaaacttccaggaatcggtcagaaaacagcgacaagactcgcgttttatacaatcgatatgaaagatgaagtagtgaatgaatttgctaaatctttgttaagtgtaaaacgagatttacacttttgcagtatctgcggaaatatcacagaagaagatccttgcgaaatatgtagaaacccttcacgtgatcgcagcattatcctagtggtcgaagagccgaaagatgtaatggcgatggaaaaaatgcgagaatatcacggactttatcatgtactccatggtgtgttatcaccgatggaagggacaggtccagaagatatcaatatttcttcgctgctgcagcggctgcatgatgcagatgtaaaagaagtgatcatcgcaacaaatgcgacaacagaaggagaagcaacagcaatgtatctctcacgtctaattaaaccagccggtatcaaagtaacacgtttagcacatgggttgtctgtaggctctgatatcgagtacgcagatgaagtcacgttattgaaagctgtcgaaggaagacgcgagttataaatttctaattaaaagttttttcagatacaatatagaagcagcataagagatgggggcaacaatgtgaacggactatttattacaattgaggggcctgatggtgcaggaaaaaccagcatcttgaatgaacttttccctcttttgaaagaagtagcaaaaacagaaatcattcaaacaagagaaccgggaggcatcccgattgctgaagagattcgagcggtaatcctggatccaaaaaatgatcggatggatgaacgcacggaagcactactttatgcggcggcaagaagacagcatctagtcgaaaaggtcttacctgctctggcaaaagggaaaatcgttttatgcgatagatttgtcgacagttctcttgcttatcaaggtgcaggccgacgcatcggcgttaccgagattgctcggttgaatgagtttgctacagaaggtactacgccagattttaccctttatcttgacgtagattcagacaccggattaagaagaatcaagaaaaacagacaaaaccaaatcgaccgtttagattcggaaggtttggaattccaccagcgtgtacgacatgcttacttaaagctggcagaagagaatccggaaagaatccacaaagttgatgcaagaaaaagctttgaagaagtgctgcaaacaagttatcatacaattattgaacaatatccgcaattttttggaaactagaaaggtgaacgtttatgaaaattattttagcgattatccaagacaaagacagcaaccgtttatcaaatgaattgattgatgcaaatatccgtgccacaaaattatcatcgacaggcggcttccttaaggctggaaacagcacgtttatcgtgggtattgaagatgatcgagtagaagaagcattggaaatcatcaaaaaaacatgtgaatcaagaaaacaatttgtatctacacctgtgacattggatatttcgatggatgggggcgttccttatccagtagaagtagaagtaggcggcgcaacagtcttcgtcttacctgttgaaggattccatcaattttaggaggagctgagctatgaatcaagaaataaacttggctcaaatgcaaccgatcgtgtatcagcagcttcaacggagctttgagcatgggcgtctcgctcatgcttatctttttgaaggagaaaaaggaacaggaaaacatgaagtaggtgtgtggctcgcacagcatctgttctgtacccaaatggaagacaatcagccttgcggaaaatgcaacaattgtcagcgaatcgaaaagaaagaacatccggatgttctggttatcgaaccggacggacaaacaatcaaagttgatcagatcagacgtttgcaaacggaattcagtcgcagcggatatgaatcaagaaaaaaggtttttttgattaaagaagctgaaaaaatgaatagcagtgcggcaaacagtctgttgaaatttttggaagaaccaccgggagactttttagcggtattagagacagatgcagtaggaaggattctccctactattcaatcccgttgtcaagtgctgcattttcaagaactttcgaaagaagcattgatccatcgattgcaagaagagcagattccattagaaaaatcaaaacttttggctttcttaacaaacagtttaggaaaagcagttgaaatctctcaagatgaatggtttaatgatgctaaggacttgatttatcaatggttcgtttacttgcaaaagcaagacactcaagcctttatctatgtccaaaaaaaattagtgaaatcatttaaagaaaaaacacagcagtttacaggattatctgtcctgatgttttattatcaggaagcacaacgtcaagcagtagcgaaaggcgaatatggcaaagtaaaacagataaaccagataattgaacgaatattgatcgcagagcagaaactacgtagcaatgtcggttttcaagctgttgcggaacagttcgttttgcagacgattttttagcttgccgcagaggacgataatcaaggaggatggaaatggtagaagtagtaggtgtccgatatagagatgcaggtcatatctattattttgcaccaggagactctgaatatagttataatgacaaggtattagtcgaatctcagcaatccttacatattgctactgttgtccttcctaaaaaagagattgatccaaatgaccttcctgaagctattcgtccaatcttgcataaagcgtcaaaagctgaactagaaaaagacaaaaaaaataaagaagatgcgtgtgatgcattgcaaatcgcaaaagaaaaagtgcagttgcgtgagctggaaatgaaaatagtcaaagctgaatatacatttgatcgaaacaaactgattttttcttttacggcggacgggcgaatcgactttagagaattggtaaaggatctagccgctgtatttcgtactcgtattgagcttcgacaaattggtgtacgcgatgaagcgaagataataggcggaattggtccatgtgggcgtccattatgctgttcttcttttttaggcgagttcgtgcccgtatcgatcaaaatggcaaaagaccaaagtttatctttgaacccaacaaaaatttccggtttatgcggacgcttgatgtgctgtctacaatatgagagcgaagaatacgagacagcaaaaaaagaactccctgactttggaaaagtaattgttacacctgatggtaaagggaaagtcgtagggttgaatctgcttagccgtatcgttagtattcggctgactggacgggaaaatcctgtcgaatatgaatgggatgaattgaaagaatttatccaagtaggtgagataaatggataagagatcattatacgacggattgaatcagttagaatcagagttgagaaatacattaacagaacttgttgaaatgaagcatgctttgcatgagatcgtagaaaaaaatacgactttggagatggaaaatcaacgcttgcgagaacatcttcgggaattgaatcaagttgcacaagctccagctgaaaatgtgaagcaagaactttccaagtctcgtatgaatcttgaaaaaatttatgaagaaggcttccatgtctgctacgatttatatggatcaagacgggacaatgacgagccttgtgcgttttgtctagaagtgatctatcgcgaaagcggtcgatgatcaataacaagaggagactggagcggagaaagactgctccagtttttttattaaggagattgtgacagatgtataatcaaaaaagtttcaaaggaaatccagtatacgggaatttatatcttgtaccaacgccaatcggaaatctagaagatatgagctacagaagtgttcgtatgctacaagaagcagaccttatcgcaagcgaagatacgcgtaatacacaaaaattattgaatcatttcgagattcatacgccccaaaaaagtttacatgaacataattataaagaacgtgtccctcaattgattgctttgttaaaagaaggaaaaacgattgctcaagtcagtgatgcaggaatgccttccatcagcgatcctggacatgagctagttttagcttgtataaaagaagggatttctgtgatctctatcccaggacctacagctgggatgacggctttgattgcttcagggttagtgcctcaaccatttttattttatggcttccttccacgcaagaaaaaagaacagaaagaaacattggaaaaactaaaagaacaaacagctacgctgattttctatgagtcaccttatcgaatcacagctacgttgacgaatttcttagacatttttggtaatcgccaagtcgttttgtgtcgagaattgacaaagatccatgaagaataccttagaggaagtacagaagaactacttgcatatatcgaagaacatccagtaaagggggaatgttgtctgcttgtagaaggaaatttgtttgaaacggcagggacagaagtggatgaagagcagggaaccttaaaagaacaggtagaagcaaagattgcatcaggcgaaaagccaaatgctgctatcaaagcagtagcgcttaaaaatggactgaaaaaacaagaagtttaccgtcaatatcacgaattaggctgaaatagtataagtagtatacaatgaagcgacaatgtggaaaacagctactaacttctcaaatctcttgaacgcgaacgaacgttcctgtataatagctaagaggtgaggatgatggagctgcaatttcctttacataatgatacatcaagaaaaatcattcatatcgatatggatgcttttttcgcttctgttgaagaacgagatcatcctgagtttcgtgggcacccattagtaattgctagacatcccagtgacactggtgggtgtggagtagtgactacggcaaattatgaagcaagaaaattcggaattcattcagcaatgagtgcacaaaaagcgtatgagctttgcccgcaagccatctttaagcctggcgaccatcataaatacagcgagatttccaaacaagtacgggaagtattctatcattatacagacattgtggaaccagttagtatcgatgaagcgtatcttgatgtgaccgaaaacaaaatcaattgcaagtcagccatcaaaattgctcgaatgatccaggcagatatttgggaaagagtccagctaacatgttctgcgggagtaagttacaataagtttttggccaaattagcatcagactatcaaaaacctagaggaatcacagtagttgcacctcaagatgctgtgccatttttaaaaactttgccaattgaaaaatttcatggagtagggaagaaaactgtacctagaatgcatgagttaggaatttatacaggaaaagacctatatgaatgcacagaaatgatgttgattcgaaattttggaaaaatgggctattctctttatcgtaaagtgagaggaatccatgattctccagtaaatgttacaagagagcgaaaatctgtgggaaaagagcatacgtatggacagccattgcaaacggaggaagccgtgctggcccaattgcgccaactagccgaaaaagtagaagaagcactgagaagagtccaaaaacatgggaaaacagtggttttgaaggtcaggtacaccgattattctactgtgaccaaaagagtgacattgccagaatacatctataaaaaagaagcgctcttttatcaagcaagtcttatatgggaggaaatcttgggagtagaaaaagggatccgattgttaggaatcaccttgacgaatcttgacccgatgacctatgaaaatatcgttcttccgttatggggaaatcaagaaatataaaaacagctttgagagttgaaaatggaaatccgttttctctctcaaagctgtttttatatcaagtcttgttttttgatttgttcataggtttctgttgcatccgtacatttttcccaaatcataacttggttggattctaaagatttttggacatcaatgattcgctggttgctgcttcctcgaaattgtagttttaggtcacgtttgctcaattcaaagcgtccgtcaacaaggatatcgatttgcgaaaggagttctaatttatcttctgaatcttgtagcaattcatcaaaggtatagcctgtccatgaccagatatcttttgtcgtaccgaactcttttcggatacgtcgtacgacttgcaagcaaacatctgtattcaaaaaaggctcgccgcccaataaagtcagtccttgtacgtaatcgttgcgcaagtcagcgatgatttgttcttctaattcaggtgtgaatggtttgccatatcgaaaattttgtgccgctttgttgaagcaaccttcgcaggcgaataagcagccactaacgtaaagactgttacggacaccttcaccatcgacaaaattaaacggtttgtagtcagcaatatagttttgactgtagtcttttgctaaccattcttttggttttggatttctcataaaaaaacttctttcatttaaggttcaaagatatagctattgaagataaaatccactcgaccatataaataagaacaaactgacctaaatccattgttcaagaaagcttgttcttattttgatagagggcgttcaaagatacaaagccatcgaaagagggtggtgaaaaaagacttgtcacagcctcttattctgaataaacggtgttcaaaagccagtttctcggtattaagttcaatttatgcaaaaatgtggaaagctattttcacaaaatttttcttaatactcgaaactaagcggctttttcacaacctctgataaacggtgttcaaaagcttgcatctgtggtaataagcccaactaaacgaaaaatatgaggagctatttttgtttagctgttcttattacttgatgcaggacagctttttcacaacctcatttcatgtgtttcacacgtgaggaaatttctttgtggcgaccatgtaccatcggacgagcttgtggatttcctaaatagccacaagtacgtttgactacatcacatgtttttgggtcatgatttccacattctggacattcgaatcctcgttctgttggtttgaaatcaccttcaaaaccacattggtagcaatggtcaattggcgtattcgtaccaagatacccgattttatcatatgcaaaatcccatacagcttctaaggctttcgggttttgttggagcatagggtattcacagtagtggatgaatccacctgaacaatattttggataatccttctcaaattccaatttttcaaatggcgttgggtttttacgcacatcatagtggaaactgtttgtataatattctttatctgtgatgttttcgatgataccaaatttttctgtatctaaacgacagaaacgatcagtcagactttcacttggtgttgaatagacgctgaaatgataaccgtattcatcaccccatgcatccgcattggcttttaattctttgacgatgtcaagtgtgaaagcttttgcctctgggtttgtttcccattcgccaccgaagaaagctgaagcaacttcatataatccaatgtagcctaatgatacagtagctcgacggtttttgaataattcattgacagaatcggtacgtgaaagacgttttccgaaagcaccatacatatataagattggcgcatttgctggaatggcttctttacaacgttctacacgatagagaagcgcatctttcatgatttccaaacggtcagacaatagctgccagaatttgttctgatctccttttgattcgatcgcgattcttggtaaattcaatgtaaccacacctaaattcattcgtccaacatttacttcttgaccattttcgtctttccatccttgcaagaatgaacgacagcccataggtactttgaaacttccagttaattcgacgattttgtcgtaattcagaatatcaggatacattcgtttcgttgcacattccaatgctagttgtttgatgtcgtaattaggatcttcagggtttaagtttacaccttttttcaaagtgaagatcagtttagggaagatagctgtgcgcttttcactccctaatccattgattcggatctgtaaaatcgctttttggatttctctttcaaaccagttttcccccaaaccaaaccctaatgaagtgaaaggggtttgcccatttgaagtaaataaggtattgatttcatattccaaactttgcatagcatcgaagatatcttttttggtttttgcttttgcatattctttttggcgttctggcgaatcgatccattcttccgcgtcttttagatgttttttatagttcaattctgcaaaaggagccagcaattcatctgttcggtcggcagaacagccaccatattgacttgacgcaacattagcaataatctgtgagatttgtgctgtcgctgtctggatagatttaggtgattccacttctgcatttccaattttgaaaccgttgttcagcatacctttgaaatcaatcaagcagcaatttgtcatcggtgtgtaaggatgataatccaaatcatggtaatggatatcacctttttgatgcgcatttgctatatgtggcggcaacattttcagtccgattgattttccgacgatgccggctgttagatcacgctgtgtattgaaaacattactgtctttatttgcattttcattcacgacagtctggtctttgttgattagtttttcaatcgaaaagttgatatctgtcgctttactacgagcaaaatcccgttttgtacggtaattgatatactcttctgctaattcatattcgtttttttctaataagatatgttccacgatgttttgaatctcatagattttgacattttcagcaaaccggcttttgatttcttggacaaccaagtctgcaatcatttggattttttcgtaagtaagtggggataatgagccgtgaattttcttttcagctttgattagtgcttcgttgatcttttgttcatcgaaatcaacatggcgaccatctcgtttgataactttcatctggtgtgcctctggttgctgagtaacgactgttttctcttcataatttactttcattatcttcaactcctgctaaattgttcttgtctatcataaaacaaaatttaggaaggagcaactaattatcagctatatatagtattcaatccgttgtataattggatttctatactatatgtagtgtatattttattgtgaaaaaaagtgaaaacttgtagttgatggatttattttttgcatatttaatttagctgaataaaataattgaataaaatttttttatttgggctaagaaaaagtgacaaaaacataagagcaaattgttcgtagatatgctactatgcaaataaacagaaatgaaagaggagaagaagaattggaaaagatgatcgaagtgaaacatctcagtaaaagctacggtagcaaactttctcccgtcaaagctttagataatatctcattcacagtcgaagaaggcgaatttgttggaatcatgggtccaagtggtgcaggtaaaacgacgttgatgaatattttatccacgatcaatttgcctacgatgggtagtgtcttgatccaaggaaaagaaataacaaaaatgaaaaatagtgagctgagtgactttcgtcgaaaaaaactaggattcatttttcaagaattcaatttgattgatactttaaatgccaaagacaatatcctattacccctagcagttgaacggatgactaaggaagagatggaaaagagagtaagacacgtagctcaattgttgaatatagaagaactgctaaaacgatatccagatgagctttctgtcggtcagcgacaacgaattgcagccgctagagcccttgttgttcagccacaagtaatctttgcagatgaaccaactggatctctagattcgaagtcggccacagaattgttgaattatttacagactatgaatcaaaaagaaaaagcgacaattttgttagtcacccatgacccatatacagcgagctactgtgacagaattttatttattaaagacggcgtgattttttcagaagttgtgagaagagggacaagaagggaattctttgaaaaagtaatcgacatgcaggcgacgattggtggaggaggaaaaatgaatgctgtataaactagccgtcaaaagtttttttcggcagtcccgagggtatcttgtttattttttcagtttgactttatccgtgatgatttattattcattcagcgcaatgacctatgatcaatctttagttagaagagcaagtccagatacttcgatagatggcggattgagttttggcggactgatcattactgtcgttttactttttttcgtattcagtgccaaccgattttttttgaatagaagacaaaaagaaataggtatctatcaactttttggtatgaacaaactacaaatttcaggcatatatgtgttggaaatcatgataatcgggttatttgcctgtatttttgggatattgctcggtattattttctccaaactcttttccatgattttggttcgaatgatggatatggatcttaatagtccgttttttatctccattccatcagtcgcagatactttatttgcttttttcatcatccttttagcagtatctgtgtattcgatatggaaaatctggcgctacccgatgattcgaagttttggagaaaaagaacaagcagatagttcaacgatgcgtttcagaacaaggcatcgattactcgctgtcattgggttattgcttttaacaagcggatattttggggctagtcattttagagaaatcacttcatggatggtcagtcatcatgaccttgagacattcattctctttttgccttttctgatctttttcatttgtgtgattggtacttatttgtttttctgctatacatttcggctctttttgatcatattgagtaaatggaagctctattactatgggatcaattttttaataataggtaatacacaagtgcacctgctcaaaagctggcgtacgaattctctaattacagtcattcttggaatttctttaatgacgattggcggtacggctagtatttctactattttatcgtatcaggagaaagtatcctccccgatggattatcagtttgatgtcgagacagaaaaaaaaatcaagcctattctggcagaggaaggacagaagataactaaagaaatcaccttgcattataaagtcataggtagtatctacagaccagatctcgaagaacctatgtttcaaactgctaatctgatctcagaaacagaatatcaagccttcagaaaagttaatccggatttgccgaacgtttctttgaaatctcctaaccatactgttttgcttgatcaaatgcaaactctttttcggaatatttcattatatggttctagtattggattgccagataatcaagagttgaagattcagcaaatgcttccaagtgtattaggtgacgaaacgatagtatatctaagtcctgtactagtcgtggatgataacgtttttgaaaaagcaaaaggtgtagattatcaagtagtcaatgtggatgtatcaggtggaaataatgaaaagatagatgaacgattgagcagtgaaatgtcgataaagtggctcaatgctatttattattcttatgatatcgtaaatgggcgtctgcaaggagacattagtacaaagaaactgccagatgacaaaatgaaggaagcgcagtttagtcaagaaggttctcggttgaacttctcttccagctattcaaaattgcgtgcagtcaaccggcggattggtatcaatatttttgtcacactgtttgtcggaatgatcgtcattattgctactggcagtattctgaccgttcgacaattagcagaagcagaggaagaaaaagaaaattatcacctattaactaaactggggataccacaaagaagaattagaaggatgattttcgagcaaaacgcacttaccttttttccacccatgatattaggaatcactcatgcagtatttgcaatcaatgttttcactcagtatatcaaaactgccgattattggctggcttatcttgtcagtggcttattgatccttatctatcttttgctttatgtcattacgagtcagttatattgtcggattatcgaggaatgacaggcggaataagacaagataataaaaagtactaaattttaaacaccgtttaaataagaggttatgaaaaagctgtcctgcatcaaataataagaaacagccaagcaaaaatagtttctcatgtttttgatttggctggacttattaccgcagatgcaagcttttaaacaccatttatttggaataagaggttgtgacacgtttttgtcacaacctctttattttttatattttttaaaattactagaaattataaagaaaaaagcagtgttttgatgtgctatttttataaaagctatgtgacaaaactgttagtaaaaaaacggtttctgtaagctagacacatgtttctttttgtcaaaattcgttacactttgtgtgaggttatatgaggagggaattcaatgaataaatggtggtctaatccaaaattgaattattggggaaaattcatcattcgaacaattttttatagtgcggtactgctgttcctaatctacctgtatcactataaaaatattcaaggaggaacatttatctataacgaattttaggaggaagagtatggaaatcaaaacgattattgaagcaatcgatgattggggaataagcgaacctgatcgaattgcttatcaggcggatgagatgcatacttttggagaattgaaacaagcatcagacgcacttgcttattatttagaagaaaaggtagaaggggatggaccaatcgtcgtttttggtaatttagaatttgagatgattgtcgcatttctaggaattgtcaaatctggtcatgcttatttgccaattgaagaacatacacccaaagaacgtatcctgtcgatctttcgggtggctaaaccatctatggtcatcagtattgggaattggatagaagatattccttctgttcctgtcgtaacaaaagaagaatttcaagaaatcgagaagataccagtagaattttatcccaaaaatagcgtaaaaggcacagaaaatttttatattatttttacctctggtactactggagaaccaaaaggcgtacaaatcagtcatgataatctagtcagctttgttcaatggacgatggaagactttgggatcaagcctgggatgcatttcttagctcaagcgccattttcttttgatttatcggtattttctatttatcctgcattagtttctggtggaatgctgaagccgttaaataaagcagttattcaagattttcgtcaattattcgcgacattgcctaacttgaagttgaatatttgggtttctactccatcttttatggatatttgcttgatggagcctaccttcaatggagaaaatgtaccagaattggacatgtttttattttgcggagaagaattgacaaaaaaaactgcagaaacactacttgatcgattcccaaatgcacggatatataatacttacggcccaacagaagcaactgtggctatttcaagtatccagattgatcagcacatactagataaatacgaccgactaccaatcggctatgtaaaaaaagacaccaaagtttctattgtccaagaagacaaacttgtttcaaaaggagaaactggcgaaatcattattgcaggaccaagcgtatcaaaaggttacctgaacaatccagaaaaaacagcagctgcgttcttttgtcaaaatgacttagcaagttaccatacaggggatgcaggaaggttggatgaagatgggcttttattttatgaaggccgtatggatcagcaggtcaaattgcatggttaccggatcgagttaggggatatcgaacattatctgttgcaagactcccggatcaaacaagccgttgtcgtaccaaaatatcaaggaacaaaagtgcagcagcttgttgctttcatcgtattagaaaacataacgaaacaaccggattttcaactgaccaaatcgatcaaagaacaattactgcaagttgtgatggagtatatgattcctcagaagttccattatgtcaatctgctgcctcagacagtaaatggaaaaattgatcgaaaaaaattaacagctgaggtgaatcctgaatgatgtttcctcatatgatcccttacgcagagccgttttatttttttcttttagccattgcgcttataccaatcgttctatctttattgatatggaaaaaaagattaccaatttatcaatcagtggtgacacttttctttttatttgtcagctttggaggtacttattgggagcagggaacggcgctgatagggtatgctttttggcagacaatccttgtatggggctattttgttcaccggcaaaggaaaaatcaaacaggatggttttacgccgccgttattttagcaataattccactgtttttaacgaaagtgactcctttttttgaacatggaaaagcatcgctgcttggttttttaggaatctcttatttaacctttaagtctgtgcaaatgatcatggaaataagagatggcatgatcaaagtatataacccatttcgttatatccagtttctgctgtttttcccgacaatatcttctggacccatcgatcgttataggagatttgaaaaggatcagctccatccacctgttcgtgataaatatgttgatctcttgggaaaaggcgtccaaaatatttttgtcggttttttatataagttcattatcggttattattttggtcaagtactgctccctgtagtagggcgcatcgcattacagcatggtgggatttcatgggcgttagtgggttacatgtacgtgtatagcatgtatttattttttgattttgcaggttacagtttgtttgcagtcggtacaagctacatgatggggtatcagacgccaatcaatttcaataaaccatttttatcatggaatatcaaagagttctggaaccgatggcatatgaccttgtctttttggttccgcgattacgtgtatatgcggttgatgttcttcatgatgaagaaaaaaatctttaaaagcaagatcgtaatgtcaaatattggatatttcgctttgtttcttctaatgggtgtctggcatggattgacgtggtactacatcgtatacggtctgtatcatgcttgtctgatctgtctgacagatgcatggatccgatttaagaagaagcataaagatcagttaccttctaacaaatttacgcatggcgtagccgtatttttgacatttcaagcggtatgtttcagcttcctgattttttcaggatttttagataaacttttttttagctaacgaatagtgacatattaatttatataacaaaggagaaaaggaaaatggaagaacaaattttatcaatcttagaagaaataacaggaacagatgaagtaagaaaaaatcgtgatattgatctatttgatgaaggtttgcttgattctttagcatctgtgcaattattagtcgagctagacggagagttggatatccaagtcccagtctctgaattcgagcgggaggattggtgcacaccgaataaaatcattcaacaagcaactgcattgaagggttgagtatgaaaaagaaactctttgctatttttggacctgttgttctcgcttttggtctgcttgccctatttttcacttcttcctatcgagtaaatattgataacccggaagtaatcaagcgagcgtcttcatctatgtcagcaaatgtactaaagggcgatgcaataaaaaacaaagctttgtctgaaaaacaatatatccccttttttgggtcgagtgaattaagcaggatcagtccattccatccgtctgttttggctgaaaaatatgatagaggttatcgtcctttcttgctaggagcgccgggaacacaatcattaagtcaatatatgatgatgcgatctgcaggggatgatttgaaaaacaaaaaagtggtgtttattatctcgcctcaatggtttgtaaaagatggtgtaaaaacagattatttcaacacttactattctgaacttcagacctatgattggttgttctcattgaaaaaagtcacatcagctgatcgctatttagctagaagactattaactttttcaaaagtaaaagagaacgatacgctgacaggaattctacaaacgattaaagaaggaaagttacctttacctgaatctttggatcagttgcacagccaatggaacatgttgaagcgtgaggatgagatattcagtgatatcggtttgaaagatcgtcagcaaaaaatcgatcatgaatcaaaacgattaccagaccactatcaagaaacagaattatccattttggcagataagattggaaaacaagaaacgacaaataattcatttggtttgaaaaacgatttttacacacatcgtatccgatcccacgagccagaactcaaacagtcacaaaaagattgggattatcgtttttcaccagaattttctgattttcagctaatcttggatcaattagcaaaaaatcataatgaagtgttgtttatcattccaccggttaacgagaaatggagcgattataccggactatctcaagaaatgctacaaggatttgccaaaaaaatcaaatttcaattaaatagccaaggattcaatcgaatagctgattttgtcaatcaagctggtaccaattattttatggaagatacgatccatttagggtggaaaggctggctagccgcagatcaacagattagaccgttcttagaagaaaaccagcttcctagtaggtaccatctcgatgatgcttttttcagcaaaacttggcaacaacaagtaccagataaactacgattaaaataaataaaacaggtggaggatatctgcctgttttatttattttagaatattctgaaataaacagtaaaaataccaagttagcctgaacaaaaaacaaaagcaatggtataatcacaatatgaatatagaaatgggggaaaacatttggatacaaaagaagaacagctactaattgatttgacttctgcaaaaggagtacctgggaatgaagaagaggtaagagaagtattcagagaatatgctaaaccattcgctgatgatattttttatgacggattaggcagtgtgattgctaagcatggcgctggcggaggaccaaaagtctttatttctggtcatatggacgaagttggttttatggtaacaaaaataaccgaaaaaggcttcttggaattccaaacacttggaggctggtggggacaagtgatgcttgctcagcaagttgaaatcaaaacacgagaaggaaaaatcattcacggagtaattggttcaaaaccaccgcatgttttaacacctcaagtaagaaataaaccatatgaaatcaaagatatgtttattgatatcggtgcatcaaaccaagaagaagccaaagagtggggcatacgtccgggagatatggtcaccccatatattgaatataaacgaatgaacggcagtaagtatttgctggcaaaagcatgggataatcggatagggacagctgtttctttgcgagtattggagaatctatctaaagaagcacatccaaatgttttatttgcaggaagcgatgtgcaagaagaagtgggcttgcgaggcgctcgaacaagcacgcaccttgtaaatccggatattgcttttgctttagatactggtacagcaggtgatactccaggaatgacaccaaaagaagcagattcggttttaggaaaaggtccacagattttgatttttgatgcatcgatgattccgcacaaaaaattattgaatttcgttatcgatgtagcagaggaaatggctatcccattccaatatacagtgatctctggcggtggaacggatgcaggacaaatgcatttgacaagagacggcgttccttctgtagccattactgttcctgttcgttatttgcattcccacacatcagtgatccatgaagatgattatttgaatacagtgaagctagttactgagttagtgaaacgacttgatagtgaaacagttgaaaaaatccggagttatgaataatgaataataaaatgcctatttctgaatatcgaaaaaaagcgcgagcttctttggagaatcaatggggaatcaatgcttggcttgttttcttatccatattgttcacgagcgtcatacagaatttttttgacggtttcagtccttttacggaagaaagcatgcagcaaaacctattgagttttctagtcgataatttgcttttattcgcattcaactatgcattgttttatattgcgttagtagttgtacgaggtggcagaccaaaaagcaatcttctattttcagtttttcaaaaaaaatattttggttcgatacttgtcatcaatttgattaattcaatcatcaactggttgctcaacagtttgatctttctgcccatgtttttaatcagcggagtgagtgcttatacgcagttgcttttcaattcaagtacggtacctacggatgtcatgccaggagattttcttgatatcagctttgttttatcaacggtagggatgatttttgtttcagcacttatcatgagcatcgttggcggattgttccaatttgctgcatggacgaagttcgactatcctgatttgtcggtcgtacaatgcttaaaatatggctggttcttattgaaagatagaatcggtacgtatattttgttgcaactatcttttatcggctggtatttgttaggggcaatcgctttattcatcggtcttttgtgggtcatcgtttatgtgaatgtatcagttgcagaattttatgaacaagcacggattgaaaaaggtggtccagaagcctattttgcttaatctgtaagcagtttattcattagaaaaataacttttgtggtaggataaatctttgagggggaatatatgatgaaattaactgttttaggctgcttaggggcgtatccttataaaaatcaagggacaacaggttatttacttcaatctgacggtttcaacttgttgattgatgcaggtagtgctacgctcatcaaattacaagaacatcttgatccacttgatttggatgctgtgatccttagccattatcatcatgatcatattgctgaccttggtgtattacagtattactggcaacttcatcccaagagagatccggagacattgctttcaatttacgggcacacaaaagattctgtccactttgaagaattgacgatggcgaatgtctcaaaaggacatccttattttgaagccgaagaattaaaaattggtccttttctgattacttttatggaaacaatccatccagtagtatgttacgccatgcgaatcgtagaagaagcaacggggaaagtattcgtatttacaggagattcaggttatttggaaagtttcgctgattttgcgaaagaggctgatttgtttctagcagatacctatctatttgaaggaaatgaacatcatcatgcacatttcacttcaaaagaagctggagaactggcgaaatcagctaacgtaaagaaacttgtacttacccatctacctcagtttggcgacttagaacaattgaaaaatgaagcgcaaaaagcagcaggtaaagggatagatgtagagcttgctgcagttgacaaagtgtttgacatttaggaggaagaacatgatttttgtaccaaatgaaaaccacgacccaagaatcaatttagcaattgaacaatacttgttgcaagaaatgccattagatgaacccattttgctcttttatatcaatgaaccttcaatcatcatcggtaggaatcagaacacgattgaagaaatcaatcgagattatgtggaagaacatggtattcatgtggtccgccgtctaagtggaggcggagctgtctaccatgattttgggaacttgaactttagttttattatgcctgatgatggtgattccttccgtgattttgcgaaagtaacacaaccaatcatccaagcacttcatgaattgggtgttgccggggctgagttgaaaggccgaaatgatttagtcattgatggtatgaaattttccggtaatgcgatgtatgctaccaacggccggatgtttgctcatggaacgatcatgttcgactctgatatcaatgaagtagtcaatgcattaaaagtaaaaaaagacaaaatcgaatcaaaaggaatcaaatcgatccgttctcgtgtgacgaatatcaaaccgtttcttcccgaagaaaaacaaaaaatgacaacggaagaatttcgtcaagaaatcttgttgaaaatttttggtgtagaatcagtagaggaagtaaaaacatacgaattgaccgacgaagattggaaaaaaatcaatcgaatctctgaagaatattaccgaaattgggattggaattacggaaagtccccagatttcaatttctctcgtcaaaaacgtttctctatcggttcgatcgaagtccacttgaatgtatcagaaggaatgattaaagaagcaaaaatctttggtgatttcttcggactaggagatatctctgatgtcgaaaaaaaattggtgggacagaaatatgataaagaatctctatcaaaaatagttgaccaaattgatgtgaaaaaatattttggtgcgatagaatcagaagaattacttaccttactttattaaaaacaaaaagcagcggaatccttatgtattggattccactgcttttttatatagaattcgagtaatttcgggaaagctgaacagtgatccgatcaatcaatgtatctttttcctgcgttagtgttccagtgtaacgatctgccacatctttcatcatcatcaaatcaaagcgttcctgatcatctaattcttctgtgatacctcgactaaatatattcgtatcataatgtgcactatgttcgcaacaaatgacgaaatgattctcttgctcatatatcgacaaatgaatttttcgatacagcggattttcgatggcatgagtttctctaaaggaatgctctagggcatgaatcaaaagctgggctagatcatcatctttgataggaagctcctccggaagttctgcttcgaagatgatctggatattccgtttatcagctaactgttgatagcgcgcgaaaatcagatttgtcatctgatgattgcaaaaagaacacagcatttcaaaattttttgcttcttccaagattgtttccacatatttttttgcttttacttgatccgtatgcattaagtcttgcagattttccatttcctgaacaaattctaaacgaagcgtatttacttcttggatatgctgtcgcagttgctcataatgctgttccagcaaatcgtttttgatttttaagaaatctacttgtcttcggtctttatctgtgttcagaatgtggtcaatcagattgtaactgataataacaatcaaaataataatgaataaaatcgtagaccaattgatcgtcgtttgataaatacctagtgctgtttggatataaatcaagcagtggataatggcaaccaagacgatccaaggtgtacaaactacataaaaacgattgttcttatatgcttcaccaatgcaggtaagcgaagtgactagagtactgataacactagctatattagcaattggcatcaattcaggaagttcagcagaagtaaaagctgcataaagcagaacaccagaaaagatcgaaagctggattatacaaaaaatcccataccattttttataataaatcatccggctccaataatagcagataatgaaagacgaggttaggataataaataaatgagataaaaaagagtgaacgaatggttcaaaaaggatgccacttaaaatatcttctgaaacagcttcaaatcctaatgccaaagcaaagcagcttaagataatcagcgagtattcaagccgtttttgtttgtacatcaagtagatagtatagataaacgtcccaatagcaatgaaaactgcaatgatcatcgttaatacttgtggtactgattgagaatagataaaaccgattaacggaccagttgtacccagatagactttcggcggtaacccagcgtagttctgataaggagatgagacagagatcatcaatttttttccgatgtaatctgatggtaaatctatcacagccagtgatagtccagggttgctttctgcgtcgtaatcttcccgttggtataaaatgtttccgtttagatacacagtaatccattgatgatttcctttgattagtaaatttgcttcgttcaacggtttctcaagtgtcgtttccataataaatgtttcgtctttgtctacggtaggaatcgtacgagtgtacttgctgtcaaacttaaaatcaggatcatcttttgaatagaaaacccatgaatcttttatttctttcatttgattactattagcaggagagaagataaaatagaagaaataagcaatccctgctaaaaataacactgataatataattattatgctccattttatgcgcatatagaaagattcttttttattatatatgttattaaaaaaagccataaaggtattcctttctaaaacttgtaattttagggtaaacgtttttttaactatcgtcaattatttataataaaaaatgagataaagatgaggaaatagaatcaaaaaacgtcgttgtcataaaaatgtgtttttacagttataatttgaaaaaaatttatcgttattatatgattaagaaggattgaagaaagaaaggagctgaaaacgatgcctgattataaaaaaataacttttgttagttctataacactgattatatttttaatacttattcttctcgtcgtcttggttccccgaatttttggattgactccttacattattgaggatagagaaatgaacccatattatgcacaaggaaatctgatatatgtacgaccaaaaaatacagatgagattttagtcggagatattattacatattatgaaaattcaggtaaaaaaatctcgacacgtcgcgtaatagccattgaaaacaactacaacgacttttatacaaaagctgacacacggacttatatcgagcctggagtagtaaaaaagagaaatattatcggtagtccaatcttccagattccatatattggtctggtcctttcaaaaacagcatttgcatggatccaggggttattctttacgattgctttttgcttaacaggaatcacagcttggaatacttttgtagagttgaagaagaagcggagacgaacacataaatttttgtgagaatgttgaaaaagacaaatatattcaagagataccactactcttctgaacgagtgatacggaaaacactaatacagcttgtagatttagctagttgttcgtataatgtgtaaagaggaggagtagtatgcgcaatgaaatgatgcatcgtcctgtagtcaaagaagaactattggactttatgcgtacccagcaaaaaaaattaccgggtgagctaggcaaattggaagaagaagctcatgtagcagaagtaccggttattccccacgaaacagttgtatttttgaaatttttacttggacaaattcagcctgaacgaatcttagagatcggtgcagctatcggtttttcatcaagtgtcatggcgacaacaatcggagaaaacgctcatgttacgaccattgatcgtttcgatgtcatgatcgagaaagcgaaaaaaaactatgaacgtctaggattgacagataaagtaaccttgcttgaagggcaagccgcagatattttgcctgagttgtctggtccatatgactttatttttatggatagtgcaaaatcaaaatatattgaatttttacctgaatgtttgcgtttgttacgaaaaggtggcgttttgatggtagatgatattttccaaggagggacgatcttgctccctgatgaagagattcctcgtggcaaacgagctatccatcgtaaattaaatgaattccttcgtgtcgtgatgaaccatcctgatttgacatcgaccatcttaccattaggcgatggtgtaatcttaatgacaaaagaatcagaagaaatcgatttgtgatacatgattatgacaatcagtaagtgattgattatatcaaggaatccatctaaatttgatgtgaaagagactgtatttgtaaaacaactgaaggaaatagtgaatagattgaaataaacaggagtaagcatgaagacaatgcaactcctgttttcgactgataaccttagaatagatggaatcgaatgtgtcttttcaaaggattgatttggtagttgaattaaaataattggctatttgctaattaaataactatttcgtattgacagaagcaatttaattatctataattattgatgttccgctgattcctgtcatagtagctcagctggatagagcatccgccttctaagcggacggtcgggggttcgaatccctcctgtgacgctaaaaaaccggtagaaacctcagtttctaacggtttttctttgttttttgtgccaatattgtttgttttcaaaggcaaataaaataaaaaaaacatctttatctagtacaattataggaagtaaaaataaaatccatcagaaagaggaagcaaatatgtcaatgttatcaaaatttttagtcactctagtggccatcgaatttttttatatcatgtacatcgaaacagtaagaactgattccgatacgacaagcagagtttttaaaatgaataaagaagaattaagcagaaaatctgttcaaacattatttaagaatcaaggagtatacaatggactattaggagttggactactttacggagcttacctttcttccgcacctaaagaaattacaagtatgctgttgctatcaatttttattgttgcattgtatggaagtctgactagcgatcgttggattttactaaaacaaggtgggttagctctgctggccttgctttctattttcttctaaatgtagaaaaacaaggatttattggacaagaaactttgtgaaaaatattactttatctcatgaaatatgctattctaatgaatggtattttagaaaatttcatgaaaaggagttagataggtgttcaaaaattatgttttatcactaaaaaaagaattttcaggttatgatctttcaagatttcagaaagatcttttggctggaatcacagtagctgctgtagcattgcctttagccttggcttttggggtatcaagcggagccgatgcgtccgcaggtttgattacggctatcattgccggtctcgttattggcggtttatcaggcggtttttatcaaatatcaggtccgacaggcgcaatggcagctattctaatgtctattgcggcaacaaagggaatgcaaggtgtgttgcttgctacttttttggctggtctatttttacttgtagcagggcttttccgattaggaacactaacttcttttatcccagcacccgtaatcacaggatttacttcaggtattgctattattattgcattaggtcagatcgataatttatttggtgttcattcggaaggtacaaatgttattgaaaagctaagtagttatcaaacactaggttttccaataaacatagcatctttgattatgggaggactagtcattttagggatgttcatctatccgaaaaaatggtcgaaacgaatgcctagttcgctgttagccatcattttagcaacagtagttacgctactgtgtcatttaccagtagacactgttggtaacatcccacaaacattgatcagcagtaatcgcttgggcttgggagattttagcttttctgccttgcaacaagtagcagttccggctattagcattgctctgttagggatgattgagagcttattatgtggtgcttctgctggtcgaatggcaaataaatcattagacagtaaccaagaattagtggcacaaggggtgggaaatctattgcttcctttttttggcgggattcctgctactgcagccattgctcgtacaagtgtggccatcaaatctggcgcacaaaccagattagctggcatgatccatgcagttgtcttgttgctttccatgcttgtttttgcgccagtgatgtcacagattccgatgccagcacttgcaggtgttttgatcgtgacggcttggcgtatgaatgaatggagaacgattaaggagctatttgttcataaatattggtcagctattctattgtttgttcttacaatgatttgtacagtgatctttgatttaagtattgctattgtaattgggattatcggcggttgtgtattttttgttgtaaaaagtgcggctatcacgatttcattagaaacaatcgattggcaaagaatagggctgccagaaacggaaaagctgaataattggacagtagtgtacattagcggtccgctgtttttcatgtcttcagagaaactaaaaaataaattggaagaactaaaccatcacgacggtgtcatcttctccatgcgtggcgtaccaagtattgatttgacggcacgcgcaatttttgatgaatttcaagaaaaagcagaacagagaggacaaacgattatctatacttccttgcagccggaagtagaaaaacaactttctcacttatgggaatatacatccacacatcaacatcaaacagttgcccatgcgttgacagcattgcatgcgaaatatactgcaatgagccattaaaacaatgaaaaagaacagacaagactgtaaactaacaatttcaccgtcttgtctgttctttttaatcttgttgtaaaagtgaagctagtacttgccaatcttgatggataacaggtacaagggaacgattatagaaaatagctgctggatgaaaaagtggaaggatacggtagtttttttctgaccattcgtaggcatctttttgttttgttagctgtaagacgggacctgtatagagttgaccatggtttttggtaacagtatattctttaccaagtaatcgttgcaggccgatatttccaagtgtcgcaattaattttggctggacttccatcagttcgtaatccagtatcggtgcgtgtgcaaatacttcggatcgcgtaggtgtacgatttggataaacagtttctgtctgttgtgtccgtttattgatccgatgggtcacgcgatacgggcgactccgtacagcactggtgatatagacatcttctcgtgttaaaccagtggaagaaagtgcctgcatcaattcttttccagcttgtccgctaaaagggatgtgtgtatcaatctctgtttttcctggggcttctcctacaagcattaatttaggatgaagaggtccttgcccagcgacaaatccttctacaggacggccgttcatccttaaagaagcctctagtatcaattctgttgggtattccattcgtgctcctcctttttcttttattataagaagaaaagaaacacaatgcgactattttatttagcagaaacgaagaggaaagaaaagcaggagcacgattgtttaaatctttatttcattttttgactttaaatttagttgacgaacagcggctgttctggtaagctagtactgttgtaattgtggactccacagctacaaccgctcagaacaagtaataagcacagcagatgctgtcacttcggatggcgagtctaagtatatcagaaggaggtgctttatagcatgtacgcaattattaaaactggtggtaaacaagtaaaagttgaagttggacaagcaatctatgttgaaaaacttgacgttgaagcaggagaaaaagttgtttttgacgaagttatcttagtaggtggcgaatctacaaaagtaggcgctccaactgttgcaggtgcaactgttgaaggtactgttgaaaaacacggcaaacaaaagaaagtcgttactttcaaatacaaacctaaaaaacattcacaccgcaaacaaggtcatcgtcaaccatatacaaaagtggttatcgaagcgatcaacgcttaatcagcgtttgagaaagaaggcctatatatgatcaaaggaacatttaagcgaaatgacgcaggtcagatcgtttcattcactttgaccgggcatgctgatgctggtccttatggaagtgatatcgtttgtgcaggtgtttctgcgttagcgatcagcactgtcaacgggattgcctcattagccggttttgaaccgattgttgaaatgaatgaagaagaaggcggttatctttataccgaagtcacttcaggaatgacacaagaacaaaacaatattgctgagattctattagaaaatcttttattaggtttacaatcaatagaagctgaaaactcagaatatatccaaattaaaacaatcaatgataaataggaggtgcagaccatgttgttatctatgaatctacaattatttgcccacaaaaaaggtggcggttctacatctaacggccgtgactcagaatcaaaacgtctaggtgctaaacgcgctgatggacaaacagttacaggtggatcaattctttatcgtcaacgcggtacaaaaatctatccaggtgtaaacgtgggtatcggtggagacgacactttatttgcaaaagttgatggcgtagtacgtttcgaacgtaaaggccgtaacaaaaaacaagtgtctgtttatccagtagctcaagaagcttaattgaagcttgcgattaaagaggttgtgacaagatttttgtcacaacctcttttttgtttataaaaaaagttggaatgaaggatgcgaaggttgccatgtctttttacgcttaagatttttttgccattttgtaatcagaatgttttgataactattgtttttattgatgaaagcgatatcgtttgctatcagcagcatcattgtaggataaatagtgttctttttcttgtttccgatataaaaatggagttgatattttgtgttcttttatcttcattacgcttgtcccttcgcttgttgtcaacgaaacaaaatcaggtaaatagttgacgaaacggaaataaatacatagtattatgttttgaagcctaagaacaacagtctatagaaaaggagcgataccattggcaaaacgcatggaccgaatttatatgtatgtcaaagaaaaaaccgctcatttaacaaaggcagaatatgaccaaggagtaacgacacaagaaattgctgaagtgttaggaatccaaagaacgaatagcagtaaagatctgaatcagctagtgcgcgaaggaaaactgataaagacagatggacgaccagtacgttacatatatcaaacactcgctacgcacgtaaagccagctgcaaaacatgtggtcagttacaaagaaacgccggtctctgaagaaaaaaatacgctccagatagatactaaggatatctttgcaaaaatcattggagctaatggtagcatgaaaaactcagtggaacaggcaaaagctgcgatcttgtatccgccaagaggattaaattgcttgattacaggacctaccggatcaggaaagacttattttgcgcacgcgatgtatcattttgccaaagcacatcatgtaatagatgaggaaacggaactgattgttttcaattgtgctgattacgcgaataaccctgagcttttgatgagccatttatttgggtatgcaaaaggagcctttacaggtgcagatgaagaaaaaatgggaattatcgatcaagcggatggtggtatgttatttctggatgaaattcaccgattgcctccagaaggtcaagaaatgatcttttactttatggatcacgggacttacagtcgacttggagaaacaacgaaatctcatgaagcaaatgtacgaatcgtaggtgcgaccacagaagatccaggctcttcgctattggaaacttttgttcggcgtatcccaattaatatcaaacttccggcttttgaaaaacgccctgcaaatgagaaagtcgatttagtaaaaattatgattgcccacgaagcgaaccgcacgcaacgaaagatctctttgacagaagatgtagcaaaagcactgattggcagtgtgacttatgggaatataggtcaattgaagtcgaatatccagttagtatgcgcacgaggatttctaaatcatatgcaatctcccgaaatatcgattacgattgatgatttgacagaagggattcgtagcggattgattcaattagcaagcaaccgcagtgcaatggcagagctttctaaaatattggagccaaagataactgtagcaccaaacgatacaatcatgaaaatccaatcagactcctatgaattaccttataatctatatgatatcatcggagataaagcagctttgctgaagtcggatgggttggaccaagaagcaatcaatcactttatttctacagatatcaacatccatctgaagtctttttataaagaccatgggttttcttttaatgcagatagcaaattagcagaatttgtagatccaaaaatcatagaagtgaccaatcagatttatgtaatggtcaaaagatctttaccatatgactttcagcaaaactttatttatgctatgagcttgcatatcagttcgtttttgaaaaagatcaatttaggagaagaacggcatacgaatgataatatccgtgagatggcatttgattttccagatgaatatgctgttgcgaaagaagtgcgtagttatatagaaacgtattttcaagtggatattccagaaagtgaagactactacttgactgttctactcgtctcgttacgggcgaaccaagcaagcggcagaatcggtgtagtcgttgcagctcacggaaacagtacagcgagcagtatggttcaggttgtccaacagttgttagatgcagagaacgtacgagcagtagacatgccgttggatatggatccgaaaacagctttagaccgcattgaaggcaatgtacaagaagtagatgaaggaagcggggtcatactattagtggatatggggtccctcgcctcatttaattcgcaaattcagcgagacaccgggatacctgtacgtaccgttgacatggtaacaacttctctagttttggaaactgtacgaaaggtctctgtattagggacagatttagatatgttgcatgaatcattgaagaattttcgaggttacgcagaaatatcttctgtagaacctgtccaggaaacaaaacctatccataagaaaaaagctgttttggccatttgtgcatctggcgaaggtacagcgcaaagaatcaaagaattgatcgaacgagcggtaaataagcgtcaagaaacagaattagaagttctagctttgtcgattgtggaagtgaaagaagaattgccagttatccaaaaagaatatcagatcatagcaactactggaattactgatttgaatatccaagcaccatttattcctttagagcgcttcattgatcaaaatatcgaagtcattttggatcagttgcttatggaatcagaaatggaagaaactgaattcatctcgctagatgaagagacagctaaaaaaacatgtgttgaatttatctctgagaacttcatctttatcaatggtagtaaactaattgatccaatgtggcaattttctacacaaatctctcagacgatgggaattggcaatgaagaatatggctttaagatcaacttagtgatgcacacagcaggaatgatcgaacggattattcgaaatgaaacgttgatggtggaacaaaacgaattaacgaatataacgagtgatcctctttataatcaattaacagcctcggttgtcctgctagaagataagataaaagtaaaagtgccaatagaagaaatgtattatctgctatgtctagtgcataatcagctagataaaaaagaatacactatgccttaaatacacaaaaacgatacacttttatagtgtatcgtttttgtgtattggttaagaatcctttaaattcaattagtgtatcacaaaaaaattggcacgctttttgcttatagtagtgtgtgctaggaggtggttgttcacacagaaatgataggggtttctgtgaagtagtgaggaagaaggagttttgcagatggatattcgattggcacgtatagatgatcgtttaatccacgggcaggtcgcaacagtttggtcgaagcaaacaggtgttgaacgtatcgttgtgatcagcgatgtagttgctcaagataaattgagaaagtttctattaaaagaagctgcaccgccgggaatcacagcaaatgtaataaccgtgcagaaaatgattcaaatctatcatagtggactattatcacgagcaaaagtgatgcttttattcaccaatcctcaagatgttgaagcggttgtccgctgcggtgtacagttgaagtcgttgaatatcggcggtatgagttttactgaaggcaaatcaatgattaccaattttgtttcagtaaatcaacaagatattgattcctttcgttacttgaacagtcaagaagtggagttagagattcgaaaagtacctgctgacaggaaaatccttttgatggaactactagcgaaaatcaaaaaggtgtaacaaaaatggttgttggaaaaggtcaaataattctgttgtaatggttagcaattattaatatttttgaatttgttacaacaaaagtaaataggaggtataaatatggtagggattatcctagcaagtcatggacaatttgctgaaggaatcttacaatccggttcaatgatctttggcgaacaagaaaacgtcaaagccgtgattttgaaaccaagtgaaggtccagatgacttgagagccaaattggaagaagcggttgcttcttttgataatcaagacgaagtgttattcttagttgatttatggggcggaacaccgttcaatcaatcaaacacattattcgaagagcacaaagataaatgggcaatcgtcagcggtttgaatttgccaatgttgattgaagcctatgcatcacgattttcaatggaatctgctcatgaaattgcagcgcatatcattgaaacagcaaaagatggtgtaaaagtgaaaccggaagaattagaaccggcagaagcaccgaaagcagcagttgaagacgcacaacctaaaggagcacttccagaaggaactgtggtcggagacgggaaaatcaaatatgtattagctcgtgttgactcacgtctgttacatggacaagttgcgacagcttggacaaaagcagtgcaaccaaaccgtattatcgttgtttcagatgcagtatcaaaggatgatctgcgtaagagactaatcgaacaagctgctcctccaggtgtaaaagcaaatgttattcctattagcaaaatgatcgaagtcgcaaaagaccctcgttttggaaataccaaagcattgcttttatttgaaaatcctgaagacgtattgacagctgttgaaggtggcgtggacatcaaagaattaaatgttggatcaatggcgcattcagttggtaaagtcgttgtaagtaaagtattgtctatgggacaagaagatgttgaagcgtttgagaagcttgaacaaaaaggtgtgaaattcgatgtacgtaaagtacctaatgattcacgcgataacatggatgacattttgaaaaaagcaaaagctgaattagcaaaagcgtaataaataatattaaagtttataggaggcttatcatgtctattatttcaataattttagtcgtattagttgcctttctagctggtatggaaggtattcttgatgaatttcaatttcatcaaccactagtggcatgtacattgatcggtttagttaccggtaacctcgaagctggtatcgtacttggcggtacacttcaaatgatcgctttaggttgggcaaatatcggtgccgctgtagcaccagatgctgcattagcatcagtagcatcagcaattattttagttctaggtggacaaggtgttaaaggtgttccttctgcgatcgcgattgccgttcctttggctgttgcagggttgttcttaacaatgatcgtacgtacaatcgctgttccaatcgttcatttgatggatgcggctgctgaagaaggaaacatccgtacggttgaaatgtggcacatcattgctgtatgtttacaaggggttcgtatcgcggtcccagcagcagcattgctatttatcccagcacaaactgtgcaatcattccttgaatcaatgccagcatggttaacagatggtatggcaatcggtgggggaatggtcgtagctgtaggttacgctttggtaatcaacatgatggctacaaaagaagtatggccattcttcattatcggtttcgttgtagctgcaatttctcaattaacattgattgctctaggtgctttaggtgttgcattagctcttatttacttgaacctttctaaaatgggtggttcatcaaataatggaggcggaagcaactctggtgaccctttaggcgacattttgaatgactattaatcttgaaggaggaaaataaaatggcagaagaaaaaatcaaattatcaaaaaaagatcgtttagctgttgcatggcgctctaccttcattcaaggttcatggaactacgaacgtatgcaaaacggtggctgggcattttctatgattccagcaatcaaaaaattatacaaaacaaaagaagaacgttctgcagcattgaaacgtcacttggaattctttaatacacacccatacattgcttctccaattttaggggttacattggcactggaagaagaacgtgcgaatggcgcacctgttgatgatgtagcgattcaaggggttaaagtaggtatgatgggtcctttagctggtgttggtgacccagtgttctggtttacagtacgtccaatgctaggtgcactaggtgcttcattagctatgggaggaaatatccttggaccaatcatcttcttcttaggttggaacattattcgttgggcattcatgtggtatacacaagaattcggctacagagctggttctaaaattacggatgacctttctggcggattattacaagacgtaacaaaaggtgcttctattttagggatgttcgtattagctgccttggtacaaagatgggtatcaatcaaattcttaccagttgtatcaactgtaaaattagataaaggtgcttacatcgaatgggataaattaccttcaggtggtgaaggaatcaagagcgcatttgaacaagttaataatggcttagccctttctcctgaaaaggtaacaacgttacaagacaacttagaccaattgattcctggtttagctgcattaggattaacattgttctgtatgtggttgcttaagaaaaaagtttctccaatcgttattatccttggtttattcgtagtcggtgttgtaggacacgtcatcggacttttataatccataaaaatatagctcgggcgttgtcccgagctttttttatatagtatactgtgaataaacagatatttggagggagacaatggttcaatcaatcaatacaaaagtagacttagtaattgacgctacttcatttacggggctgacagattacggacaaatcatgataggcgataatggctttgaattttaccatgcgcgagatagacgcaaatatatccaaattccatgggaagaagtggattatgtactagcatcggtcatgctaaaaggaaaatggattcctcgatatgccattcaaacgaaaaaaaatggtacatacacattttcttccaaagaacctaaaaaagtacttcgtgcgatcagagaatatgtagatgaagatagaatggtacagtcattgagtttctttgatgtagtgaaacgtggtatccgtagcatgtttaaacgcaaataaaaaataaagaaaacttctaaggggaggttttctttatttttttactttgcagaagaaaatatgaaatagcagaaccaattatttgtcccctttaaatcccttatgctaaaattgattagcaaagaaggaggttatattatgagttggttatggacattgattgttggagctgtgatcggagcgattgcaggtgcaatcaccagcaaaggaaattcgatgggctgtatcacgaatatcattgctggattagttggttcaagtattggacaagcgattttcggcgaatggggaccaaaagctgcaggtatggcacttattccatctattttaggcgcagtgattttggtagcagttgtctcgtttttctttggaaaacggtcataagttttttacaaaatagtaaactaaaaggagttgcagcgagactgtgactcctttttggctttctttaaaagaaaaagaagtttttcggaaatttttatttaactgtcgtgtacgaagaaaagtttgctataatagaaaaaagcgtgcaaagaaagagggagtttcattatgatgctacgtgtagaaaaattgcgcaaaaaaatgcaagaagaaaatttggattcatttttggttaccagtccgtacaatcttcgttacttaacgaactttacaggtacgacaggattagctgttattactttggaaaaagcattttttattactgattttcgttataccgagcaagcggcagcgcaggctcaagggtttgaaattattaaaaatgtcggacctatttttgatgaggtagcaaacttagtacgcaaagaagaactgcactcattagcttttgaggaaacaacagtctcatttttagaatattctgttttagaagaaatcatcgatgcggaattagtacctgtttcacagatgattgaagaactcagagaagtgaaagatgaagaagaaatcgccattatcgaaaaagcatgtaatattgcggatatggcttatgatcacatcctgaaaatgatccaaccgggcatgactgagattgaagtcgcaaatcaactagacttttatatgcgttctcttggcgcttcaggtgtttcttttgatacgatcgttgctagcggattgcgttcggctatgccgcatggtgtagcaagcaagaaactcatcgaacaaggtgacttgatcacgttggattttggctgctattacgaagggtatgtttctgatatgacacgtacattcgctattggtgatcctggagaaaaattaaaagaaatttatcaagtagttctagacgcgcaattagcggttattgatgctgcgaaaccaggagtgactggtgtacaattagacgcagttgctagagattatatttcaaaacatggttatggtgaagcgtttggacattctacaggacatgggattggtcttgagattcacgaaggaccgaatgtttcttctcgtgcggaaaagcaatttgtaccaggaaatgtaattactgacgagccagggatctacttaccaggaatcggtggggtacgtattgaggacgatttgctgatcacagaagatggcaatcgtgtattgactcgttcaccaaaagaattgatcatcttatagtctcgtccataaaagaagtaagcgtaaaaatcagtgttcacagactttgttatagaaaatcgcttgatttaatgatacactatagaagaacttttaagctgtaagagataataaagttggatattttctccaattcatagcaatttgcagctgatcggcggcagttttttaccaaatgatcattatagccgcatcatagagaattcggatgtatctcgtgcttaggcaaagggaggaataaataaatggcagatgaaaaaaatttgattttaaacgcaaaccaagatttgggagagattgtgattgctcctgaagtcatcgaagtaatcatcgggattgctgcttctaaagtagaaggcgtatacggaatgcgcggaacttttgccagcaatgtcactgaattattaggacgagcagctcacggaaaaggtgtttacttggcaaatgaggaagatggcttgaaagtagatctttactgctacctggaatatggtgtttcagttcctaaagttgcaatggaaatgcaagaacgggttagccagcaagtccttttcatgacagatatcgatctagctgaagtcaatatccatgtagtagctgttgttcctgaaaaattagaacaaccaacaatcgaagaactttttgaagacgaagaggaagagaatgaataaagaattatcaagacacgagattcgggagatggcattgcaggctttatttccgttagacttcaatgcagacctaacaaaagaagatgcgattttcaacgcaatcgaattagaccaccgcgacatgatcaatgaagatgaatcagagtttgttcctgtttatcttgacacgctagttggcggtgtctgtgcaaaaaaagatgaattggataaagtgatcgaaaaacatttgaaaaataattggcatatcaatcggatctcaaaaatggatttggtgatcttgcgtatcgcaatttttgaaatgacttatgtgacagatgtaccagcggctgttgctttaaatgaagcaattgagttggcaaaaacatttagtgatgaccgttcgcgtaaattcgtcaacggtgtcttatccaatgtattaaaagaattagaagctggggcgtaagtcctagcttttttctgtgaatcatcataaacctgttataaatcgggaaaattctatggtagaatgaaaacacaaaaaatatctgggagtggttagatggcagaattgattaacggaaaagaattagctgaaaaaatgcaggcagagattgctgaaaaaatccaaaaattgaaagataatggtatccatcccggattagttgttttattggtaggggaaaatccagccagtcaaatctatgtaagaaataaagaacgcgtagcaaaagaaatcggaatccattcatcagtagagcgttatcctgagacaatttctgaagacgaactacttgcagaaatcgaaaaatacaatcaagatcctagatttcatggtatattggtccaattaccattgccaaagcatatagatgaagaaaagatcctgttagctatccgtcctgaaaaagatgtagatggctttcatccaatgaatttaggcagactccttgcgggtaaaccggacaagattccttgtactccatacggcatcatgaaaatgtttgaagcttattctatcgatccgacgggtaaacgagcagtagttatcggacgaagcaatatcgtcggtaaaccgatggctcagctgctcttgatggcagatgcaactgttactgttgctcattctaaaaccgaaaatctggctgaactggcacaagaagcagatattttagtcgtagcaataggacgtggacattttgtcacaaaagaattcgtaaaaccaggtgctgtagtgatcgatgtagggatgaaccgtgatgctaacggtaagctgatcggtgatgtgaaatttgatgaagtggagcctgttgcaggctggatcactcctgtgccaaagggtgtagggccaatgactatcacgatgctgatgtatcaaaccgtaaaatctgccgaagcttttggagcaggtgaataaatggcacaagaatatttaactgtcactacattaacgaggtatttgaaacgtaaatttgatgccgatccttatttagaacgagtatatttaacaggcgaaatatcgaatttccgtttacgcgccaatgcccatcaatatttcagcttaaaagatgatcatgcaaaaatatctgctatcatgttcaaaggtgcattccaaaaattacgattccagccaaaagaaggaatgaaagtccttgttgttgggcgtatttcactctatgaagcgggaggttcgtatcaaatctatgtagagcacatggagcctgatggaataggtgctttatatcaagaattggaagaacgaaaagaaaagctgatgaaggaaggcctttttcaaggtcctaaaaaaatgttgccgcgttttccaaagcgaatcgcaatccttaccagtccaagcggagcggttatccgcgatatcatcacgacggtaaaaagaaggtatccaattgtccaattggttttgttcccaaccgttgtacaagggaatcaagcagcggacaatgttgtcaaaaatatccgacgagtagaagagatgggcgatttcgatacaatgatcattggtcgtgggggcggatcaattgaggatttgtggccgtttaatgaagaacgggttgcccgagcgatttatcaagccaatacgccggtaatctcatctgtgggacatgaaacagataccacgatcgctgatttagtagcagatgttcgggctgctactccaacagcagctgcagaattagctgttcctgttttgtcagaagagttgatgcgcattcaagaacggcaagctagattgcagcaggcgtttgtacaccagatccagcggaaacaagaacggttcgagcgtgctcgacgttcctatgtctttcggcagcctgaaagattgtatgaaggtcagaccatcaaattagatcaattgaaacagcgattatatcaagctacacagcagatttatcatgcaaaagaaaagcaaacgatcgcgttaagccaccaattggaacaagtggctccgatttatcgagtcaaagcagcccgccaagaaactgcttatctagaaaaacgtttagaagagaaaatccaacaatatatgaaacaacagcagcagcgttttgctcaagctgttcaatctcttgatttgttgagtccattgaaaatcatgggaagaggctacagctatacgacgttaaatgatcaagtagtaaaaagtgtctccgagatccatcaaggggatttgctgacgatccattatcaagatggaatcgttaaaggacaagtacaagagatagacaaaggagaataaaaatatggaaaatccaacttttgaagagtcactgcaagaattagaaaaaatcgtcatgcagctagaacaaggagacgttccattagaatcagctctagattcgtttaaacgaggaatggaattaagcaaacattgccaagataccttagctaaagcagaagaaaccttgacgaaaatgatgacagaatcaaatgaagaagttgattttgacggaaacgaggaaagctgaaatgagattaactgacttttcagctattcatctaccagctgtagaaaaagaaatcttgtcttttttagatgaacatacgacggatagagcactttgtgatgcgatgacttattcagtgaaagcaggtggaaaaagaatccgtcccttattacttttaacggctgttgcttcctttgatgaacctatcgatgttcccgtctatcaagtagcagctgctttagaaatggttcatacgtattccttgatccacgatgatttgcctgcgatggacaatgatgatcttcgaaggggaaaacctaccaatcacaaagtattcggcgaagcgttagctatattggctggagatggtttactgacaggcgcattccagctgatcagtatggcacacttgggtcattctcctaagcttctgttgcttcagcaattagctgtttgtgtggggtcacaaggtatggtggctggacaagctgcagatatcgaaggcgaatcgaaaaagctttcattagaggaattagcatttattcatgaaagaaagacagggcgtttgattcgttatgccttgctagctggaggtatattagcgaagcaacctgaagaaatcttattgctacttcaacgattagccgaacatttaggtttggctttccagataagagatgatctacttgatgtgattggtacaacgaaaacattagggaaaacagctggtaaagatgaacgtatggaaaaaaacacttacccgcgtttattaggcctggaaaagacacgtgaggcgttggagattgagttgttatccgctaataagatcatagacaaattagaagaggatgttttttcttttgatggcgggctgatgcgccagatgatcaagcaatttgatgtggagaaatgagggaaagaatggaaaaagaacgcgtagatgtattagcggtcaaacaaggattatttgaaacaagagaacaggccaaacgttcagttatggctggtttgatttacaacgaaaaaaacgagcggtttgataaaccgggagaaaaaattccagtaagtagtgaattaagagtcaaaggtaaaaaacttccttatgtttctcggggtggattaaaattagaaaaagcgctcaaagcatttgatctatctgttgaaggaaaaacattgttagatatcggtgcttccactggcggatttactgatgcagctttgcaaaatggtgcaaaaatgagttatgctttagatgtcggttacaatcagctagcttggaaaatcagacaagatcctagagttgtcgtaatggaaagagtgaattttcgttatgcaaaacccgaagactttaccttaggaattccagaagttgctgttatcgatgtttcttttatttcactaaaactgatgctacctccattacatgctattttaaaagaagagggagaagtgattgccttaatcaaacctcaattcgaagcaggtagagaagctgtagggaaaaacggaattgttcgtgacgcacagacccatcaaaaagttttagaagacattttgtcatttgcagcacaaggtggatatgatgtgctggaagtaagttattctccgatcacggggggagaaggaaatatcgagttcttggctcacttgaagaaagtacctgaaagcggcacgatcaatccagctattaatatggcagaagtggtttcaaacgcacatgaacagtttgaccataaataaattgtaactgtgaaaatcaagtgagaagtatgcggattcttctttattataccaaggaaataagctatcattggataagaagaataagctaaggagcgaagacgtaatgagaaaaaaagatcggcatcgtttgattactcgattgttgagtgagcaagatatccgaaagcaggaagaatttgttgaaatcctgaagagcaaaggaatatctgttactcaagctacgatttccagagatataaaggaactgaaactgattaaggtaccggcctcagatggcggctaccgttatagtataccagctgaaacaaatgaagatgtaaatactaaattggaaaaactgttaaaagacgctttcgtagcagttgaccaaatggaaaaatttgttattttgaaaactttgccggggaatgcttcggcagcagcgaatttgatcgataagcgctacaagaaagaattattttcgattatcaatgatgacgataatgttttgatgattacacgaactgaagaccaggcagttttactaaagaaagacttcctgcattacctttaagttgaggagcgaatgtgatgctacaagaaatcagtattactaactttgcgattattccggaattgcggctttcttttcacgaaggaatgaccgcgctgaccggagagactggtgcgggtaaatccatcattatcgatgccttaggtttgttagcaggaggaagaggttcaagcgattatatacgtcaaggcgcagaaaaatgcattcttgaaggattgtttgaacttccgaaacaagaaggattctctgaattgatggttgaattaggtatcgaaacggatgaagacaatctgatcgttcgacgggatatgtcgttgactggaaaaaatgtttgccgagtgaatggtcacatcatcacgctagctaatctaaggaaaatcggaagttatttagtggatatccaagggcaaaacgaacatcaggaactgctccagcctgaatcacatcttgcattattggatcgttttggagatgcagctttccaacagaagaaaaagagttatcagcaagaatatacctcttatcgtgagctggaaaaaagggtacgaaaagtgcagcaaaatgaaaaatcctatgttcagagaatagatatgcttcactttcagcaagaagaaatagctgctgctgatttgcaagtcggagaagaagagaaattaaaagaagaaagagaaaaacttagcaattatcaaaaaattgctgatggattagctgcaggctacggagcactgacgaataatgaacaaaacagtgtagatggtgttggcttggccgttgcagaattacaagggatcgcacatctagatgtggagtatgaagcaatttatgaaaatatccaaagtgcttactatttgctacaagatgcaatcggagacatgagtcgtcaaatcgatttgttggagttagatgagagtcgtttagaagaagtgactcaacgtttagaattaatccgacagttgaaacgcaaatatggcgaatccattgagtcgatattggcttactatgacgaaatcaccgaagagctagcttcttctgatttttcagaaggtcaattggacaaaatgaaagaggaactagagcaaaaagagcttctacttcagcaacaagccgcagatcttcatgaagcgcgtaaaaaaatcgcaaaagaattggaaaaatccattctgcatgaattaaaaagtctgtatatggaaaacactgagtttgaagtacgtttcttaaaagaagaaaacagacaattgaatcatgatgggtttgaccaaatcgaattctacattacgaccaatccaggagagccgctgaagcctttagtgaaagtcgcttctggtggcgaattatctcgtatgttactggctttgaaaactattttttcttctgagcaaggtgtgacaagtattatctttgatgaagtggatacaggtgtaagtggaagagttgcacaagccatcgcggataaaatttctcaaatatcgaaacattctcaagttttgtgcattactcatctgccgcaagtcgccgcagtcgctgactatcaatattatatcgtgaaagcagtgattgatggtcgtacgcaaacttctgtttcagaattgaaaacaaaagaaagagaagaagaaattgcacgtatgctagctggaagtgagattacaaaactgacactcgaacatgcaaaagaactattgcaactcgcaaaaaggacctgatccactgtagtggttcaggtcctttttagcaactgatagctatattttattttttacatgacactcatgacagcagtcaatacaacagacccaatcgttaaaatcagcatcgtccaaatgacaaattttgttactttagcaaaagtacttgtttgttttttttcacgcattgttttcaacctcgtaattaattagttaatccaagtgtacaatctttttgtcttttctacaagaggtcttttttataaaaacttccctttttttaaataataggtagttacgatacaaataaataatgttaatagaactagccagataaacgcatcatctctttcagcaatgggtagcttgatgttcatcccatagatacttccgatgattgttggtatagttaatataatcgttaaagaagttaaaattttcataatattattcaaattattcgatacaattgctgaaaaagtctgattcatttgttctactagttttaactgaatgcgagaagtagtcattgcttgctctgtttctatcaatacatcacgtagatggtttttcaacgcatgattttcttggagaagtttattttgcgctaattctttcaatgcatctaaattagcagaagtcgcttctctgaaataaacaaggcttttttggatatccatgatttgataaagttgtttgttttcagttgatacttgaagtttggcttccaaagtatcgcattgagattgaagcgtagctaaataactgttataagacagggtaacctgccagatgaattgaaagaagatattgagattgggtgaaacatcgctttttggaaaggtttgactaaagactttctttaaaaatagtggttcatgattcgtaattgtgataagcttctttttgggcgtcaaaatgatagagagcgggtatgtatccacttgaaaataaccgctaggacttgttttagcaaacggatattgtaacaataataacgctggttttgtcaactttgattgattgaattcttctgtacgggaattttctgcatcgtccaatatggaagtgatgtaatctgacggaatttcaaattgatgtgtcagctgatgaatctcttcttgattgggacgttctacacaataccagattgtttgatcagtttcctttccggtattacgcagtttttcattatctaatgtaaaatatttgatcatgattttcctcctgttgcctgtttcttttattataacggatagggaattggaatacatggaatgtgtttgtaagatatagaatataactgcataaatttaaataaaatgaaacagttgtgtaaagtatatacagtatacttgaagcaacgataaaaaggagtttacgttcatgggcacattcacaccacttatcttgttttggtatatttacccggtaatcgttttgtttggttgccaatttcttgtaaaattattttcgttaaatcgtcgttttaaaataaaagcccctgatttggcgattccttttttgtggggcggtatgcatgcgttgtctagaaacacagcgacaatttctatcctgccgtttttctttatttctgttttactactgggcatctgtattgctatttttcaagcatattattatgaagaaatcatttattcgcgttatttcaagatgacttggcgtttagtttttctgctgacaatcgtcttgtacgcggtcttgatcattgtgaatatactttcttacctatgaaaaaagcagaaaagctgcaaaaagtcttttaaaaggctttttgcagcttgattcttaaaaaaatgtttatgaataaaaaaagttgttcccggatttcctagaaaaggtggtagaaagtgggggattgtggtagactaattttagttagtggaggaatggggggctttcaatgttgatgggtgaattccaacataatattgatgcaaaaggacgtttaatcgttccctcaaaacttcgtgaagaacttggcgaaaagtttgttctgacacgcggattggatggttgtcttttcggctatccgatgagcgaatgggaaaatctggaagctaagctgaacgaaatgccgttggctaaaaaagacgcacgtacatttgtgcgattcttctattcggctgccactgaatgcgaacttgataaacaaggacggatcaatataccaagcacgttaagaaattatgcagctttgacaaaagggtgcgtaatcatcggcgtatctaaccgaattgaaatttgggatgagacacgatgggaagatttttctgcagaagcagaagagaattttgacgaaattgctgaaaatatgattgatttcggactataagaataggaagaggctgactaatgactgaaacatttcaacactatacagtcatgttgaaagaaacggtagatggattgaacatcaaatcggatggcgtttatgtagactgtacactcggcggtgccggacatagtgaatatttattgagccaactaagttctaaagggcacctgtatgcgtttgaccaagatcaaaaagcaatcgatcacgccaagctgcgtttagcttcttatgtcgaacaagggatggtcacatttatcaaagcgaatttcagagaattagaagaacgcttgagtgagtatgtagataaggtagatggtattttgtatgacttaggggtttcctctcctcaactagatgaagcagaacgtggatttagttatcatcaagatgcacccttggatatgcgtatggatcagtcagctcctttaaccgcttatcacgtaattaatgaatattcctaccatgaattagtaaagattttcttccgctatggcgaggagaaattttccaaacaaattgctcgtgaaatcgaacgagtacgaaaaacaaaaccaatccaaacaactggtgagcttgtcgaaatcattaaacaagtcatcccagctcccgcaagaagaaaaggcgggcatcctgcaaaaagaatttttcaagctgtgcggattgcagtaaatgacgaacttggtgccgaagagacctctttagaacaggcaatccggttattgaaagtcaatggaagaatcagtgtgatcacattccactcattagaagacagaattgtcaaaagtatgtttaaagaatatagtacggtacaagatttaccaccgggacttcctgtcatacctgacgaatttcaaccggaactgaaagttattactcgtaaaccaatccttccttcagaggaagagttagcagaaaacaatcgatcacgcagtgcaaagttacgtattgcagaaaaaataagaatgaaagaggagtagaatgatggcagaattaaagaaaatgcaagagtacgaatatgatttacctgaattggtggatcagccagaacaacaaatgccagattcttcttcgaatcaagaaatcattcttccacaatcaccagcaaaacgattgaagcagatttctgctttggaaaaaattgctgtggcaagcgtggcgattgctattgttgctttatgtgttttaacagtcatgttgcgtacaaatatcagcggagctgaaaaagaaatcacatcaatacaaacagaaatcaatgataaaaagcaagaaaaaacgagtttagaacaagaaaaaaatgaactttctcgtactgaacggattaaacaaatcgcagaagaaaaaggattgtctattaatgacgacaatttaaggaaagtgaagtaaatgagtcttaaaaataaaattcggcggtttatggaaaagaaaaatctaaatccgatgaacaatcgcaaaaaagtaggtatcattttatttgctacgagtattggattgttctttttatttgccgtccgtttctcgtatatcgttattggaggtcatgttgctggtacctcattagctgaaaaaacaaaacagttgtaccaaggaagtgaagtagtaaaagcaaaaagaggaacgatttatgatcgtaacggtgtggcgctcgcagaagatgcctcctcttattcaattaaagcgatactctcaaaaacatatacttctggggataaaaaactgtatgtcgaagaaaagaattttgataaaatagcagaaatcctgcataagaatctttctatagacaaaaaagatgcactgaatattttagaagacggcgcaaaaaaagagctgtatcaagttgaatttggtagctatgggaaaaatatctcccaagaaaccaagcaaaacatcgaagcagatatgaaaaaagaaggtgtcgctggtctttactttgtcgaccatcaggctcggatgtatccaaatggcgtcttttcttctcattttatcggatatgcagttccagacaaagatgagaatggcttagttggtaaactaggtttggagtctgcttacaatgatattttgagcggtaaagatggtaagattatttatcaaaaagataattttcaaaatcctctgccaggtacagtagcagaagaagaaaaagctgttgatggacaagatatctacacgactttggacagtagactacaaagttatttggaaacactgatggatcaagtaaatgaagaatatcaaccggaagaattgacagcagtcttgatgaaagcaaaaactggagagattttggcgatggggcagcgtcctactttcaatcccgaaacaatggaaggtttgactggagaagatgctatctggcgtaatttcttggtacaagatagttatgagccaggatcaaccatgaaggttttcactactgcagccgctatcgaagaaggagaattcaacgagaatgaaaccttccaatctggaaaaatccaagtagaagatgcgacgatcaatgaccatgactttggtgaaaaaggtgtgctgaccatgcgacaagctctttcatggtcaagcaacgtcgggatggtcatactggaacagcgattaggcggacgatggtacaattatttacaaaaactaggatttggacaaagtacccattctggattagatgacgaagtaaatggtgctttgcctacatcaaatattgtcgaccgagcaatgagtgcttatggacaagcggtaggtgtgacgaatttccaaatgatgaaagctttcacttctattgcgaataacggtacaatgattcaacctcgatatatcagcaaagtagtggatcctcaaactggagaagagcgaacaactcaaacagaagttctaggacaacctttttcaaaagaaacaacagaaaaagtccgtgaatatatgagagatgttgtcgaaagcgaaaactacggtagtgcttatggcgtatatagtgtacctggatacaatgtatcggcaaaaaccggaacagcccaaatcgcttctgatacagggggataccaaacaggagatacagcctacctgtattcgattgtggagatggttccttctgaagatccagactatgtcttgtatctaacaatgaaacaccctaagacatatgatcgaatggctttggctaaaatcgcaaatccattgatgaaacgggcaatggattttaaagaaactgaagaagatacggatacagaaaccaaaacagaaaaagtatccgtagccgattatcgtaatctagaagcagatgttgcagcagcggatgctcaaaaaagcggactgcaacctgtcgttatcggtaacgggaaaaaagtacaaaaacaatctactgccaacggtgatcagttgatctctggagaaaaactgattctatatactggcggcgacaagctgatgcctgatgtaactggatggtcaaaagcagatatcatgaagctagggaaaatccttggtatcgaagttagttttgatggggatggttattgtgtcaaacaagaacttgctccatatgaaaaaatcacaaaagaaaaacttaattttactttagaagaataagaagagaaataggagagaaaagagcatggaatggacacaagcattgattcccattgtcagcagttgtgcaatgacgattgccgcaatgccgctatttattggttactttcaaatgaaaaagcaaggtcaggcgattcgcgaggagggaccaaagtggcacaatatcaaagccggaactcctacaatgggcggcttagtgtttctgatcggctctattttgacagggatttgggttggagcttggcaaaaacagctgactcctactcttttcatcttgctttttgtattagcattatatggagtaattggttttcttgatgattttataaagatcttcaagaaaagaaacatggggctgaactcgaaacagaaactgattggacaggttctagggggaatcatcttttatcttgtttaccgttctgaaggctatccaggtgtattgaatttctttgggttggatctgcctttaggaatcatttatggggttttcgctatcttctggcttgttggattttcaaatgcggtcaatctgacggatggtatcgatggattagttgctggcttaggcagcatctcttttgcagcttacggtctgattgcttggcatcagcatcagtatgatgtattaatcatttgtctcagtgtcttaggtggcttacttggattcttcgtctataaccggaaacctgccaagatttttatgggagatgttggttcattagctttgggcggacttttagcggcaatctctatgatgctgaaccaagagtggacattgcttttgattggcttgatttatgttatggaaactgcaagtgtgatgcttcaagttacatcctttaaacttacgggaaaacgaatttttaaaatgtctccaatccaccatcattttgaaatgtgcggatggtcggagtggaagattgatacagttttttggttgatcagcattgtgacttcattgatcacattatggatcgtttggtaggagatgacaggaaatgaaaaaaatatcaacatatgaaaataaaaaagtgcttgtcttaggactcgcaaaaagcggagtaagtgcggccaaattattacatgaattgggcgcacttgtcaccgttaatgacggaaaaccttttgatgaaaatccggaagcacaagaattgctttctttagggataaaagtaataacaggcagtcatccaatcgaattactagatgaagaattttcgttgatggtcaaaaatcctgggattccctacagccatcctttagtagcaaaagcccaagaaatgggtattccggtaattacggaagtggagctagcttacgaagtagcggaatgcccaattattgggattacaggaacgaatggaaaaaccacgacaacaacaatgactggactactactgaatgcaggcgtagacaaaggagttgcacgtttagcaggaaatattgggtatccagcaagtggtgtcgcgcaagaagcgaaaccagaagataaaatcgtgatggagttatctagttttcaactcatgggaatcacagatttccatcctcatatagcggtgatcaccaatatttatgaagcacatattgattatcatgggacaagaaaagaatacgtcaaagctaaatggaaccttcaaaaaaatatgacagctgaagattatctagttcttaactggaatcagtcagaactacaagaattagcgcaaagaacaaaagcacgcgtcctgcctttttcgacaaaagaagtgttggaagatggtgtgtatgctgacgatcacgcaatttattataaaaaagaaaaaataatggaaatttctgaacttggcgtaccaggtacgcataatgtagaaaatgcgctagctgctattactgtagcaaaattgtatggtgtatcaaatgaagctatacgacaaacgttgcatttattccatggcgtgccgcatcgtacgcaatatgtaggagagattcaaggcagaaaattttataatgattcaaaagcaaccaatattttagcgactaaaatggctctaagcggatttgaaacggctaaggtcgtgttattggcaggcggattagatagaggaaatacatttgatgaattggttccttcactaaaaggaatcaaagcaatgatcgtatttggtcaaacaaaagaaaaattgatcgatgctggaaaaaaagcaggcatcgagacgatagtaacagccgattctgtagaacaagcagttcctttagcattagaaaacagtacagatggtgatgtgattttattatcaccagcgaatgccagctgggatcaataccctaattttgaaactagaggaaaccgattcatggaagctgtgaatcaattaaaatagaaaaagtagaagcgagcgataaaaaatgaaaattttggttacaggcggaggaacgggaggacatatttatccagctcttgcctttgtcaattatgtgaagacacaagtaccgaatgcggaattcatgtatgtgggggcaaaacgtggtctggaaaataaaattgtccctgatacaggaatgcctttccatactttggagattcaaggctttaaacgaaaaatttccatgcataatatcaagacaatccgattgtttcttaagagtatccgtcaagcaaaaaaaatcctcagtgattttcaaccagatatcgttatcggtactggaggatatgtatccggagcggtagtgtatgctgcatcaaaaatgggaattccaactattatccatgaacaaaacagtgtaccaggtgttaccaataaatttttaagccgatatgtggatcggatcgctctttcattcaaagatgcggctcctttttttcctgaaaacaaatcagtccttgtaggtaatcctcgagcacaagaagtagcagatactaaaaaatcagatattttgaaaacatttgggttggatccagaaaagaaaacagtcttgatttttggcggcagtcaaggagcacttaaaatcaatcaagcggtatcggtttttttaagtgaatatattccttcctcttatcaagtcttgtatgcttcaggagaaagatattatgaagaaatcctaaataaaataaatcctgaaatacaaaacattagtgtccaaccttacatcaaaaatatggcagaagtcatggcttcgagcgatctgctagtgggacgtgctggtgcaacttcgatcgcagaatttacagctttggggcttccggcagtgctggttcctagtccatatgttacgaatgatcatcagactaaaaatgcaatgagtcttgttcatgcaggagcagcaaaaatgattgcggataatgagctaacgggtgaatcactaagtcagacaattaacgaaatcatggatgatgaagaattgcaaaagcaaatgtgccgagcttctaaagaacaaggcatccctgatgcttcaaaacgtctttatgacgtagtgaatcaaataatcaaaaaataaaggcggtggtcttagtgagtaagaaaaaagaacctaaaaaattgtctcatccgtcttctgatgaaaacaatttgactccttggcaaaaggctaaccgaaaatatctggcagaacaagggatgaaaaaccaagagccaaaaaaagaagacacaccattagatacacccctttcagattctgaagaagaaagaacggttcaagaggaacagcaagaaataagccagtcagaaagccagtccgagaaaaaaatcgaattttttgaagagatcaagcaaaagaaaaacggtggcccgtataacggttcttttttgaatcgtctccccaatttaaaaagtcaaaggcataaagtactgtttcgtcggttagcattgattattactgtattgggcataccgctgatttttttgatctattatgtttctccttatagcaagctacaagcagttgcagtgtcaggtaataaggtagtcaacagtcaggaaatcatctctgataccaaattgtcattgggagaaaatgtctgggggcagtatttcgatcgatccacttatatcgaacggctaaaaaaagcacagccgagaatcgaaaaagcaactatacacttcaaagggataaatgagttcgatttggatgtgacagaatataaagaaatcgctttgattgcaaaagataaccaatactatccagtaattgaaaatggaacagtattagatgaaaaagtagcaaatcctacaaaaaatctccctatcttggaagagttcaaagattcagcaaaaatcaaagaattaacaaagcaatacaatcagttatcatcagaattgcaaaaagcaatctctgaaatcaagtatacaccaagagcaagtaataaaaacctgatccaattgaacatgaatgatggcaatcaagtcattgtaaatatcaataatcttgcgaaccaaatgaaatattattcgcaagtagccaaagacatggatgaaaaaggtgtaatcgacatggaagttggcatctactcatatccttacagcagtactcaagaaacggcagaatcggaccaaacggaagaaacaactggaagtgaagaaaacgcggatcaaataaatgggtcaagtgaagagtcagaaacgcaagcagcagatacacctgaatcgtctgatacaaacggctcatctgattcaaataattcaagtgaaacaagtcaaatagaagacaatccaagtacaactccgtcaagtttaaatgaaaattgataaaacaactttaaaaagtaagaatgtactttctaaaaaccagtaatttatggtagaattgaaagcagtgaatatatctattaataagtatattttaaaacggacgctagttgttcgcttgtatatggaatagtaagtaggagggaatcccattcatggcaaaaacaggaatgtatgtaggccttgatattggaacgacatctgttaaagttgtcgtggctgaatatatcgacagccaaatgaatattattggagtaggaaacgcaaaatcagaagggattaaccgaggcattatcgttgatatcgataaaacggtccaagcgatacaacgagcagtacgacaagcagaagaaaaagcaggtatccagatcaaaggcgtaagtgtcggtttgccagcaaacatgcttgaagtagaaaattgccagggaatgattgcagttaacggagattcaaaggaaatcaccgatgaagatgtcagaaatgtggcttctgctgcccttgttcgttcaatacctcctgaacgtcaaatcgtgtcaattttgccacaagattttactgtcgatggattcgaggggatcaaagaccctcgtggaatgatcggcgtaagattagaaatgtacggtctgttgtttaccggaccaaaaacgatcatccataacatacgtaaatgcgtggaaaatgccggattaatcgtcaatgaaatggtgattactcctttagcgctgacagaatcaattctttctgacggagaaaaagattttggtacgattgttattgatatgggtggtggccaaacgacaacagctgttatgcatgataagcaattgaagtttaccagtctcgaccaagaaggtggcgaatttgtcactaaagatatctctattgtattaaatacgtcttttaacaatgcagaagcgttgaaaataaattacggggatgcatatccagaacggacatcaccagatgaagagtttccagtagatgtaattggccagtcagaaccagtgaaagtcgatgaacgctatttgtcagaaattatttcagctcgtatggaacagattttcaacaaagcaaaagatgcattggaccaaatcgaagcattagagttgccaggtggcgtcgtattgacaggcggagctgctagtcttccaggtgttgtggacttggcgcaagaaatcttcggcgtaaatgtgaaactgtatgttccaaatcacatgggactgagaaacccggtatttacaaatgtaataagtatcgttgattattcagcaaacttgagcgaagtgtatcaattggcaaaaattgctgttacaggtgaaacctcagcagctcgtcaaatggtagttgaacaagaaacaacaaacacatatgaaagctatgaagcacctgaagaaacagtctacgatgagccggaaccaaaagaatccggagaaaatgtaaaaaataaaatcaagggtttctttacaaatatttttgattaattcatcctgggaggaataagatatggaattctcaattgataataatatcaatgacggcgcagtaatcaaagtcatcggagtcggcggtggcggtggaaatgctgtgaaccgaatgattgaagaaaacgtcaaaggtgttgaattcattacggccaacacagacgtgcaagcattaaaaaattcaaaagctgaaacagttatccaattaggaccaaaatatactcgtggtttaggtgctggttctcaaccagaagttggacaaaaagcggcagaagaaagtgaacaatccttacgcgaagctttagacggtgcagatatgattttcatcactgcaggaatgggtggaggaactggtacaggtgctgcgccaatcgttgcagggattgctagagaactgggcgcattgaccgttggtgtcgttacacgtccattcacttttgaaggacctaaacgtggtcgttttgctgcagaaggtatcgctcgtttgaaagaaaatgtggatacattattgattatctcaaataaccgtttactagaagttgtagataaaaagacaccaatgcttgaagctttccgtgaagcagataacgttttacgtcaaggtgtacaaggtatctctgacttgattacggcaccaggttacgttaaccttgactttgctgacgtgaaaacagtgatggaaaaccaaggtacagcattgatgggaatcggtgtagctagtggagaagatcgcgtagtagaagcaacgaaaaaagcaatctcctctccattgcttgaaacatctattgatggagcggaacaagtacttcttaacatcacaggcggtttggatatgacattgtttgaagcacaagatgcttcagatatcgtagcaaatgcagcaactggcgatgtaaatattattctaggtacatctatcaatgaagaaatgggcgatgaaatccgcgtgacggtcatcgcaacaggtatcgatgaatcaaaaaaggagcgcaagtctagccgtccagctagacaagcacaaatgcaatcacctgctcaaaagactgtattagatatggatcaagctaaaccaacttctgcagaagaagaaaacagttttggcgattgggatatcagacgtgaacaaaatgttcgtcctagagttgatgattccaattttgacaatatcgaaaaaaaagaatttgatacattcaaccgcgaagaaacaaaatctcatggcgatgatgaattaaatacgccaccgtttttccgtcgtaaaaaataaaggagaggaagagcacatgattgctgacaacttgcagaaaatcaagcaagaaattcaggattcgtgtgctcttgttcatcgtgatccgaaagaagttacattagtagctgtaacaaaatctgttgaatcagctcaagctgaagaattggtcagagctggcgttatgaattgtgcagaaaaccgagtagataaactattacaaaagaaacaagatttatttgattttcccgaaataaagtggcatttaattggtaatttacagcgcagaaaggtaaaattgattgtaaatgaaattgattactttcatgcgttggacagtttaagattagcagaagaaatccagaagcggttagaaaaagaattatcctgttttattgaagtaaatgtttctggtgaggaatcaaaacatggaatttcaccagatgagcttttaccgtttgtggaatctttagctgcctgcacaaaaatcaaggttgttgggttaatgactatggcgcctaaagaagcttctgatgagcaaatccataaagtgtttggtacgctgaaagaattgcgtgatcttgttcaagcaaaaggttatgcccatgcaccatgtaatgaattaagcatggggatgagtcaggattttcaaattgcgattgaagaaggtgcaacatttatccgtgtaggaacagcgctattcaaagacgaataaaggaggaacaaaaatgccgcttttaaacagaggagcaattgctaattttttcggattagctgatgaggaagagtacgaataccaagattatcctgaaacaacaaaaaaggctgtacagccaactaaaaaaaatacaacacagaatcaaccaactcattctgtatctgctgcgaatactcatgagaaacaaaaaacggcgacttcacgtcctgtaacgcatgaaagtattcagccggctgaaaagaaaaaagtaattgaactacatcaatcacctacaaaaactgtagcgaaagaaagaacagcttcaagaacgtctacacaacctaaagcaaaccttgcagggaaaatcactgtgatggaaccaagagcttattctgaagcgatggcgattgctaaacgaatcatcgctggtgaagcaaccttagtgaattttcatttagtggaagaaaagcaagcgagaagaatcgttgattttctaacaggaacagtttatgcattagatggagatatcaaacgcgttggagatgagatttttctttgtacaccgacagggatggagattgacagttcaaccgctcaatcttttgcagatgcgaatttgtttgatctgtaagaggaggaactacgatttatattattgcgctattacttcatttaattgaacgggcagcctatttctatagcattatcttgatggtatatgctttgctctcttggtttccaggcggttatcaatcaggattaggacggtttttagctaagatctgtgaaccgtatatcagtttattcgatcgtctgcctttaaggatcggtcctttggatttcacgattttaggggccattctaatcttgaacttagccgtacaaggattagcacagatcgttatatggataactatccatttagtttattgattcaagcaacaaaatctttattctcagaatagataggaggggaaaattttggatggaaatgtataccagcactttcgggcagatgaacgtacatttatcgactcagtaggtgattggattgaacaagttcaaggacaatatgcgccatatctgactgaatttcttgaccccagacaatcctatattttagaaacactgattcggcaaagcagtgatttgcgtttcatgttttatggtggatatgaacaggcagaaagaaaaagatgtttgattttccccgattattacgaacctgtagaggaagattttgaaacagcattgtatgaaatccattatcctagcaaatttgccagtctaagtcatgggaaaatcctcgggactttagtgggaacaggtatcaaacgttcttactttggcgatatcatctcagatggcgatcgctggcaagtatttattgcaaatgaggtggatcattttgttgctgcacaagtaacaaagattggaaaagttgctgtacgcttggaaccaatcaaatacacagaaatgattttgccgaaagacagctggacacaagaaagaggaacagttagttctatgcgactggacagtgtgatctctgagatttataatatttccagacagcggtctaagcagctgattgaagctggtaaagtaaaagtgaattggacagaaaatacaagacctgattttgtacttgaactattagatattatttcagtcaggggttacggcagagtccagatccaagaacttgagggaaagacgaaaaaagaaaagtacagggtgttgtttggtgtattacgtaaataaaataaaaaggtggtttactcatggctttaactccattagatatccaaaataagacattcccaacaaaaatgcggggatataatcaagacgaagtagatgatttcttagatttagttgttcgtgactacgaagaattgactcaaagaaatcgtgaattagaaaaagcagtcaaacattcagaagaaaaacttgagtatttcaatgaattgaaagatgcattgaaccaatcgatcatcgtagctcaagacacagcggataaagtaaaaacaagtgcaagcaaagaatctgaagtgatcgttacttctgcacaaaacaaagcagatgagttagttgcgaatgctgaaaaacgtgcacaccaattaacaactgatgcagaagaaaaagcaagaaagatcttgacagatgcaacagaaaaagcaagacagcttgcgacagaaacagaagatcttaagaaaaagacacgagtattccatcaacgtatcagcttgatgcttgaatctcaattggaacaagtgaaaagtccagaatgggacgaaattttacaaccattctctagctatgtgactgacagccatgaagtgatcaaagaagttttagcaaaacagcttgacaacgaaaatgatactgatgtaaactcagacacaggagtcatagaagcgcctatgacggcatttgatacacaggctatcgatatctcaatcgtacctggtgaacatgaaaacgagtagaacagaaaagcactttgttattcttaaagcgagccgatgagagtggaagatcggtaagacactgcatcgtgaaagatcctctacttgagactgcttttctgaaactagagtaagaagcagcggctgacctcgttattggtcacagagagtttgcattagatagatagatgcaactaaatttgggtggtaccacggcatgttcgtcccttgcggctgaacatgcctttttgtgtccggaaaataaacgaaggagtgaatggttgaatgaaaatgaaagaaaccttgcaattaggaaaaacaaaattccctatgcgtggtaatttgccaaaccgagaaggcgaatggcaaaaagaatgggaagaaaatcaaatctaccaaaaaagacaaaaattgaacgaaggaaaacctagctttgttcttcatgatggacctccttatgccaatgggaatatccatttagggcactcattgaataaaatcagtaaagacattatcattcgttcaaaatcaatgtctggctatcgcgcaccatatgttccaggctgggatacacatggattgccaatcgaacaagtattggctaataaaggcgtgaaacgtaaagaaatgtccatggcagaatatttgaaaaaatgtcgtgaatatgcactttcccaagtagataaacaacgagaagatttcaaacgcctaggggttgcaggagattgggaacatccctatgtcacattagacccttcgtatgaagctgcacaagtacgcgtatttggtaaaatggctgaaaaaggctatatttacaaaggattgaaacccatttactggtctccgtcaagtgagtcttctttagcggaagctgaaattgaatataaagatgtaaaatctccatctatttttgtagctttcaatgtcaaagacggcaaaggcatccttgatgaagatacagctttcgtcatttggacgacaacaccatggacattgccagcaaaccaaggtattgctgtaaatcccaaatttacgtatgtactggtcgaagctgatggccgtaagtttgttgtagcaaaagatttgctagaaacagttcaaacagaaatcggttgggaaaaggtaacggttctaaaagaatttgctggccaagaaatggaatatatgactgcaagtcatccattctatgaccgtgaatcgctcgtaattttaggtgaccatgttactttagacgctggtactggattagtccatactgctccaggacacggggaagatgactatatcgccggtagcaaatataaactatctgtagtgtcacctgtagactcaaaagggttgtttacagaagaagctcctggatttgaaggaatcttttatgataaagcaaatccaatgattactgatttattaaaggaaaaaggagctttgctgaaactagatttctttacccatagttatcctcacgattggcggacgaaaaaacctgtgatttatcgtgcaacaccgcaatggtttgcatctatcgataaattccgtcagaatattttggatgaagtagaaaaagtagattgggttatcccatggggaaaaacacgtttatataatatgatccgtgatcgcggcgactgggtcatttctcgtcaacgtgcatggggagtgccgcttccaattttctatgctgaaaatggtgaagcaatcatcacgccagaaacaatcgaacatgtagcaaaattattcgctgaacatggatcaatcatctggtttgaaaaagaagcaaaagaacttcttcctgaaggatttactcacccaggttctcctaatggcgaatttacaaaagaaaaagatatcatggatgtctggtttgattctggttcttctcatgaagctgttttacgtcaacgaccagaattatcattcccagcagatatgtacttagaaggatcagaccaatatcgtggttggttcaactcaagtatcacgacaagtgtggctatcaatggcgtagcaccatataaatcagttatttcgcaaggatttgctttagatggtgaaggccgtaagatgagtaaatctttaggaaatatcattgcaccagaaaaagtgatcaaacaatttggtgcagatatccttcgcttgtgggtatctagtgtcgattatgaagcagatgttcgtgtatcgatggatatcttaagtcaagtggcagaggtatatcgtaagatcagaaatacgatgcgtttcttattagcgaatacagaagatttcgatcctaaaaaagatactgtttcgtacaatgatttacgctctgtagacaaatacatgaccgtacgattgaaccaagtaatcaaagaaatcagagaagaaggatatgacaaatataatttcatgcatatttaccgtacagttatgaacttcttgactgttgatctatcgtccttctacctggattttgctaaagatgtggtttatatcgaagcagaagatgattatcaacgtcgttgcatgcaaactgttttctatcaaacagctgtagctttgacgaaactattgacgcctatcattccacatacggcggaagaaatctggtcattcctaaaagaagaagaagcatacgttcagttaagtgagtttcctggctatgaagagtttgcgaaccaagaggaattgatggacacttgggctgctttcatggatttccgtgacaaggtcttaaaagcattggaagaagcaagaaatagcaaattgattggtaaatcattggaagcaaaactaactgtttatccaaaacaacaagttcgtgaaatgttaaaagctttggatgcagatattgcacaattgctgatcgtttccccagactactttgaagtaatggaagcagatgtgcaagtgccagataatgctgtggtatttgatgatgttgctattacagtggaaaaagcagacggagaaacgtgcgatcgctgtcgtcaagttcgtaaagatgtaggagtagatgaaaaacttcctcatctatgcggacgttgtgcaaaaatcgttgaagcattctatcctgaagctgtagctgaaggattcgaagaaaagtaaaatggaaaaggggttgtgacatgttttttgtcacaaccccttttgttatcaatcgattaatttcccacgttcgcgataccagttatctggttgccagatccattcgaatccatctttttcaagtagttcgaaagctgctttaggccccattgatccggctttgtagtttggaaagtccggttgtgtttggtcccaagctttacgaatgacatccacgatatgccaagattgagcgacttcttcccaatgagagaaattcgttccatcaccattcaacgcatctagcagtaatttttcgtaagcttctgggctattttcaaccatttctgcactatttcgaaattctaatttgattggttccgtttcaaacccttgacctacttcttttccattcagggataaagaaaatccttcagttggctggatatagatcgttagaacattcggtgggagtgtcgtatcgtcacatggttcatcgacagatgttttgaatacattaacaggaacctgtttgaatacgatattgatccgagtacctttttcagtcaaacgtttgcctgtacgcacatagaagggaacaccagaccaacggaagttgtcgatagtgaattttcctgcgacgaaggtttcggtctctgattgagcatccactttgtcttcttctcgataacctttgaattgtacgccatctaattcaccttgagcatattgtccacgaacgaagttttctaacacttcttcttcgttgtagatgcggattgctttcaatgctttaatcttttctgtacggatttctttttcggaaaatgctactggtggttccattgcaagtaatgctacaacttgcagaatatgattttgcaccatgtctttcagtgcgccactgtgatcgtagtagcccccgcgatcttctacgccaaggttttcaccaaaagtgatttggatattatcgatataacgattattccattgagcctcaaaaatattattggcaaaacggatagctgaaatgttttggatcatttctttccctaaataatgatcgattctgaaaatatcttgctctgggaatacttctctgatttgctgattcaattcgaaagcagactggtaatccgatccaaacggtttttctataatcaaacgattgaagccattttttgtcataatgttttgtgattttaaatgagaaacgatcgttccgaaaaattgaggtgccatggccaaataatagacgcgattaccgtttaactgatagtgtccatctaatcggtcagacaattcttttaatgtttgataatgtgttgaatcatttacatcatgggattggtagtaaaaatgactagcaaaagtagttgcttcttcatcagaaggattcaatgcacgaatcgtttctttgacaacttcacgatagtgttcatcgctccaaggacggcgagcggtcccaatcacggcaaaatgctcgcctaaatttccttttctgtaaaggcggaacaaagacgggtacaatttacgttgggctaggtcacctgtgccgccgaatatcgtaaacaatacatttttttcattagacatgtagatacactcctttatattttatcgacaaaaatcgtgctggccgccttgaagctgacgggtattttctttttatcattttggatagtgattggtccttcataagctgcgatgtcaacgatctcgtactcttcgttgatattcaggtcaattgtgactaagtaatccaacaattctttttcatcaagcactcgtgcaatacgcacttttgtaccgacaggataggattctagtgtttgccggcgttcttcatggacgacttcctcttttttaggaatcgatcctccatgaggacaatgttcaggatgattcaaatagttttctaaatgatctgcaagatgttccgaagtcacatgttccaatacttcagcatcatcgtggacttcattccagctatagtctaaatgttcaactaaaaaaacttcccataaacgatgtttgcgaattaaactgctagctttttgcagcccgcttgcagtcaattgtacaccttgataaggggaatgttctacaagctcttctttcacaagtttagaaatcatttcactgacagatgcagccgagacatccaggctagatacgatttgtttattgttgactttcgttgtatctccgcctagttctaaaatgattttcaaataatcttctcgatttggtgtcatattcgatcatcctttcatggtaaaaaccatcattagtaagtgtaacaaaaaaaacgttaattgactatttttctaaataaaaatcaaaggatttttggacgtttttacaacaaaaaacgaaagatgagaaagaagactcatactttcgtttaaatagatatatattgggaggtgtctatttttcagatgtcagcttatacgagacatctgcagattcatcataaagagtttgttcgggataagaaaagataagataaaaaccatattgatcacgtacgactaaacgctgttcatctatttctactacagatgtgccaagtgactgaccgttgatcaaaaacgtgtaatcagatgtaatctgtaattgttgtttttgctggctatcactgaagaaccatgtaccttgatacctcgagagtctttcagatttttccgcttgttttttctttttcaagtaaatccaacttgagagaacggcaacgagtgaaccaagaaaatagatcattttttttatcaccaaatcactcctttatgagaaaatcatcgtatagaaacattcttccttctttatttcattgtaccgaataaaaactaaaatttctctaagactttcgactggtttttttactgtttttccacaaattatgataggatacatagtaggaagacaggtgacagaatttgaagtatcagcaagttgaaacagctttttttattgaccgtccgaatcggtttattgcacattgtatgaaaaaagacggagaaataattatcgcgcatgtcaaaaatacaggtaggggaaaagaggtcctgataccaggcgctgaagtggctattgtatttgctcctggacctaaacggaaaaccgactatgatctgattgctgtaaaaaagaagggtgattggttcaatatcgatagtcaattgcctaatcagttggcaactgacggtattttagacggtacgatacttttaccaggattaattggtccatttacaacatacaagcgtgaagtaacttatcttcactccaaatttgatatttatttggagacggcggccggacaaaaagcatttgttgaagtcaaaggtatgacgcttgaaaataaagcaattggtgcttttcctgatgcgcctaccctcagaggattgaaacatgttggagaattagcgtatgccgcacaagatggttatgctgcttatgtcttgtttattgctcaattcgaacatcttcatttcgcaacgatccatgaagaaatgcaaccagcactagctgatatggttcgacatgcgcagcaaagtggtgttcaaatcctcgcctataattgtcaagtaacggcagatgaggtaagtgtcaagcaggctatcccgtttgatgtagctatcccgtttgaagatcctatacaatagaaagaaggtaaaaaaatgatcaacttaggtattattggaacaaattggatcactcatcaatttgtccaagcagctttgagcacaaaaaaatatgaattgacagcggtatattctagacatttggaaaaagcacaggaatttggttctcattatgaaggggatatcgaatttgcaacagatttgaagacttttttcaatattgctcatatggacactgtttatatagcttctccaaatagtcttcattttagtcagactaagcaagcaattttggcaggtaaaaatgtgatagtggaaaagccagctttttcgacgccaaaagaaatggatgaaatcatccatttggcaaatgaacacaatgtgtatttttttgaagcagcaagaaatatccatgaatcaggttttaaaaagattgccgattacttaccattaaaagacgagataatcggtgcaaatttcagctatatgaaatattcttcgcgttatgaccaagtattagatggagaagaaccaaatatcttctcgactcatttctcaggtggtgcattgatggatttaggtgtttaccttgtgtatgcaactgtcgcttggtttggaatgccaaaagaagtccattatttcccaagaaagatttctactggtgtggatggtcttggatggggaatcttgcgttatgatactttcgatgtatcgatccaaccaggtaaaatcggtgattcttatctgccatcagagatctattttgactcaggaacgctagtgatgaatggcgtcaatgcaatcgaacaagcagagtttcatgatcgggtacacgaagaaatcattgacttagcagtaacagctgcagaaaatccaatggaagatgaagcagaggattttgccaatgtcataactcatccgaaagatgcagcttggggattattgtatgaagagtggatcgagctggctagaaatgtgaaccaagtgatttatgatttaagaaaaaatggtggcatcaaattcgatgcagataatgaggaagatttttaatgaacgaatttgtacaagtatttcccgaaaattggcagaaaaattatgagaataaaggatttattacaccttctcttattcaacaggcagtttttcagccattaagcaataaacaaagcatagtagccatctctccaacaggttcaggtaaaacactggcttatctttggccgttactactaaacgtggaaccaggtgaagcaagtgcgttggttatctttgcatcttctcaagaactagctattcaagtagcagatgttgcacgtgaatggggaaaagacaaagaattgaaagtccaatctttggtgggcggagcaaacgttaaacgacaaattgaaggtttgaagaaaaaaccagaaatcttgattggtacaccaggaagaatattggaattgatgaaagctaaaaaaataaaagcacatcaagtgaaaacaatggtatttgatgaagcagaccagctatttgatgcggggaacagccaaatcattgatcagattcttcatcaagctccgacagaatatcagctagcctttttttcagcaacagcagatcgttcccttgaaagcattgaaaaaatcactgggaaaacgtttgagacgatcgacgtgacagcagaagatgattctcgaaaaggcttgagacattactttttacgagtgccaatacgaaagaaagatgaatatctaagacgtctcactcacatagaagattttcaaggtctgattttctttaatcaactgactgaattaggtgtgatggaagaaaaattgctgtatagaggggtacctgtaggaagccttgcctctgatcaaaacaagctgctccgaaaagcggcgttggaacaattcaaaaagaaaaagatcagcgcacttttgaccacagatgtggcggctagaggtttagatattacaggacttccttatgtcgtgaatgcagaagtgccgttaagtgaagaagcttacttgcatcgttctggaagaactggacgaatgggcaatgaaggaacagtgatcacactcgtacaagataacaatttaagagatttgaaacgacttttacgtccgacaaacataacacttgaagagatttttctgcacggaggaaagttacaaacggatcaaccaatcaaagaagatgtagctaccgcagcgaataacaagtataagaaatcttttcatgggaaagaacaaaatccagagcataacaaaaacaaatcaagaaaaaaagttaaaaataaatcaaaaaaagagagaaataaaggagcaaggcgcaaataagcgcctttttatgctatgattatgaaaacgggaacaaaattggttgccagaggagggattatgtgaaagaacgtcaagaagagattttgcatctattgacagaaaaccaacaaggattgacagcaagtgatgtagctgagcgcttgaatattgatcgaagcaatgcaagccgatatttaagcgaactgtataaggctcatcatattgtaaaaaccgctggccgaccagtcgtttactccttgccaacggaaaaatcaaaatctgatgaagtacatgtcgactcttctacgcaagtgacttttgaaacgctcgttggagaaaatgattctttaaaagtcagtatacagcaggcaaaagcagcgattctttatccgccgcgggggctacataccattatttttggagaaactggtacagggaagtcaatgtttgcggaatgtatgtatcattttgcaatcgaatctgaaatgctttcagccgatgcgccatttgtttctttcaattgtgcggattatgctcaaaatccccaactgctctttggacacatctttgggatcaaaaaaggagcttacacaggagcagcgcaagatagtcctggtctaatcgccaaagcagacggcggtatattgtttttagatgagatccaccgtttaccaccggaagggcaggaaatgctgtttactttcatcgataaaggtatctatcgtccacttggagaaagtgcacaagtacatgaagcatcagttcagattattggggcaacgactgaatcttcagaaagcttcttgactaccttcaaccgacggatccctatggctatcaccttgccaaaccttgcttcgcgttcactggatgagcgttatgagatcatctctcttttcatcaaacaagaagcgaaccgtttaaatcaacgtatcgatatcgaaaaagaagcgattcttgcctttatgctttatgatgcggaagggaatatcggtcaagtgaaacgagacttgaaattagtctgtgcaaaatcttttttacattaccgaacgcatcatgagaaaaaactgatcattcgaaaagaagaactttcccttcaagtacaaaaaggactactgaaaatcaaagaaataccagaacgcctcgaccgattcatggacagtaagagccagtatttgacatttgaaccaggatttgctgatgtcgtctggtcacaagatccagaaagaaacatgcaagtctacaacgatattgaggaaaaagttacttctctttctgaaaccggtgtggagaacatcgatttggagacgctcatttcaaaagatgtggatgcttattttcagacatatgtcaaagaattgactaaaagttcaatcccaaaagatcttttaccagatgagatctggcggctaaccaatcaattgtatgatgtagctgaaaaacggttagaccgtatttataatgaaaaagctcgttttgcttttgctttgcatttgcaaagtacattggatcgtgtgagagaaggacatatgattgtccatccagatttgaataacgtacgaaaaaattttaagaaggaattccaggtagcaatcgatctttcgacaatcattgaagaagaagaacaagtcgagattccttttgatgaaattggctttatcagtatgtttctttctatcaacttaggagaaagtgagcctgttaaagaaaacaaagtagatgttctcgtactgatgcacggcagacagaccgcttcaagtatgttggagatggcgcaagaactattaggaacaaaagtaggaaaagcttttaatatgccattggttatggaagttcaaacaatgtatgaagaggtactacaatatgtcaaaaattatcaggggcatttgacgaatggactgcttttgttaacagatatgggatcattaaacaccttcagtgatttgatttatgaagagactggcattcggacgaaagcaatcacaatgacaagtacgatgattgtgatagaagcgatacggatggcaagtgttggaagaagcttagaagacatttatcaaaatattcagctctcctttgaatcaatcgtacgtgatcagttcaaagcggaaaaagctgaaactttacagcgtaaaaaagccgtcatcgtgacatgttttactggtgagggagtagctgccaaattgtatcaacggattatgccggtgattaatcaaaacaaagtagaactgatccagatgcagtttttagaacgcgaatcattcaaaaaacacattgatgccttattggaagaatatgaaatcaaagcaattgcaggaacggttgacgttgattatcaaaatatcccatttttttctgcctatgacgtttttgatgatgaaaaattgaatgttttgaagcgtatagctgatgatgaggtcccaacagctaaaattgttgattcgctttcaggatcattaagtgatgtcttttctattgatgaattgatccgctcattgcaaaaaacagttcagcagatccagacagatttgtcgattatcgtagaaccaggagtagatactggaattgtcatccatttagccttcatgctagacggattgatcaaaaaagaatcgcatcggcaatttgagaaactatctattttctcaaaaatttaccgtttggaaatggatatcgttcgagcaaatttgatggcactggaacgaaaatatcaggtaaaaatttcagaagatgatatcgcgtttcttacacaaatgtttcttgaaaacaaaataaaaaaataaacacactaatcatactgtttacacactgaatatcagtgtgcgcactatataaaagagctaaaaagcatgaaaacgctattttagctctttttttcttggcatgcttcttgcattatataaaagtgtaaaaaaaataaaaggagtgttaaaaatggcaaaaaaaacaattatgttagtttgttcagcagggatgagtacgagtttattggtcacaaaaatgcaaaaagcagcagaagaaaaaggaatggaagccgatatttttgctgtctctgcctcagatgcagataataatttagaatctaagaatgtcgatgttttattattaggtcctcaagtacgtttcatgaaagctcaattcgaacaaaaacttgcgcctaaaggtattccgttagatgttatcaatatgcaagactatggcatgatgaatggagaaaaagtacttgcacaggcagaaaatctaatgaaataaatcaagtatgtagttgggggataacaacgtggaagatcagcaaaatctagaagccatcatgggactaatcatgtttggcggtaatgcaaagagcgacgcaatggaagcgattgcggctgctaaaatcggtgatttcgagttagcggatagaaaaatcgctgatgcagaagaatcacttatacaagcacatcatgcacaaacagatatgttgacacaagaagcacaaggaaatcatatgcaagtgacgttattgactgttcatagtcaagatcatttaatgacgtctattgcgtttactgatttagcaaaagaaatcatcgaactttatcgtcgcgtatacagcgaataaatacaacttcttttttgaacggaagaagaaaaatttttgaacggattttttattttgttataaagagaactctctttatataaaaaacttataggaggaagtaaaaaatgaacggactaacaagttggatggagaaatacatcctgccagttgccgcaaaaatcggagcgcaaaaacatttagttgctttgcgtgatgcttttatcggcacactgcccgcaacaatggcgggatcagtcgctgtaatgatcaatgcaattattcgagatttaccgcaacagtttaacagtacctacgctgacagtttagcagcagacaaaggaatctttgccgtattgaatgtcatcatcggaatcaatggttttgtctggaacggtacactagcaatcgccggattgatctttgccttttcttgggggtataatcttgcccgagcttatggagtaaatgatctagctgggggaatcgttggtctagctaccttgattcaaggtatttcctttggtccagcattatcagcagcattagatgtgaatgtcccttcaaatgtcgcagatgcaatcaatagttctgagattggtgcaacgattgcagatggtacactgtcagttggattatggggttggctaaaactagatcatttgaatggaaacgcttattttacagttatgatcatgggagcaatttcagtcattattttttgtaaattgatgcttgctaacattacgatcaaaatgcctgattcagtaccaccagcagtatctaaagcatttgcagccattttaccagctacgatcgctttatatgtcattgctattatcaattatatcgtaggtcgtgtagctgatgggcaactaatcattgatttggtgcaaaaatatattgcagaaccattcctaggattatctcaagggttgggagcagtattgatcgtcacagtgtttgttcaagtattctggttctttggtattcatggaccaaatgtattggcaccagtgctagagggaatctggggacaagcacaactaatcaatattgatattttccaaaaaggttataacggaaaaactggtacaccagccgtgttagatgcaatcgaagatggaaaagcttatatgtgggtccgtggatcgttcgatgcttttgcatggtttggcggatcaggtggaacgatcgtcttactgatagctatcttgattttctctaaacgagcggattatttaacagtagctaaattatccattggacctggtattttcaatatcaacgagccagtgatgtttggtctgccgatcgtattgaatgccatcatgttcatcccattcttgattgctccagtagttgcgacagctatcggttggttagcaacttactttggacttgtagcaccagtatcgcaacaagttacatgggtagtaccgccgttcttattgtcattcttagcaacaggagcggattggcgagcaccaatcgtaacattggtatgtatggtcgtgactttcttgatttgggcaccgtttgtcatttctgcaaacaaaatggaccctgccgcaggcgaacaacaataagatgaatctgaggagcgggacgctttaagtttcgttcctcataatgaattttcgaggaggaactgaaaaatgatttcaattgccagtgcaatgcaacaagatgcaatcaaagaattgttagaaggatacaatgaagaaggaatgacatttacgtttaaagaaaaacaaggaatcaaaatgttctttgagacaagtgcagaagatccggaagctgcggctaaaaaagcaaaggaactaatcaaagcacagccttggggaacagtcctttattttcagtcaacagctgtttaagaaaatggttcaaaaagataggatggttgatatgataaaaaacggtttatttttatgtagtattggttctttgatcgtgttgtatagtttgaatccacattcgcaaaggtatgatttgtatagtatggtcacgggtcttttcctaacaggattaggaatctacttcttcatgaaggggaaaaaaagagaagaagcaaaggagaaaaataactaatggaaatcacaaaaaaattaaatattccagcgtcgtttttttacgataaagttatggattctgttcttttcgatgtacgtaaagcgaccggcaaatcagtgaccagaaaacagctgaaaaatttggagtacgtcaaacaattctcgcaaaataaccgggctcgtataaaaatcgaagaagtcattgaaaaccagtcttataagtttcgtacatcgacaacgaagaatgaattcgttgttcattatcaaatcaaaccagtagacgattcgacctgtgagattcattacacagaaaaaatggagtcttacggcatgcttcaaaagttgaatgatatgcttttaggaacgatcttgatgtactttaagcggagacgtttcaaaaaaatgctagagatgatcgaagcaacgtattaaaccattgaaaaaatggtactatttagttattgaaaaatgaagtaagctagaagagatttttcagaggaagcaaagtctttcctgagattcctcactagcttttttgtaggaaggggcagcaaaatgacaaaacaagtaagagagctagggggatcttcgattgaggaaatgtttgctttagccacatatgcatttaatggggcagatacacctgaaaggagagaacgttttcgtacacttgcggagaattcctggaattacggtttttttgatgaggaggatcggctaacaagtcaagtcatggcgactcctttcccagtgaatttttacggacaagagtatttaatggccggtattggctatgttgcttcttatcctgaagcaaggggacaaggcggaatcaatcagatcatggaaaagattcttgaagattgccgttatcgtaaagtaagcttatcttatctggcgcccttctcctatcccttctatcggcgctatggctatgaacaatcgtttgataaaatcagttatcaactaaacagtcgtgacgtgccttttaccaaaaagaaatctggcaagatgaagcgtatgaatttcgaagatgcaaaagctgctatcaaacgaatttatgaacagatgcctgaaaatcaacgagctggtctgaagcgcgaagactggtggtatacgtataaattcaagcaaaaaggtaattaccagtttgctttgtattttgatgatactggggaagcaatgggctatgtcgtttaccagcttgcagcgtcttcctttattattgtggaatggggatttttgaatcacgatgccttttgcagccttgtccgctttgtaagttcccataacggtgcttttgaaacatttgaatattcatgtggctacggtggcaatgatcaaaattatctattagcaaatccatttgcttctgtaacgatcacaccttatatgatggcgaggatcgtggatatttctttgtttttggaaaaatatccatttagaaagaaacaagctgcctttgctcttcagatagaagaagatcagtatgcaaaatggaatgaaggaatcgtggaagtaacgattaaaaatggaaaaaaccatctctcaaaagtagaacaaacggcgttaccgatcgttcgcggaagtatccaacatatcacacagctattattaggatatcgtaaagttgaagagctggtattccaagagaggatacaggtggcaaaagaatatgaagaaatgttaagttcgatcttgccacagcaacagccaatccttaatgactatttttgataaaaaacgggggatgacaatatttttgtcaccacccgtttatttttcgtttgacatttgaaggaaaatattaaagtaaatcctcttttttcgtaaatttgaattttttgttttcttttgttttagggttttcttttttgtggtcttggattgcttctttcgtgatcttttcccgattttttttagatgaatctaagcgttcggcatatactttttcttttggcttatcattcattggaaagaacctccctgtattatttcattctactcctagtttatcatctgttaagagctagtggaaacgttttgcctaacctacaagctgatttttttagcagataagcttgcaagtaaaaaacaaacaagctacaattgatttattgaaattgttcctgtagctcagtaggatagagcaatcgcctcctaagcgataggtcgctggttcgattccagtcaggaacgtataaataacccctgtatcctttgtggtacaggtttttttattttaaaacaacaaaaattaaatgttttataattaaaaaaacttcattttttattgatataagggtataattgttgttgaaggaaggtgataaaaaaacattttcgttaaaacggaaagcaaaaaataaaaataaaaatgaaagaaggagaaaaattaaaaaaatggattcttagcgctacattgattgttttacttagggctttcgcagatgcaagggtaatagaacaaagtggttttactggtaggtgtgtagcttttccaatgctatggagctagagcctttctagtgggcataagtatgtttaactttttatgctaatctgggcacataatgtacaggcgcactacatagagaatctcgaaagtgggattagtactaagtatagttgatacaaacagcacttcacagctagaataattggaaagtcagaagttttttgttcgatttgaaatacctagttagtttgaataagtacataaagaatcttcttatttagcacttaataaaaaatataaaaaacatttaaaagagaaattaaagggtttctcaatctttgataaaaaaggaggaagtagaaaatgaaaaaagcaaaattgatacttagtacaatcgtcttgacatctttatgtagtggttttttagggactgggacggtggatgccagtgaatataataataaagcttcgagctgctagtgatacaacgcttactgtgtcacgcatacctcataatcctattctatattttgaaatttcaatggaaaattataatcaatctgactcaacccaacgttgggtaatggagtacaatgcaaatgccggtggttattatatccgggagcagattccgggaagtatgaattttacaccgcaatatatttgggatagtggaggaagctttttggacttctcgggtaacaaagagagggtagggactctgtggaagttatattcagccggacagaattcgttgggaaatatattttttatagaaaatatgtcaaacgggaactatatgagttggaccagaggaggtcatactgatcgggcgttgaggtctactgcatttgattggaattgggagcaaagattcattgtacaagttgaaggagaagtttaaaagagaaaaatggaagtacactaatacgttcaatctttttgacttatatctagagagtggggcaataatcagatttttttctgactattgtcccactctcttttttatatatttttcgttattttattcgtgctaacaagattttgctcaagcccaatctccattacggaaaatcggtactgtagaaccgtcttcgcggataccatcgatatccatcttgtcagatcctaccatgaaatctacgtgggtttgacttctattcaaaccagcttctgctaattcttcatcggacatttctgtaccgcctttcacactgaaggcataagcagatcctaaggctaaatggttcgatgcgttttcatcaaatagtgtattgaagaaaatgataccagattgagaaataggtgaagggtcaggaacaagtgccacttctcctagacgacgcgcaccttcatcggtatcaagcaatttttctaagacatcttcgccttgttcggcagaaaagtcaactacttttccatctttgaaagtaaatttcataccagagatgatcgtaccagcataactcagtggttttgtacttgaaatatacccatctacacgatgactgtcaggagcggtgaacacttcttctgttggcatatttgccatgaatttttcccctcgagcattgtagcttccagcaccttcccaaagatggtttttaggcaatccaatgatgatatccgtaccaggagcagtgtagtgcagggcagaaaattgttcttgattcaattcttctgctttttttgctaatttctcatcgtgttttttccatgctaaaacagggtcttcttcgtagacacgagttgttttaaaaatttgatcccataatgcatcaacttgttcttcttctggcagatctggaaaaacttttgctgcccattgtttaccagcagcagctacaacagtccaactgactttatttgcctgagttgccttgcgcaaattcattagtgctttaccggcagctgcttgataagttgctactcggtggctgtctacaccggcaaacgcatcaggatcggcagaaacgacactgatcctgcttgctcctttttcaagccattcatccgcttgatcgattttagattgtggtacatcctcaatacgatctgttgctgcatgtaaaagaaattctctttgaatctgatcatctgtccattgaacgatgacttcagcagctcctaatttgtaagcttcttgtgtgatcaagcgagcaaggggtgcttggtctacactgatctgtaaaacgactgtgtgacctttttctgtggccacgccagtttctgcaattaagcgtgcatatttttttagaagttcattaaaattcgataacataataaagattcctcctcaccattttttctggtaactattagcatgataccatttaatcatgattcaaacaatgtagctttaaataaaaaaaggaggttatttttttctggttgcgtttcacgttctatgacacgacttgctattttagcttgtgaagaaaatcgaaaactaattttgcatatcaaaaaaaacatgttacaatgaaattaatcaatggtggaagcgttataaaaaaattgaggagattaaaaaaatatggcaagaaaaaagacgattactaaagaacagattttggcagctgcttatgaagtagctgccaccgagggatttacacgatttactgcgagaaacattgcgaacaaaatgaattgttccacgcagccgatctatcttgagttcaaaaatatggatgacttgagacaagcactttttgagcaaatctatgattatttgcaatacgaagtgtttccagttgagcatacagggaatacgattatcgatcttgcttttaattatatccattttgcaagaagagagaagaagttgtatcgttcactgtacttagaagaatatggtggaggaaaagagatgcaaaatttctcttatacttactttgtgaatacagtgaaacgggatccagcctacgcggatctttcagaagaacagatcgaatccttgcataacggtacatggatcatagctaccgggattgcagctttgatgtcttcaagcattatccatccaactgatgagcagattgaaaaaatgatccaagacagcattgatgcaatcttgaatctcaaagaaccaatcgaaatcgattgaatatactcaagagtttcgccaatcagtagataacaagagatgtgtcaacataaggaaaatttcgtttttcttacagcgtatacatttttaactcccgaagaactcttccatgaatacaataaaagagccgtctagattgattcaatctggacggctcttttatatctcaagcatattaaagttttgcgactaattctttagcgaaagcttctagattttcgatatcttcttcctcagcatttaagtctacttttacattttctgcgccttttgatgcgcctgtttttccaaaagcagcatcgaagtcatccactgatttacagaattcatcgtaaaaagtatctccagatccgcagacgccgtagattttccctgatagatccaactcttgcaagtcttcataaaaatctacaatctcatcaggaagatcgccatcatcgtatgtataagtagctacgacgcaaatatctgcctcctcgaattcatctgcatctacttgggtacattcgttgatttcgacttcgatatccatattttcaaatgcttctgcaacaatatcggcgatttcttcagtatttcctgtcatgctagcatatacgatttttgctaaagccatgatgtgcctccttgtttaaaattatttaacaattatgaattataccaaaacatcgttgaaaagaaaataaaacctagagacacatgggaaatgtcatttggctaaatgtatgccgctatgttaaaatgagagagatttgtaaaaaggagacgaaaatatgattactttaaaatcagcacgtgaaattgaaatgatggcagaatctggcgctttattggcagatgtacataaaaatctgcgtgattttatcaaaccaggcataacaagttgggatattgaggtatttgtcagaaactatatcgagagtcatggaggaatcgctgcgcaaattggcttcgaagggtatgaatatgcgacttgtatcagtatcaatgatgaaatttgtcatggatttcctcgtaaaaaacctttgaaaagcggcgatttggtaaaagtcgacatgtgtatcgatttgaaaggcggcatttccgattcttgttgggcttatgtagtaggagaatctacacctgagatcgaccgattgatggaagtaacgaagaaagcattgtacatcggtattgagcaagcacaagtaggaaatcggatcggcgacatcggtcatgctatccagacatatgtagaaggtgaaaatctagcgatcgtccgtgattttattggtcatggcgttggccctacgatccatgaagaaccagccgttcctcattacggagaagctggaaaaggtttgcgattgaaagaaggtatggtcatcacgatcgagcctatggtcaataccggaacttggaaaatgaaaatggatcctaatggttggactgcttatacaagagacggcggactatcttgccaatatgaacatacattggctattactaaagatggccctagaatcttgacatcacaaggagaagaaggtacctattgattcagccaattaataggtacgggagaggtacatgaaagtttggaacaaaataaaacaaaatgaaaatctgatgcgctttattgagacgactcaaaagcgcatcactgattcagaaatgagtacgacctcggttgtcgttgcttattatttactcttgtctttatttccattgattattgcttttggtaatattttgccgtttctccatatcgatcaagagactgtgctgacctatttacgagaagtgattcctgagaccgtttaccagtttattggtcctgcaatcaaggaccttttgacacaaagttcaggcggtttgctatccgtttctgctttagcggccttgtggtctgccagtcaaagtattaacgctttacaaattgcgatgaataaagcgtatggcgtagaaaatagaaaaaattttttgatcgttcgcttcttctcgctgatcgtaatcgtcttgttcatgattgccattagtggagtaactatcgttcttggtttaggacagctgattttagatgctatccaaccgattgtacaaatacctgtgaactttattgatcagttccaaaccttgaaatggccaatcacattggtggctttatttgtcatcatgttcttgatttatttaattgtccctaatgctcagttgaagttgaagacgattattccaggtacgatcttcgctaccgtcggctggatgctgttatcacaagtgtttagtatctatgccagatattttgcaacgaggatcagcggttatcagatcataggaagttttattgtcctcatgctttggcttaattttgctgctacgatcatcattttgggcggaatcatcaatgcagttgttcaagaatacgtgacgggacatcaaatcaaaaaacgtcgagatccaagccgaaaatggttcaataaattgaaagctaaattttctcataaaaaaaagtagaaacaagagttcttattgtaaatttatatcagtaatttataataattatgactcttaattaaagtaggtgcccatatgcttgtttcttttagtatggttataagattttttctgacaattttattatcactgatattaacacctgtatttaaaatcatttcagtacaaacgggtatggtcgacaaaccaaatgaaagaaggataaacaaagttccaatgccttccgcaggcggactgcccatttttatttcatttgttatatcgactttattcttattccgtaaaatcattccacaatcgtatattgtgccgatcttgctcgcttctttggtgatcatcgtcacaggagtactcgatgataaatttgagttgacacctaaacaaaagagtgtagggatcttgcttgcctctcttattatttattttgtagcagatatacgtattgattcctttacgcttccttttattggctatgttcaattaggatggcttagtttccctgtaacgattttttggatcttcggtatcacgaacgcagtcaatctgattgacggtttagacgggttagcggcagggatttcattgattggtttaatcacgataggcatcattgggtattttttccttcatgcttccacagtgtacatcccggtcgttattttctgtcttgtagcaagtattatcggatttttcccgtacaatttttatccggcaaagatttatttaggcgatacaggagcgttattcttagggttcatgatggccgtcctttcactacaagggctgaagaacgtaacttttgtttcgtcaatttctctactgatcgtcatgggcgttccggtaacagatacgttttttgctatcattagaagaaaagcaaaccgtgtttctttttctacagcagataaaaaacatcttcatcaccgactaatcagtttaggatttactcataaaggtgccgtcctgacgatttatgcgatggctttgatgttttctttcacagctatggtcatgaattatactggaagaatcggaacgattgtattgattattgctatgctatttgctgcaattttattatttgaattgattggtctgattaacgagaaacatcagtttattttaaaaacattgcgatttttagggaataaagagtatcgtacgcaagtaaaacagaaatatttgaagaaatggaaccgtcatatagatgaataacaaattaaaccagccaattcttattagtattgtaacggcgaacagtgataagatttttcggacactagataattttatttccactgtaaaagatgaaacagcgataaaaattcggatttttgacaacaactcccttccggaatataaaagcagactaaaagaatatgtgacatatccgtatatcgaaatctattttcatgatgaaaattccggattcggttatggacataatcacaatctgctgaagagcgattgccactatggcattatttgtaatccagatattttagtggatgaagaaacagttacagcattggtgttgttactgaaagaacatcccgaatgcgcgatgttagcacctaagattcttaatgaagatgggaccactcagcacctcatccgtgagcggctggctgtttttgattatgttttgcgctttgtgcctttcaaatgggtcaaaaaaaggtttgataaacggctagctgtctttgaatgccgtggcttgcccactaatgttgatagttatgtgcgaatgatctcgggcagttttatggtagctgatattgataaatttaaagagataaggggatttgatgagcgtttcttcatgtactttgaagataatgacttgtgcttgagttttgaaaaagcaggttacaaattattgtacacacccttttatgcagtcgtccatttttatggaaagggtgcacatcgaaatgcaaaactttttcgtgtatttttgacttctatgatgaaatttttcaataagtgggggtggcgttttttctgatgaaaccagaaatagtagtagtagtcgtgctatatcagcaactattcagccaatctccaacttatgaaccattaagcaaagcacttagcgaaaagcatattcagcttgttatttacgataatagtcctcaaagacagcaaaatgagctgtttgaaaaagaaaacaccatttactatcatgatccgcaaaaccctggattagcggcggcttataattatgcgttgtctcaagcaaatgaaagaacacgttgtatcgttacattggatcaggatacgaggctagtcgacgactattttgaaatcttgcgtaaggtagcttttacagatgaatgtgttgctgcagttccgatgattttttctgggggacggcaagtttctcccgtctattcaaatcattatatcaatcgtacagcacaagcagtagaagtagacggtacgacagctgaaagaatcatggcaatcaattcaggtgtggcatggtctgtcaaatttctaaaaaagattggcgggtttaatcctgctttttctttagattttttggaccattggctgttttggaaagtgaatcagttggaaaaaatggtggagatactaccagtacgactggaacatgatctttcggtattagactatgaaaaagtttcaagcaatagataccgttctattttacaagcagaaaatcgattttatcatgaatatgatcaaagacatttatccagtcaccgacaacaattattgttaagaacagttaaacagtttttgaccgtcaaaaaccggcatatctggcggatgactttgcgctcatatgttaagaattggaaggtgtgaattcgtgcgttcggtttgtatagctacctttaatgggggcagatatttaagagagcagttggatagtattttatctcagctttcagcagaagatgaagtgattatttctgatgatggatcagtagatgatacatgggatatattgactgaatacgcagaaaaagatagacggataaagcttttttcaggacctcgtcaagggttaatcgctaattttggctatgcgattcagcagacgaaaggagagctaatctttttggcagatcaagatgatgtttggttagagacaaaagtgaaaaaaatcactgactattttgaacagcatccggatcagttagtagtcgtttcagatttgatcattgtgaacagtaagctgcaagagatccatgcttcctatttttcattccgaaattccaaagaaggatgggtcaataatgtgatacgaagtcattatattggtgcaggtatggcttttcgctcttcgttgaaatccgatattttgccgattccctcagaagtgcctatgcatgacatgtggatcggtttgttgggaggaaggaagactgggtttctgagagaacctttgacactgtatcgaagacatgatttaaatgcgagtgagattgaaacgcattctaaattacgccaaaaaatttcctggcgtgttcatctgattacggcgttgatcaaacgaaaatggtttaaacgttgataaaagatgtttaaatccttaatatttccatgacaaatataacgattgatgagataatagcaaagtgaaatttgaaatcaaaaaggagagcatatatccatgaagggaatcattcttgctgggggcagcggaacacgtctgtaccctttaacaaaggcaacatcgaaacaattgatgccgatttatgacaaaccaatgatttattatccaatgtctactctgatgttggcgggaatcaaagaaattctgattatttcaacgccacaagatacaccacgtttcaaggaattgtttggaaacggaaatgatttaggactgcagatcgaatatgcagtacaagaaagtccagatggattggcacaagcatttatcattggagaagaatttattggagatgatagtgtctgcttggtattaggagacaatatttactacggtggcggtctgtctaaaatgttgcaacgagcagcttcaaaagatgcaggcgcgacagtatttggctatcatgtcaatgatccagaacgctttggtgtagtagaatttgatgagaatatgcaagctttgtcgattgaagaaaagcctgctcagccaaaatcaaattacgcagtaactggcctttatttttatgacaatgaggtgatttctattgctaaaggaatcaaaccgtcagaacgtggagaattagaaatcacagatgtcaataaagcatatttggataaaggaaaattatctgtagaacttatgggacgcggatttgcttggcttgatacaggaacacatgaatcattgcttgaagcatctacctttatcgaaacgattgaaaaacgtcagaatttaaaagtggcttgtttggaagaaattgcttaccgtatgggctacattgataaagaacaactgctagcccttgcacagcctttgaaaaaaaatcaatacggtcaatatttattgaatttggccgctgaataaggagttcctacagatgaaagtaacagatacaaaattaacagatgtaaaaatcgtggaaatggatgtctttggcgaccatcgcggtttttttacagaaagctattcaaaagcaaaatttgcagaacatggattagattatgactttgttcaagacaatcattcgttatctgctgaagctggtgttcttcgggggctccatttccaaaaaggagaagctgcacagacaaaattgattcgtgtggttactggagcagttttagacgtagtagtggacatccgcaaaggcagcccgacttatggtcaatgggacggatttatcttatctgaacataatcatcgtcagttgcttgtacctaaaggatatgcacatggattcgttactttgacaccaaacgtgaacttcctttacaagtgtgataattactataatgcagaagcagatggaggcatcgcatttgatgatccagatttagcgattgattggccaattgatccatcaagagcgattatgtcggaaaaagatcaccgtcatccgacattaaaagaatttgaagcagaaaatccatttgtttacggagaaatctaagaattaaggagaaattttcttatgaaaaacatcattgttaccggaggtgccggattcatcggctctaatttcgttcattacgtggtaaacaatcatccagaagtgcatgtcactgttttggataaactgacttatgcaggaaacaaagagaacttggctggacttcctagcgatcgcgtagaattagtcgtaggagatgttgcagatgcagaattagtggaccgtctagtaaaagaagcggatgcagttgttcattacgcggcagaatcccataacgataattcattaaaagatcctttcccatttgtacaaacgaatatcattggtacgtatacacttttagaagcttgccgcaagtatgatgtacgctaccatcacgtatctactgacgaggtttacggagatcttccattacgtgaagacctaccgggacatggagaaggcgaaggagaaaaattcactgccgaaacaccatataatccttcaagcccatattcttctacaaaagctggttcagatctgttagtaaaagcgtgggtacgttcttttggcttacgtgcaactatttcaaattgttcaaacaactatggtccttaccagcatattgaaaaatttatacctcgccaagtaacgaacattttaagcggtattcgtccaaaactatacggtgaagggaaaaatgttcgtgactggatccatacaaatgatcattcttcagcagtgtggttgatcttgacaaaaggcagaattggcgaaacctatctgatcggtgcggacggcgaagaagataataagaccgtgatggaattgatcttagaaatgatgggtcaaccaaaagacgcatacgaccatgtaaacgaccgtgcagggcacgatttgcgttatgcaatcgattcgacaaaattgcgagaagagctaggttggcagcctgagtttacgaacttccgtgatgggttggctgacacgatcaaatggtacgaagaacatgaagactggtggaaaaaagaaaaagaggccgttgaagcagcatatgccaaaaatggacaataatacagaggaaatttcactgtattaatggaaaaacacatgtgaggcaggcgctcgcctgtctcttttttaaaataaaaatcaaggagcggataaccatatgtttttattaactggaggaaatggacaattaggtacagaattgcgtcatttattagatgaaaaaaatctgccatatgtttcaacagatgcaaaagacttggatatcacagatgccgagaaaacaatggcttatattacagaattaaaaccggatgttattttccattgcgcagcttacacagcagtagataaagcagaagatgaagcaaaagaattagatgagaaaatcaatgtcgatggcacaagaaatgtagcacttgcagcaaaagctgtgaatgctcaattcgtctatatcagtacagactatgtcttcgatggaaaaaacaaaaatgtagagtacgaagtagatgaccaaacgaatccactaaatgaatatggtcgtacgaaattattaggtgaaaaagcagtagaagagattttagaagactattatatcatacgaacttcttgggttttcgggatttatggacacaatttcgtcttcacgatgcaacgcctagcggaaacccgcgacaaactgactgtagtaaatgaccagttcgggcggccaacttggacacgtactttggcagaatttatggtatatgtcatcgaagaaaaagcaccattcggtatttatcatttgtcgaatgaaaatagctgttcttggtatgaatttgccaaagaaatattgaaagatacagatgtggaagtagcgcctgttacatcggaagaatttccacaaaaagcaacgcgtccgcagtattcagtcatgagcctgaaaaagacagaagcgttaggatttgtcataccaacttggcaagaagcacttgcgcaaatgctggaagctgccaaaaaaatgaataagtaatttcctttttatcaaatagaatttggagcatgatatggaaaaacaaacaagaagtgcacgacgaaaagaaaaaccaaaagcgaatcaggcagattcgaatttggtgcttgacctgtttctaaaactccgataccttattggcgttttagtcatcgtggtcattgttacttttaatttaaacggaagttcacttggtgtttgggataaatatgtgtcgcaaagagacgatgggaaaaaaactgatgtgatttttggacagaatcgggaagtacggtcagatgaatggctggtgcagacacctttttacctctcacaagctgaagaggactttccgttggtgaacgaagattattcactgaacggacaaaacatgatcattgcgtataattctcctgtaaaggatattacggttatcggaaaaccattcaactggggattctttttcctcggaagagatcgaagcctttccttttattgggcgatgaaattagtcgtcatggtcttgcttggattcgaagtactgatgatattaacgaagagaaaaaaagctctatcgctgatcggtgcatttgcgctgacattttctcccgcagtccagtggtggttcatgcagcatgtgggcgatttgattttctttactttgggattgatgactgctttttatcattatttctacaatcatgataaaaaatggctacgaacgttgatgatgcttttggtagttattttcggtattgggtttattttagtgatttacccagcccatcaagtgatgctggcgtacttgctgattttttattttgttggcctgcttatttactacagcaagaaaatttcttgggatctgttggatgtagtgttgattggaggggcagttttatttattggcggagtcatggttcatttctggttgacgtcaaaagacgcattgttagcttctttggataccttatatccaggaaaacgagtcagcaccggtggaaagtggacgattggcgaatttttttctttcctgacaaactggaaaatcccttttgaagacatcaactattcgaataactctgaagtggctttgttctatcacttctttccgactgtattcctagccagtccatttgtgttatttggcaaaaaagatagtgaacaaaagttattgggacgtattttgatgattttttgtctgttttctatcttttggattaccgttggattgccaaaatggctagcagaaattactctgctgtcttatgttcctcctttaagagccatccttacttttagttttgcggcttgcctattatcaatttggttcatcgcttatatttggagagaagatgttattcctatttggtataaattcattttactggcagtaaacgcatggtcttatttctatgcaattactcattcgaagatggataattatttttcagatttcgaaaccatcgcagttgctgtgttgggaacagtgattctagcttttgcattatttggctggagacgctcgttttatcttgcttttaccgccgtgatcatcgcatctggtttctttgtcaatccagtcgtagaaggtactggagcgatttttgaaaaaacactggcaaaagaaatccgaaaaatcgatcaacaagattctggcaaagtctggttgactgaagatgaactgtataatttcaccccaactttgggtgtgaaatctttcaatacagtccgcttttatccagatatggctgcatggaagaaaatcgatccaaaagaagaacatgagaagtattataatcggtatgctcacacaagagcttttatcgctaaggaagatacaaagttcattttagatcgtccagatatgttctcggtcacgttgaattttgaagacgcagaaaaattagggatcaactatgtaatcagtaagcgaccgttaactgattacaatcagttatatgaagctcaattcacacaactatatggaccggacaaagacggttatatgatttttaaagtagaatatccggattatccagatgtaccacaaacacaaactcaggaaaatcagctagtcttacagtaatgggctagctgagaataaccctgaagtattattagaaaggagagtggagataattcaagcaatcgtacaaaaatttgtcaacaaaatgagtgctggtttcttgcttttgttgctgacgctggtcttttctgtttggacagcaggattaagcttcccaaccactttgtttatatataacaacagttcgctacttatcacttttagtgtggctattttgctcattttaaatgtttataaagcaaaaggcgtcgattttctttatctaggtgttgcgcttgcacttttcattttcttttcttactttcgggaattaagaaatgagtctttatttggagatttactgtttcctttgattattttattttgtttagtaattaaatggattgagtggacaaaatgggatcgcggtatttatctgcttgtctttacggtcttcctcggaatcacattatatcgtgtatttacagagatccaagtaccagaaggacaaagcatctggactccaggcaattcgctttctgatatttggatcaatacgaatacaatcggaagttctttgatgactcttgctttattgatcagcggatttgccagttcttttgaacggtggtatgttcgtatcatcggtgcgatagcagtcgttgcagcctttttaggcatttgggtctgtcaatcaagaggcgcattagttgcattgattgtttttgcgatattggatcttttccctaaatcattgatgcgtgtcattcgtgcgccgtttattgcctatacggctacgattcttttagctttaccgatttcttatctagccgctgtttccgaaaaagtcaatttgtttaccggtcgagaagatatttggcataaattctatcagacgctaggagaaaaatctgagcaagttttacttgggatgaaaacattcatcttccaacgaggaaaccaatttttaggaaaccacaatagttataattctattttgaatatctatgggttaatagggtttggaattgctgctttgctgcttatcctttttattggtcgcttaacgttgaaagcagatttatccaacgggcagatgacttttatctgggccttttttgcggtgatgatgcagtcatttatggaggatacattgacttcatacccgtgggttccgattatttatatcctgttggctatggccgttcatcgctatgacgaaacgaaagttatggaagaatactatgacatagaagagccatatgacgacatgaatgctggagatccaagttatgaggaacaaccagatagcgctcattcttccaggatccaacgctatcattgataggcgcaaaatacgagagaggctgtgacaaccgtcgcagccttttttggtttattgcaattgtctagcatcttctgtaaaatagaaacgttagagaaaatcttgtatcatagaaaattaagaaataaataagaacgcagctcggtaccaaaaatatggtaaaatggcacttgactgtaattcactgaaatcgcttggaggaacacaaatgtttaaagatttgtatttatttatgaaggacatttatcagaacagaaaattactgctacagttttcgatcaatgacttcaaatcaagatatgcaggatcgtttttaggaatcttatgggcgtttatcaatccgttatttactgtattgatttattggctggtatttggcgttggattgaaagcacaaatgatcgatgcaaaatacccatttatcgtatatttagttacagggatgattccttggttcttcttctctgatgcctttgcatcaactacggttgtttttcgggaatatacttatttagtaaagaaagtcgtattcaatattcgtatcttgcccacgacgaaaatcctatctaatctgtacacccatttattcttcattctgattggcatagctgttgcgcttataaatggtatatatccttcagccatgtctttacagctgatttactatctattttgcatgtgtgctttcttgacaggattgacttggctgacagcatccatccaaccatttttaccagacatcatgcaattgattacgatcgtcctgcagttgattatgtggacattgccgatattatggagcccgaaccagtttgactcaggtcttgtaagcatattgaaattaaatccgctgtactatgttgttcaaggctatcgtgagtcgtttttaagtgaagcttggttctgggagcatggaacatacactttgtatttctgggtgttcacgttagtaatgttcgtaatcggctctgcagtgttccgtagattgaaaccacatttttcagatgtgctgtaaggagaatagctatgacagaatatgcaattagactaaaagatatcacaaaatcttataatatgtacgcaaaaccgtcggatcgatttcgtgaagctcttaatccttttaagaaatcctatcatgatgtgttttatgcgttgaaaaacgtgaatgtagaaataaaaaaaggtgagatgatcggtttcgttggagaaaacggatccggaaaatctacgatgttgaaaatcattacaggggtactgacaccaacatccggtacgatggaaatcgaagggaaaatctctgctttgctagaactaggttcaggattcaatcctgagtattctggctatgaaaatatctatttaaatggaatggtactaggcttttcaagagaagaagtcgatgaaatggtcgatgatatcattgaatttgctgacatcggagaccatatttatcaacctgtaaaaacttattcaagcgggatgttcgttcgtctagcttttgctgtagcaatcaatgtgaatcccgatattttgattgtggatgaagcattggcagtaggcgatcttgaatttcaactaaaatgtatggaaaaatttacagaaatcaagaactcgggaaagacgattttattcgtttctcatgatatcagttcgatccgtcgtttttgtgatcgttcctattggttgaaaaacggagaagtcgtcgaatatggcgatacgatggaagtaacgacgaattatgaaaactttttaaagaaaaaatcagttaaaacagtggatcggaataaaaaccaagtagaacggttcgccgctccagatatcgtcgacgtgacgaaagcggaattgttggataaagacaaaaatccggtggatatgctggaacaaggagaaaaactatacgttaaagtaacttatgaagtaaaagatgatacaatcaaaaatccggttttaggaattgcgctacgaacagtcgacaatttttatgtatgcggacttaatactctactagatggtatcaagattccttggaaaaaaggagagaatatcttttatctggagtatgaaaagttaggtttgttagctggtgaatattattttgacgttgcggtctttgaagaaaatgcaacggttcctttggtatataagacaaagtacatgaacttgtttgtcagcggttcttatatcggagaaggcatcgtggtcttagaccataaatgggaagaagggactcatagcaatgaaatatgattttgaaatggacctagatgaacaaagcagtgtgggaaaaattgccgcacagatcaaaccaggaagtaaagttttagagtttggtcccggaaacggccgattaacgaaacatttaatcggagcaaaacaatgtgaagtgagcattgttgagttagataaggaattgttcgattttgtcagcgaatttgctcaagatggattttatggtgatatcgaaagttttgagtgggcaaactattatgctggacagacatttgattacgtcttgtttgcggatgttttagaacatttggtagatcctggaaaaacattgaagaaagtcagagaatttttgaatgaagaaggagagatcctgattacattccctaacttggcgcataattctgtcatgatcgatttgttcaataaccaattgccgtgggcttcttatggtctcctagatgaaacccataattctttttatactcatgatggcttccaaaaagtttttgaaaaagcgggattattcattaatattgaagattatttgtacttagctgtaggtgatacagaattaaaatcaacttatgaagaattgccggaagctgtacgctatgatttcaaaatgcgaccatttggtgaagtctaccaatactttttctcattgatgaaacatccagtagcacaaagttccattgcagagccacaaaattctaattatgtaaaagtgttagaagtaacccagcaaacgaaacaagatgaaacaatccaacaaataccattcaataatttcacaggggaaaatgagacactaagtttccccgtatcagaaacaacagaaagaatggtgtttcgcttcgcgcaacaacctagctttatcgaattcagcgcagaagctgccggagaaaaactaacatttatcgattcgaatgctgtagtcaaaacagtaaatgattgttatttgtttgatgggaaagaattaccagagttcgttctaacggatatttctgggaaagaagtgactatccattgtcactatcgctttatcggggaattgacaccaacaatgaaagaattgttggaaacgattcgtcccatggctgaagtcacaaagcagctttctgagaaaaatgacgaattagaaagagaaaatcatcatcttcttgaggaaaatacaagactagaccatacgttaaaaacaaccacaaatcgctattgcacattgttggaaagtgatgaatggacaataaaacatagactaggacgacgtaagaaagaaacttcgaaaaaaatccaagaaaaagaactttctatatgtattgacgagaaaatctgggatgcagaaacaaaaatattaaaaatcatcggatggggaatcgctaattcggatcgccagcccttgtcctataagttatcagctgaccaatcgccatttttcgaagcaattcctgtttcacgagaagaagtcaatcaagcagaacagctcgcaaaaggaacagaagcgggatttgagttacgaatcctttgcgagcaagaacgttcattcttagtggaagcagtagctcaaaatggccaatcatggatcattgaaatgtaaataatgattaacttataaagataaggagtaaacgaatcgtgcaaaaaaaagaaattgccgtatttatcgatcaaatcactcgtgaacgggccactggcgatttgcttattgtgggctgggcaattgatgaagtgaccaaagaaatccctacgataaaggtagaaaaagaaaatgtgattgctgaagcaacacatgtcgtaagattggatatcaatcatttatataatcttgatgttaagacccaaagcggttttaaggtacgtttatcagggaaaatgagaggaaaagccatcttagacttccaaacagcgagacatcaaaatggcatagctgtgaaattaaacggtaaatacccttatgatgacggcattgaatcttcatgggaaagaaaaaaaagattactgaaaaaagggataaattatgcaaggactcatggcgtaaaaaaagcgatccgtcgggtcaaattggaattgaagccaggatcgatcgactatgcagagtggatcagtcgtcatgagaaaccagatttgaaagagcaaaggaaagaagcacaaggatttgcgtaccgtccattgatttccatacttatgcctgtctataacgttgaaatcaaatggctcgaaaaatgcattgattcggtactggatcaaacgtatgatcattgggaactatgtatcagtgatgatgcttctactgatccagctatccgaaagtgtctggaatcctatcaagcaaaagatgatagaatcaaagtcgttttccgaaaagaaaatggacacatcagtctggcaactaattctgcattggaaatagcagaaggagaatttatagcactcttagataatgatgatgaattaccgccatttgcattatatgaagtggcaaaagtgctaaacgtacatccagaactggatgtgatctacagtgacgaagataaaatcgatgcagatggcaatcgctttgatccgcatttcaaagcagactggtcgcctgatacattgatgggaaataattatatctctcacttaggcgtatatcgaacaagcattgttaaagaacttggcggtttccgtaaaggctatgaaggttctcaagattatgatttggtccttcgtgtgacagaacaaatccctgcagatcatatttaccacattgaccgagtcttgtatcattggcggacgatcccaggatcaactgcaagtaatggcgaagccaaaagttatatctatgattccggagtgaaagcattgacagatgccctgtctagaagaaacatcaaaggaagcgtacgtcctggcagaatttctggattttatgagattgcttatgacgtcttgcaagaggatttggtcagtgtgatcattccaacgaagaatggctatgaagatctaaaaacttgtgtggattcgatcatcgaaaaaacgtcttattcaaattatgaaatcattattgcggataacggaagtacagatccaaaaatgcaagaattatttgcagaatacaagcatcagctgaaagaccgctttatcgtagaattgattgacattccattcaattattctcgaattaacaatttagcagcagaaaaagcaaacggcaaatactttttattcttgaataacgatacagaagtgattgagccagattggatgacggtgatggtttcttatgcacagtttgatcgaatcggctgtgtaggagcaaaactgttttatccagatgatacaacgcagcatgcaggagtattattaggaatcggtggtgttgcagggcatgcattgaataactatgatcgaacacattgtggttatttcggccgattggtcattgacgtcaattacttagcagtcactgcagcttgtatgatggtcaaggcagctgacttcaatgctgttaacgggtttgatgaaacattagaagtagcattcaacgatgttgacttgtgcttgaaagtttatgaactgggtcgttacaatgtctatgcacatcaagcagaattgtaccatttcgaatctaaatcaagaggttatgaagatactccagaaaaacaaagacgttttgctggggaaatcaaaaaaatgcaagataagtggccttcttatattgctcatgacccattttataacgataatctaactaaagaaggaatcggcaatttttcgttgagacctgattgatcaaagaactgtattttcatttttattgatgaaaatacagttcttttaatttaattatatgaatattgtaacttgtgaccgaagagatgataggaaaaacacccattcagtaggaagcatgtgatacggtttttgtccaactctctgttaggcagaaatacacatataagcctacaatagttgccttttctagtttcttttaatttcttttacaatttggttattcactaggtttttaaactttgctatggtaagatgatagaggcattattttatggttaggagtgtatatatgaataaaaatggggagtggaatgcggcacgcaggatattcattatcatcatggatgtacttgtattgaatgtgtcgatctatcttagctttttgctcaagttccaaggagaagtcccagcaagaaacttagagacctttcagcattcagcaatttttatttccattatctttattgcgttgaatattttgttaggagcttatgtattctataaccgaatgatcagtgatatcgtcttcattactgttattggacaggtgctgatagcattgggaatcatggtggttacttttgctggacgttggtttgcatttccgcgtggcgtcatcgtgctctcgtttatacttggcacgatattacttagcgtttatcggatagtcgtttataaactatacttaagagtcagtcgtgataagaaagtacttatcgtaggtttggagaaagatgtcgcaccagcgatccaaaactttcaatctaagaaaaacaacaaacataaggttgaagcagtagtgatcgacaattattatgaaaacacaaaaaaattgattgatgacatcgatattgtctacttggcttcaaaaatcccagaagatgaaaaaatcaatatttatcaattagtgacaaaaaaagagaagaagctgtttttaaatacaacttttgaaaatttaacgatgatcaatccgaacatcatgaatttcgaagatgaaagtatcattgaagcttccggtttcaaaattcagccggaatatgaattattcaaacgtctctttgatatcatcgtttcgcttattttactgatcctcgcttcaccttttatgctaatcacagcgattttggtaaaaacaacttcacctggaccaattatttataaacaagtacgtattacgaaaaatcaaaaggaattttcaatctataaatttcgttccatgagtgcaacagctgaagcaaaatcaggcccagtcttggcaaagagcaatgatgcacgtgtgacaccagtaggcaaatttatccgtgccgtacgttttgacgaattacctcaaatctttaatgtattgaaaggcgatatgtcgatcgtcggaccacgtccagaaagaccatttttcgttgatcagttcaatgaagaaaatccttattattatttaagacacaatgtacgtgcagggattaccggatatgcacaagtatacggaaaatatgtatcagattataatagtaaactacgttttgatttgttgtatatcaaaaagtattccttactattagatttaaagattttacttcaaacaatcaaaatcttatttgataagatgtcctcacaaggactagatgaagatgaaaatatcagttcattagcagaaatcgacttttcacaagagaaaatttatcgctaagctggaggaaagaaatgaaatgagccatccgatatttagtataattgttccagtttataatgccgaagacacgatcgttcatactatagaagttttaaaaaatctggcatttgaagaatatgaagtgattttggtcaatgatgggtcaactgacaaaacagagcagctgattcagtcagctatccaaggagatagtcattttcaactttttacaaccgaaaatcaaggacctggacttgctcgaaatgaaggcatcaagcaatctacagggaaatatgtattatttttcgatgcagacgatgagccagtcaaagaaattttggcagattatcagcagttgtttgaacagtatcctgaagcagatttgcttatcagttcttttacattccgcacgctaagcggggaagaaatcatttcggaaaaggactatcttgttccagaataccaatatacaaatcatgaacagttcgtggatgatatgtatcatctgatgaatcagcagttgatgtatgtggtttggaacaaatgttacaagagggaaatcttgatggaaaaacagattctattcaaaaattacagcagttgtgaagaccgtatcttcaatttgaactattatgaacattgtcagcaagtaatattgaatccaagaatcgagtatatctatcattttgaaggtggaaaagggataaccaaccaatataaaccgaataaatttgaaacctttaaagaattttatgaattagcaaatgtcgtgacaagtgataaagacaaaccaggtatggcttctcttcttttaaaaggaacaacctctgtcattttttctatttatgagaatcctgagcggactgctaaagaaaaaagagaagaagctatgcatatcttgaatgatccagccatccaagaagctaaaaaggttgcattgactgattccagcgcgaaaaaagtaacaaaatggctgtataatttgccggctcctctattattatctgcggtgaaagccggcagctttgtggaagtgaaaatgccaagcatcatggcattgttgaagagagtttattaaaaaagtcggaataaggggttgtgactgtcttttgtcacaacccttttaaaaacaaaaaatagctgtttatctatcctttttcagtcagtaaagaaagaactacttgcataagattgaaaaccgcctctatttatgagaaaatagggaagattaataaaagaatggttgaggcaactataatgtacagtacagatcctgaattaaaaaaaattcaaaaagtaaatctcgaaatggcacaatactttgtagatttttgtaaaagtcacgatttgttgtgttatttttgtggtggcggcgcaatcggagcaattcgacataaaggttttatcccatgggatgatgatttagattttttcatgcctagaagggattatgatcgcttagctgaattatgggaaaccggcccacaaaaagataaatttgttttattaagaccaactctgacgaatcacgatcggaactcctttacaactatccgtaacgtccaaacgacctttatcaaaacgtatcaggaagatttagatatccctcatggtatccaattagatatttttccgttagatactgcacctgaaaagcaagcagaacggaaaaagcaaaagatatgggcaatgatctatgcgctttatcgaagtcagcaagtaccgcaaaaccatgggaaagcaatggaattagctggaaagttattgttaaatagcgtatccgcaaaaacgaagtataaaatatggagatatgctgaaaagcagatgaccaaatacaatgataacccgacgaatttcgttacagaactttgtgtcggtccacgatatatgggaaatgtttatcctgcaaaagactttgaatctgctgtgtgggtaccattcgaagatacagagatgccagtaccaattggctatgatcattatttaagtcaagtttttggcgactatatgcagcttccccctgaaaaagatcaggtttctcaccatgaagcagtttatattgacccagaacattcatacaaaatgtacaaaggaaaatattatttaactaaaggagcagaaaaaaaatgattacagctattattattgccggcggtgtcggtaaacgtatgggacaagatatcccaaaacagttcattacaattgaaggtaaacctattattatctatacgttagaatcatttcaaaaacatccacaggtcgatcggattttagtcgtttgtaaatctggctgggaagaaacgatgtgggcgtatatcaaagaattcaatattagcaaagtccaatgggtcatcacagggggatcaaaaggacaagagtcaatcaataatggtgtccagtttttgaaagattactctgaagacgatgatacgatcatcatccatgatggtatccgtccactagtagacgaactggtattgtcagatgtaatcgttaaatgtaaagaatttggtaacggtgtaacctctctaccttacaacgaacaaatttttatcaagaaaacagaagaaacgacggaacagtatgtcgatcgtaacacattgcggcgtgtctcaactccacaagcttaccaatacggaaaactacgggcagcatatgaccgagcagtgaaagaagacattggtatgactgattcttcctatacgaataccatgatggtagatttaggagaaactttatattttgctgctggttctgataaaaatatcaaattgacaacaacagatgatctagaattgttcaaagcatatttaaaaatgaaagactaggagaaagatgatgacgttgattaaacaaccaatgtaccaaaaagatttggcaaaagtgatcaatcatacaccaaaaataaaacagctacatggcaaatccgttctgatgattggcgcttcgggaatgatcggctcttttttgattgatacgttgatggctgctaatgaacaactagacatcaaaatcaaagtatatgctatgggcagaaaccgtcagaagcttgaaaaaaggtttgccagttatcttgccttagatactttcgaaattgttgaaggtgacgtcacagaacccttaccaaaagaaattcaagctgactatttgatacacggtgcaagtaacacacatcctaaggcttacgcaactgatccaatcggtacgatcatgactaatcttgcaggtacagagcaagtattgaaacatgcagtagcaacccagcctgagagagtattatttttatcaacagtagaaatctatggcgaaaatcgaggcgatatagaaaaattcacagaagattactgcgggtatatcgattgtaatacactgagagcaggctaccctgaaggaaaaagagtcagtgaatcattatgccaagcctatatcgcaaaacacgacctcgacatcgtgattccaaggctttgccgtacgtttggtccgacgatgcttttatccgatacgaaagcatcctcacaatttattttaaatgcagtcgaacaaaaggatattgttttaaaaagtgaaggaaatcagtatttttcgtatgtttatgttggagatgctgtttctgctattcttcatttactgcttgaaggagaaaaaggagaggcgtacaatgtttcttcagaaaactttgatttacgactaaaagaattagcacaacagctagctgatatcagcggcaaacaagtaatttttgaattgccggatgagattgaacaaaaaggtttttcaaaagctagtacagcgatacttgataacaagaaaatcaaagaaaatggttggtatccaatatttgaattgaaagaatcattgatacacacagtagaattagttaaaggtgagaagcaaaatgtgtgagattagtattattgttcctgtttataaagtagaaccctatttaagaaaatgtgtagattcaatcttagcgcaaacatttactgatttcgaagtgatattagtagatgacggttctcctgacaacagcggtaaaatatgtgatgaatatgcatcgaaagacagtcgtgtccgtgttatccataaaaaaaatggcggattaagtagcgcaagaaatgccgggattgatgtggcacgaggaaagtatttaggttttgttgacagtgatgattatatcgaaaaagatatgtatgaacttttgtatgacaacattgtcaaagaacaagcagatctttctatttgtggagtatatgacttatacgcaagtagggagcctaaaattttaatgccacaatatatggttttatcgaaaatagaagcgatgaaaatgattttagaagcaaaagttgtttctgttcaggcttggaataaactatacaaaaaagagatttttgatactatccgctatcctgaaggtgttatcacggaagatgctgctgttatcctatctgtattagaaaaaacagaaaaagtagttattgacactcagcagaagtattattattttcatcgggaaaacagcatttcaagtagtggttttggggagaaagatcttgatacaatcaatgtttggaaagagaatgaaatttggattaaagaacgctatccaaaattattgccagtggcacatactagaacttgttgggcacattttatcgttttagataagattgtgattagtaatagtgaatgtagctataaaggaaccaaagaaatagtaagatttttaagggataattatttgttcattttaaagaatcaatattttactagaaatagaaaaatagcggcgacagcattaaaaataaatttaaatttatataaaaagctttccatattggaagaagagaagcataaaagtaagcatagttaggtgagtggaaaatggatgtaaaaaaaataaaggttttttctgataaaagtaaaaaaatttttatagttgtctttggagtcgcattgaccattcggttaattaatttttatagtcttttgccttcaaaaatcgatacagcattattttcgttgataactgtatgggcctttgccattttaataattgatgcgttatctaaggacgtaaaaatttataaaacagattatcttttattaggatttatattagctattttgtgttctacgttctttaatggacctagtgggataattgaaaacattaaactagtcatttggcaggttatttatttatttgttgtttatcgtattggaagagatagtattgattctgaatttcttacaaaattcgaaaaattaattataggtatttggaatactttggttatcatttctttaggaatgttctttacgcactattcttacgtagcaccttttgataaattttataatggctttagagcaggatttgtcgaaaaccgtttgtatggtattttttctgatcctaattttgccggtgcaacttctgtagcagttgtttttcttgctgtaaagctattaatgacgaataaaaacaaaatggcaaaaatttatagcatagttacgatccttcttcaatttgcttacatcattttgtctggatcaagaacagcagagattgctttggtattgtgtgcttattttgctatcttctttattgtctataaccgatttgggaagacgattgcttctaaattgttattggcagtaatctgtggggttattggaactggagctgttttaggaattgctgaagcagggaaatatgctgcccctaaattgatcaatataacagcaagatatgttcctagaaagtctgaaaatccagataaagatcagaattctatcagtttaaaacgggatgatgttgtaaataaggacgatgtgtctaataatcgttttgctttatggaaaagttcgtttgagatttttcaaagtagtccgcttgtcgggagttcacctcgtaatttggttaattatgctcaaaaagaattaccgaatacgttcattgcaacaaaaaaacaaacttcccataattttatcttctatttattagcaacaacaggtctgttagggactataccgctacttgtatttcttggaattaagatttggaatacattgcgacaactatttatgcgtactataaaagactacgattcgtatgtattaaataccatggtagtacttgcaattttgatttctgctatgtttttaacagaattagtattagtaaataaattaggaagcctcatcttttggctatatttgggatatatatcaaaaaaacatcctgtggtaggtaagggaggtatatcagaataatgagagaattaaagattaaagatatccaacgtataagcgtagaaatccttgtttatatagaccaaatttgtagagaaaatcagattgagtattcattattttatggaagtttaattggttcagagcgacatcagggttatattccttgggatgatgatttggatattattttgaccagacctaattatgaacgattaatccaacttcttaaaaatgatgattcgtataaattattaagttttgaaacgagagataattatagatattgttacgcaaaattagttgatcctaatacaaaagcggtaacgaagcaatattatagtagtgaagatcctgatttaggagtctttgtagatattttcccctttgatggatttccagaaaatccagaagaacgaaaacaatttggcgatttatgtgaactctatcgtgcaaacatgatgtttacattaaaccattcgtacgctatatccagatcaaaagttaaagcaatggttaaaagggtgatttattatcctaagtaccgtcgactgttgaaaaaaggaaattactcattctggaaaaataaatatgaagaattagtgcgtaagtatccgattgaacagacgaagtactgtgggtacatggaatttattaatgaagtatggggagtttttccgatagaatggtttgagcattatgaggacgtagaatttgaggggcataaatttaaagcaattagagatcggaaaaagtttttggaactgagatacggggactatatgaaactcccgccaaaagaagaaagaatttcacatcatccctataaattttatgaaaagtaactatatgaattaaattaatttgtaatcgaagtaaggatgaataagaatgatagactataataagataatgattattaccctagataaaaaatctgtcctttattcaacagacgcaattgaacttggaatagacgtaaacagttattttaaaaaaagaaatatgtttgtcaaatgtttaaatcatcttgacagatatattaatactactttttccagaatagcatatggtgactggaaaaaaagattaaatgggatagaattactaatactaaactcacattttttttcaaaatcagttatcaagtacgtaaataaacattatccacatgttcgtattattatttggtatagtaatcctgtttcagtagatacacctattgacttctttgatggactaaattgtgaaatctggtcatttgataaaaaagacgttgaacagttttacttaaattataataatcaatttattgatacgagtagcttaaaagtcgtttcacatgagaaaaaatataagtctgaattgtgctttataggaatagataaaggacgattaacttatttaacagaacttcaaacttttttcaaagaagtaggtatagattcaatgatctatatcgtagattctagtcgaaattcttcttcaacttatcaatatgaaaagccgttaagttatcaagaggtaatcaactatgaaggaaattcgaaagcgatattagatattgttcaagaaaatcaaacaggactgtctcttagacctattgagtcgatttttttgggagtaaaattaataaccaataataatatggtaaaatatcaggatttctataatgagcagaattgttttttactaacagaacgacctttatctgaactaaaacaatttttaaataccccatatattccggtaccagataaaatattagaaaaatacactctaaagaattggatcaacaactttatacgatttgattcagataaatgattatagttttttagaaagatgatgtgataaaacttgaacacgaaggcaaaaatggtttttcgtaacttatattatacggttggagcaaatttcataactttagctatttccgtactattgaatttatttgtgcctaaactgcttggagtaagggaatatagttactggcaactgtatgtgttttattcttcttatgttggttttttgcatttaggatggatagatggtatctatttaaaaattggcggtgaagaatatgaaaatctagataaagataatctaggttcgcagttttggtatttatgcctttttgagaccctattatctgtaggtgttattatctttagtcagttcttcatgcctccatcgtataagaaaatgattttgactttaacagcagtagtttctgttattacgataatgaaaacatttatattatatgtattacaatcaacaaacagaataaaagagtatgctcaattatctcgtggcgacagatatttatatgtaataatgataggaatgtacttttttataggcggacgaaactttttttggctgattatattagatatcatttcaaaactaatcatcactttatggggaatgatgcaaatttctgatatggtttggcaaagaaatatacttaaatttaaatctgttttaagagaaattgttgataatatcaatattggtagtaaattgatgttatcaagtattgcaggtatgcttattattggttcaattcgtttttttgtagaacaaagatggacaattgaaattttcggtaaactatcttttactttgagtatctctaatatgtttttgacgtttattaatgcaataggtatagtaatgtttccactgctacgtcgttcgaataaagagaaacttccatggttatttaaaacaataagagatttgtttgtaccaattacgtatagttttttaattttttatgttccagctagatatattttaagcatgtggttaccagaatatgctgatagtcttcaatatatgggaattctatttcctattgttatttacgagggaagaatgtctttattgataaatacctatttaaaaacaatacgtaaggaaaaaacaattttgtttgtaaatatacttactttatcattaacattgttgtttgctatagttattattttcttagttggaaatataatgcttgcagtaggactaattttatttagtttagcattaagatgtaatcttgcagaatttttcttatgcaaatacttagatgtaaaagtaggaagtaaaattatattagaaaccgtattaacaatcttgtttattattggtaacatagtattcgacggtgggttcttaagtatggttgtttatttaattagtttcttagtatatatatttattattagaaaaaatttggtaaaaagtgccaaagaattttggcatctaatgaaagccgataattagtttgatatttaagttaatagaaaataaatatgtgcaattggagtgaaacttgtggatactatattgattactggcggagctggttttatcggttcaacgctagcgaattatttgggaaaagaaaacaaaatcgtagtagtcgacgatttatcaatgggaaaaaaagaaaacttggatatggataaacaagtgactttcattgagggggatgtatcagattctcaattgatggaaagaatcatgaaagaatatcagtttgcctatatttttcatctagctgctgtagctagtgtggcagattctgtagaacggcctgtagaaacacatcgtgtaaattttgacagtgcgcttttattgcttgagtttgcacggaaatatcaatctaatttaaaacgattagtatttagttcatcagctgcagtttatggtgatgaaccaacactgccaaaaaaagaagaatcagtcatccgtccattaacaccatatgctatcgataaatttgcagcagaacaatatgttttggattactgtcatttatatgatgttccaacaagtgctgtccgattttttaacgtttatggcccaaatcaaaatccgaactctccatatagcggagtcatttcgattctagtggatcgttacaaaaaacaattggcaggagaaaaagcggaatttactttatttggcgatgggagtcagtctagagactttgtttatatagaagatgttatacaagcacttttacttgttgccaaggaagaaaaagctttaggacagcaattcaatgtcgggacaggaaaaagcactacgctacttgaattgatccattcaattgatcaaatcttaggaacagagctagcgcttaaatatgaagcggagcgttcaggggatattcgtgattctttagcggatatttcaaaaattcgttctttaggctatcagcctaaatttgatatattgagcggaatggaacggtatttaaagtcagaaatcaactaaaacaaaaaccagcaagatgctggtttttttgtttcgacttagctttttaaattaacaccttccatcagttcataaatctgatttcttaaatcagtggccggcaatttgatgtttttatctgattggatattactttccataacgatggcatctttagtgtcttttttcatcgccactactgcatggaatcgattgatattcccctgagcaaggatataatcgtttccactgtaaacaccgccgctgtaaggatgtttatcaccattattttgccacaatgagaaaagtagttcttttggtatgataccgccagaaagaacactggtaaagaatttgttcaagtcataaacagacatacttatgtttcctgtgcctaattcatttcggatgtcggtttcaggctcgatcaatgcttttgaataatcgtcagttgcagacatctggtaagatacagcatgttgaggcgaattttttatattgtcataaaaatctgtatgttctagatggagaggacgaatgatttctttttttagaagagtttcataaggctgattcgttagtttgatcaatatccctgtaagcaatgtataattcaatggttcataatgatacgtattataatcagtaagtttcaaatgatgaagggcgaactgaatgatttcactatccgacataggtttgtcgggagaagcagttcgatgaagaccagagcgcatataaagcatatttttgattgtgatttgctgacttccaggaatctgaggataaaattcagctaactttgtgtcaaaagttaacttaccagcttggatttgttttagtatcagtaaagcagtcattgctttttgaatcgaaccgatttgatagtaaatagaaggtgaattcgattcttttacgcgcagatttgcatatccatatcctttttctaatagtacgcgattatttttgcgtacataaatcgaaccgatataatctgatttttgtagtaattgatcaattttgctagcaagcatttgctcatcgggcgttaaattggaagtaagttgtgctggctccgctttataagtttgggactgaggtgtttttgttaattgacctcctataatgatgcctgttgaaaagaagcagacagacaataataaaattacaagaaaagaaatagagattttctgtttttttcgatgttttccttttgacatgttaattcctttctatccatttttaactatttttcattgtaatcctcaaaaagagtatttgccacttacaattttgacataatatttggtaaaataattcacggcagtagaaatttcatgtataataaacagagttacgaagatgatagtaaggaggagttgttttgtcaggaaacaaacaacacccaagtaaagataaaaaagaagccagtaaggcagctacagcagatataatcgacaagcggagaaatctgcgtaaaaaagaagataagattgtgaggaagatcattttagtgattgctcttacattattgattattggcggatttcttggatttaccgtgtatcgttatgtagatagcgggttgaagcctttagataaatcagatgaccaattagtccaagtcgagatcccgagtggctcttctaacaagcagattggtgagattttggagaaggacaatattattaaaagcgggattgttttcaattattatacaaaatttaaaaatttaactggctttcaagctggctattatcagttagcgcctaatatgactcttgacgagattggcaaacagttgcaagaaggcggtacttctgagccaacaaaagttgcagatgggaaaattgccattccagaagggtacgatatcgatcagattgctgaacgggtagcgaaggtaactggtaaagacaagaaagaatttttagatttagtgaatgatgagactttctttaacgagttgcaccaaaaattcccagaactgttggaaagtgcatctaaagctgagaacacaaaataccgtttggaaggttacttattcccagccacatatgattattacacgagtacttcgcttaaggatctagtgattgaaatggtgaacaagacgaatacggtcatgcaaaactattattcagctatcaagcagaaaaatttgactgtacaagaagttttaactctagcttctctagttgaaaaagaaggcgtaaaagaaaatgatcgtaaaaacattgcacaagtcttctttaaccgaatcaaagcaaatatgccacttcagtcagatatctctgttttatacgcattaggtgaacacaaagaattagtgacgtatgaagatacagctgtagattcaccatataatttgtataccaataccggctatggacctggaccttttgacaatccaagcgaagaggcaatcaaggcagtattagaaccagcagaaaatgactattattatttcgtagcagatacgagcactggaaatgtttatttcgctaaaacttatgaagaacatatggaattagtggaaaaatatgtaaataattcttagaaaaacaggctctagacattgatcatttttagaaaaacatttacatttgaagaaaagcgtggtaatcttttttggactatattcctcaaaagattaccttttgcggtattttatcgaaaaaaggagacgttacacatggtagagaaagtttatccaatgactctagaaggtaaagaaaaattagaaaaagaattagaagaactaaaaacagtcaaacgcggggaaatcattgaacgaatcaaaattgcccgcggtttcggagatctttccgaaaactctgaatatgaatcagcgaaagatgaacaagcatttgttgaaggaagaatcacaacaattgaaaatatgattcgttttgctcaaatcatcgataacgacggtgtagatgcagatgaggtatcaattggtaaaacagttacattcatcgaactaccagatggagaagaagaagagtacacgattgtcggaagtgctgaagcagatccgttttctggcaaaatttccaatgattctcctattgcgcaagcattgattggcaaacgtaaaaatgatgaagtaactattgctactccaggtggcgatatgttagttaaaatcgtcaaagtagaacaagcgtagtctgactgaaagatctagagagttcatcttactgatgatacactctagatctttttctctttgtgtattttagatttcaacaaacgatcttacatctaaagtcctatagccaacagttaaaaaaataggtatgatgaaatgagaatgtgtcaggagggagaaagagcgatgaatagttcttggcgtttttttgtggtagttgaagcactactgctgttatttgctgtttggcaaatcgtaaacaatactggacttttgcttttagtgatattcggtattttcaatatatatctagctatgcgcaaacatcctcgtactaaatttcaaaattttcaattgatattaggaagtttggtcattttttttagcttagtcaacagtcctgctttatggatgatggctgtatttgccgttttatttattggtctgaaaggtgtagagatttcagggatagatttaaccaaaaatgctttttggcgaaagaaacagatcatgatgatccaaacagagcaattaaaaacacataataatgagcggaaaagacagcaattattcggtaaccaacgtattggaaacgacgtctatgaatgggacgatatcaacatcgccgtcatttctggtgatactatcatagatttgggcaatacgcttttgccaaaagatgataatattgtgattgtaagaaaagggataggcagaacacggatcttagtacctttgggcgtagccatccgtttagagcatgcgacattagtaggaaatgtcttgtttgaagaagagcaattttctttgaaaaatgaacaaatcaaaatctacagcagtgattatgatgaaaaccctcgtagattgaagattattactaataccttgattggagatgtcgaggtgatacgaatatgatgggaaaaatatccagagcgatgctagctgtttattcggggattgcggctttccttattattctattttcacttttcacttatttttatgccagcaatcaaagtcattggtggggagaattactgcgtgcacgtttattatatgttccgcttatcttccatttgttagccatttccttaggtgtaggattaattgtctttctattattatcacttattcaaaagacaaaatacgggaaaatcgaagaaaagctgcgtgcactttcttctggcaattatgaatccaaattgttgcttcttccgatcccaagtgcatcggacgatttatacatcaaagatattgataaggaaatcactaagataaaagaaaaaatgattgaagtatctagtgaattacaaattgtaacgagccgtccccaatatgtagatggacaaaccaaagaagaaattttagaattagaaagacatcgattagcccgtgagctgcatgattcagtttcgcaacaattgtttgcagcaatgatgatgatgtcggcattgacggagcaagcagaaaaaagcgagacaccagaaatgttccgcaagcagttgaaaatggtagcagagatcatcaacgcttcccagtctgagatgcgtgcgctgcttcttcatctacgtccagtcaatttagaagagaaaagtttaaagcaaggtatcgagcagttattgaaggaattgcaaaataaaatccagatttcgctgaaatgggatgtagaagatgtaaaactatctagttccattgaggatcacttgttccgaatcgttcaagaattgttatcaaatacattaagacatgccaaagccaatgaattagaggtatatttgcacaaaatagacaataatcttttgttacgtattattgacgacggaacagggtttaatatgaatgaaacgaaaacgggaagttatggattgaacaatatcaaagaacgagtagctggtattggtggaacagtaaaaatcattagttttaaagggcaaggtacaagtgtagaaatcaaggtccctttgatgaaggaggcatagataaggatgataaaagttttattagtagatgaccatgaaatggtgcgcttaggcgtctcttcttatttatctattcaagaagacattgaagtaattggagaagctgaaaatggacgacaaggctatgagaaggcgatgacacttcgaccggacgtcattttaatggacttagtcatggaagaaatggatggtatcgaatcaacaaaagcaatcttaaaagattggccagaagctaaaatcattatcgtaaccagttttattgatgacgaaaaagtttatcctgccattgaagcaggtgcagcagggtatttgttgaagacctctaccgcacatgaaattgctgatgctataagggcaacgcaacgtggcgagcgagtattagaaccagaagtgacaacaaaaatgatggaaaaaatgagtcggcgaaatgagcctgtattaaatgaagaactaacgaatcgggaaaatgaaattttaatgctgatttctgaaggaaaaagtaatcaggaaatagcggacgaattgtttattacactgaaaacagtaaaaacacatgtttccaatatattggctaagctagaagtggaagaccgtacacaagccgctatctatgcattcaaacatggtttggtgaaataatgattttttgagggaaagatttggctaatctcccctctttttttacataaaataaaggattcatcctgttttaatctctttttctgttcaccaactgttcatttttctttttttatagtttaatagtaataggagaaaactttatccgaaaagcgaaagaacgagggaggaaattatgaagaaaaagtggataggactattcttaagtctgttgttattgacaggatcaattgcgccaaatgcttatgctgttactcaaagcagcacttctgatgagctaaaaacggaacatacaacagagacttccacacaaccaatgagtgagtcgacgacccatgaaagtacaaacgactccttgccacaggactcagctaaggaagaagactcgggagaatattcagaaaataatgaaataacagaaaaaatagaaatcaataaaagcaattttcctgatgatcattttcgaaattggttgttggaaatgattgatacagataaagatggttacttatcaaatgagttattggaaataacacagttaaacttggaagggttacagatacagacactagagggagtcaatttctttaaaaatttaacgaagatcgaagtacaaaacaatgagctgaaagaattagatgtacacgaattaaagaaattagcgtatttagatgtttcatctaaccaactttcaaaaattgatctttcccaaaatagcgaattaacgtattttaagggagaaaatcaaacggttacaagtattgcgaacaaaatggataataaatgggaaataaatgatgaaacgctgaaaccagagaaagaacaaacgactttagaaacagagaaatggcagtatgatgggagtcacttttattcaagcgaacagactccattaagctatatttatgaagtatatttttcagacgacgcagtattagaagaagcagcagaaaaaacattgacagtaaaagtgacggtcgaatatatggaaccagaacaaaaagaggctgattctatcgtacctgattcatcgtctatagtattgaagaaaggagaaacaaaacaacttgcgtacacgagtgtccccgatggaagtatcatatcagatccgctatgggaatcttctaacccatcagtagtagaagtagatgagaacggtaaagtaacagcaaaagaagctggggaagctaaagtagagttgaagaacgctgaaaaagtcctcggtgaattcacggtcattgtagaagctgaaaaaaatgaatctcagacaaaagaaacagcacaaacttctgacgaaaccacagatcgttcaccaatttatagacgaagtgcgttagctgcgactcctacgatcacctatcaaacacatgtacaagatattggctggcaaacaccaactgctaatggagaagttgctgaacaactggacagaaaaaaaggatagaggctatcagaattcaagtgaacaacagttcattaaatggtgacattgaatatagcagtcatattcaagaacaaggatggcaatcatatgttagaaatggtggtaactctggtacaacgggaaattcacttcgtatggaagccatacgtattcgtttaacaggtcagttaagtcaatattatgatatttactatagagtacattcagcagagtttggatggctagggtgggcaaagaacggaaaagatgcaggaacttcaggttttagttatcgcatggaagccatacaaattcagttagtagaaaaggggaagaaagggcctttggaaagcacagcttactaccaaagaaattctttaattcctccaaatatcaattatcaaacatacatccaaaatatagggtggcagaatccacaatcaagtgggttaacagctggaactgtaggagaaaaacttaggttagaagctattcgtatgaatgtaaccgattctgaattttctggtacagttaaatacagtagccacattcaagacattggttggcaaaaagagcaagaaaataatgatatctctggtactaatggtcaaaacaaaagaattgaagcagtaaaaatacaggtaacagatgatttaaataaattttttgatgtatattacagagtacattcagcggaattcggatggttaggctggacaaagaatggaagtgaagctggtagctctggtttttcatttcaaatggaagcaatccaagttcagttagtagtaaaggggcagaatgggccaactacctctatttcttattatgaaaaaaataaactaacagtaccaaccataaactaccaagcacatttacgaaatattggctggcaatctgttcaaagcaatggaaacaatgcggggctgacagggcaaagcgctaggatagaagctttaagaatcaatgtagcaaatacgccacttcctggtgcagtggagtatacaagtcatgtacaaaatataggttggcaaaattatagtagaaataacgagatttcgggaacaactggaagagctcttcatacagaggcagttcggatacgtttgactggacaattaaatcgtttctatgacatttattaccgagtccattcagcacgtcttggctggttagattgggcaaaaaatgatcaatatgctggaacatctagattgaatttgccaatggaagcaattcaagtcgtaattgtcaaaaaaggtgcagcagcccctggaccaacgacgaatccttatcagacatctattaatcatctatttgtgatgggacatggagacaatgatcctggagcttcttataatggtgtcaatgagcgtgattttactagaggagaattgatgcctcatttacaaagatgggctgctcgtttaacgaggaatcggatcactttttataatacagctgcagatatgtatcaagattctcaacgtatgcaaggtgcatatacgattagcagttcattttcttctgtatcagaatttcatttagacagtggcgtcattggggttagcacgggcggtcatgtaatcgctcatcgtaatgggaactcattgactgcacaaaattatgcaatcgccaatgtcatacgaaattatgtaggtctttggggatcggtacaaaacacaggagggatcaatctgcgagctgacttactaaacatgaatgtattgcaatcaagagggataccttaccgtttagctgagttaggcttcataacgaatacaaatgatgtagcaaatatccgaaataatatcgacatgatcgccaaaggaattgtagagagtgtgactggcgaaaaattatagtgaaacaaactatacaagaaagatagtggggaaagtttgggactgtgacaaaagtcgtgtcgcagtccctttttccgaataaacggtattcaagagactgctatcggtaataaggcgcgattttgtcgtcgctcaaggttgaacgtctcttttacaacctctttttccgcaaaagaatgcttgcttttgtttttgtaaaggctttgttatactgagaaaagaaggtactaaaggaggaaaacggtgaaacaaaattttgcaattgtaggtcttggacgatttggcggaagtatctgccgaacactgatcgaagctggtcaagaagtactggctattgatagtaatgaagatcgggtcaatgaatatatgaatatagccactcatgctgttgtggcaaatgcacaggatgaaatgacacttcgatcattaggcataagaaatttcgatcatgtaattgtcgctattggagaagatattcaagccagtatcttagttactctgatggtaaaggaaatgggcgtaccaaatattttagcaaaagcccaaaatgagtatcatgccagagtacttgaaaagatcggagctgatcgcgtcgtccatcctgaacgagacatgggaatacggattgcgcataatttagtgtcaaagaatattttagattacctagagttgtcagataaatattctttagcagaaatccgagtatccaatcctaaatttttcaataaaacattatctgaattaaatttcagacaacgttttgacctaacagtagttgcaattcgcagagtagatcaaacggtgatcgcttcacctgcagcagatgaatacgttcgtgaaaacgataatctgctagtgattggtgagacaggcgatgtggatattttagacgataagatgaatcaatagaaagcaggttgttaggatggaattaacagtaacgccaaaagcacaaaaatggtttgaatcagaaatcgatctgccagaaacttacggaatacgtttttttggaaaagtctacggcaaaacagaagttcatgatggtttttcgattgggatgtcagtggaacagcctgaacatcctgtcaagaaagtggaaatagaggggacactgttttttattgaggatgcagatgaatggttttttaaaggatatgatttacttgtagattatgatccaaaactagaagaaccaacctatcactttaaaaaacaatagaagcaagagggtgtgacaagttgtcacaccctcttgcttaaaataggctgattcagctatcaatatcctgcagacaatttgacttgattggtttgaaggtcatgagtagcaaagtagctttttagattagttaaaaaaatagacattaatttcttttgaaaatcaggtgtcaaacctgcaatatgggacgtgatcagtacattgtccattttccaaagaggatgattttgtggtagaggctcctcctcaaaaacgtctaatgctgcaaaggaaagttgctgcttgtttaatgcttgtatcaaatcttgcgttttaacagaagcgccacgaccgacattgataaatacagcttttgaatcaaagtgttcaaatatgtgttgatcaaagagtccagttgtttcctccgttagaggtaagatattgacgacgaaatctacttcagggagaacttcctgaagttgctttaaagaaaaagttttttccattccttctgctggatgaccggatgtattgattccatagcaaatcatatccaatgctttgactttctttgcaatcatttttccaatatggccagttccaatgattaatatttttttcccttggataggttggtaatggattgaggaacctaaccatttcatttcactctgtgccctttgtgcttggaaaagaccgcgagaataacctagaatgattcctaatacgtgctcggtgatcgattcactgtggataccacttccatttgaaagtaagatatgtttttttgaaaatgcttcaagggggagttgatcaactcccgctgagatagactgtacccatttcaagttagaagaggctaatagtttttcttgatagtttgagttccaacccaaactgatttctacatttggtagatcctctggttgtaattctgtcttgaagacataaccaggcgctatagtatggatttcttcgataaattcgtcacgaaatggacgatctgcgtaaatgattctttctgacatagttaattacccgcctttctttactttaagtgtagcgcatataagaagaactttgaagtgccatgcttttttagaaattaatattgtataaataaaaaagagttgtgacaaaagatgtgtcacaactctttttccgaataaacggtgttccagaagtagcttctgccacaacctctaaaagagtttattgaagttgaaataataagttgtctgtatttctaactgatcgatatttttgaccatcctttgacagcttgagcaaaaataaagatacctgcaaaagcaataaatgcactagtgtcaaaagaagggagaaagatcatcaagagtgttgcaatgatagtcggcaacgagattgaataaatcaatgtcttcaagcaatcaaggaaagtagcttttgttagtcgaaagcgtgcatagagaaaagcaacgacattggcaaatagtaaagtgatcagcagattcaagaaactaggataaatcgaaaatagaaaggtcagggcttttacccaaatcggtatagatgcttcacttaagaaggatcgaagctgcttacctgttaaattttttaaagattcattggtgtaaggaagctctaactgattattattcaataaagcagaggtagtgcctgtattgggaagagcaatgataagtttgtcttttaacatcccgacactaacgaaatttcccatcaaatcagtagagatgtcttgttctgtacgttttccctctggatcaaatgtaaagataatggagtttgtttggtaaatgaaaccttctttttcttttgtttgaagctgtccgttttggactgtaaaatcaggaatgcgggtagcaatcttttgtccgtccaattgaatgttatttaagacttgaaaaacttggaaagagattggcagagccataattacactcaaaatcagaagatagacaatagctttccaaaatggaacgtttctcgcctccttaaggtctttgaatcgtataaaggaactgataattaattgttttgttgtcataagtactcctcatctagtagtgtcatcacttgcaattctagcgaagtatcaagtgaaatacaagtgctttaaggaaacatctgaatgattggtgaaatatcaaaaaaatgttattcttgatttaagattattcaatacaaataaaatggaggaatgaatcgtgcatacacagccacagagatcatcaaaaaagctatttggggtagtggtgctgaatgcggtgatcactttatcagaatttattggaggggttgcgtcgggaagtttgtctcttgtttcagatgcttttcataaccttagtgatacattagcaatcattttttcttatggagcacaaaaaatggcccaaaaagaagcgaatgaaaggcatacgtacggttaccagcgtttagaaatattgagtgctttcatcaactcattcatactgatcatattatctttgtttttagctgttgaagcatttaaacggttcaattccccagaaaagataaatagtcatttgatgctgatagtagcagttatcggattgcttgcgaatttgttttcgacgttattgttgagacaagaagcagacgaaaatttgaatataaaatctagttatctgcatttgttaagcgatacactgtcttcgataagtgtgattatcggagcagttttgattcgatttttcggtatctattggattgatccagttattacattgatcatttcgatatatatattgttagaagcaataatagtgattaaaaaagctgcggctattttgatacaaagtgcacctacgatcgactatgaaaaaatggagcaagaaatcaaagcaatcgaaggggtgaaagatgttcatcatgtccacatttggcagtatagcgaaaagattattattttcgacggacatattgattttgaagatcagctgctaagcgagattgaaaaggcatatccgcgtataacttctttattaaaattaaagtatgggattacacatgtaacgattcaagcagagacacatgtaaaagaccaaaaaaaattaatttttttaaataaagatgaaagttactgaaaaatagagtatgataaataagaatttctaataaggtaggttggctcatgaagcagtatcgacaaataaaaggatatttagaagcaaagggatattgggagatactggtttatctcttttttggtggtttggctacgattgtgaactttgttagttttgccctcgcacgccaatattttgatttaagtatggctctatccaattctatttcatggttttgttctgtattgtttgcttttgtgacgaacaaactttgggtattccattcaaaatcaccgaattttacacatgcacttattgaatgtggtaagttcttcttttaccgcatcctttcttacgggttggacatgggagcaatggtgttattaatcaatgtcatgaacagcaatgaatatgtggcaaaaattatcactcaaattattgttatcctagctaattacattttcagcaagttgttcattttcaaagaaactgaggtttttgaagaagaagtaggccaaggagaaaaagacgactaggcataactattgaagaatttccttctctttgttactctttgtaatgtagacattataaagaaaacattgaggaggaatttttttatgacttacacattaccagatttaccttatgcatatgacgcattggaaccttacattgatgaagaaacgatgcacctgcatcatgacaagcatcacaatacttacgtaacgaatttaaatgcagcaatcgaaaaatatccagaattaggcgaaaaaacagtagaagaattattatctgatatggatgctgttccaacagatatcaaaacagctgtacgcaacaatggtggtggacatgctaaccattcatttttctgggaaatcatggcaccgaatgcgggcggcgagcctactggggcaataaaagaagcaattaatgaagcttttggcgatttttcttcttttaaagaagaattcaaaaaagcagcagctggacgttttggttctggttgggcttggcttgtaatggagaatgggaaattagctattacctctactgcaaatcaagattctccattgatggaaggtaagacaccaattctaggtttagatgtttgggaacatgcttactatttgaaatataaaaatgtacgtccagactacattgcagcattctggaatgttattaattgggacgaagtaaataaacgtttcgaagcagcaaaataactattttctccatcatatcagtcttaaaaataatttggaaaataaacgagcgaaagcttgcgagcgttttctaaattgggtataatgttcttgcaaggttacttgcaagaacttttttggaggctatacatttatggaacacggaacagttaaatggttcaacaatgaaaaaggatttgggtttattacagtagatggcggagatgacgtatttgttcatttctcagcaattcaaggagacggcttcaagagcctagaagaaggccaagaagtagaatttacgattgttgaaggtgcgcgcggtcctcaagctgctgaagtgactaaattataataatttgttggataaagacacgacttcttagggagtcgtgtctttttgtctattcaagaagttttttgatttcttgactaagtaaatagatttgttcactagacatttcataactaattgtcaagcaaggtacatcttcttcataagtaacggtttttaaagaagtatcagttgttcggatgatcaattccggcttgaataaaaggtcgttagtaaacacaacatttaaatacatactcagctgttcttgaagaatttccatatatgctaactccaaaccaatcggaaggtcactctcaaatttgattttgatttctttattaaagtaagtaggagaaatgatcaatatgaacgcttctgctaaattccaagaatgcaaccaatcaagttcctcagattcgtttttaaattgttccgtcaatcggttgatttctcggtggaatgccggataactcatctcgataaaagaggtaatttcatgtttgacgatcgaaaattgaggaaatagcaatccatgcatcccatttgcgagcagtgtactgttcaacagcgacttttttgaatggatttgggcagacttgaatcgattggagtgaatataagaataaaaactagtctgcagttgttttacaggagtcgcaatttttgtatggatacgcaaagcagtttgcagatagtcctctttcaaataaaaagcagcccgagattgcatctaaagaaacaagaacatgctatctgtcagactgaaacgcatacgtttataattcgttgttaactcttcagccattttttcaaagccattccaaaggtcaagtgaaaaatcaggtaattcttttgctggaataacgtgtccttgttgagaacgaagataagtaacagctagtataaaggaccattcgatcatttttatcttatttggtttttgatgaacgatagcaaaagaatcctccacttctgaaaataattgatgaaactctattgaagcaaaaggccattcaacactgcgataggatggccatagtatcaaataaatcaaataacgaatttgcatctcacttcctttgaaatacatctcgcctttttttgttttgatctgcagttgatatttttttagtatctgattgatgcgagtaatgtgccgccgaaggatggattcactgatattattatcctcagagaattccgcaatcgttactttcgagtcaaggcataaatttttcaacagatgaaaaataggcgagcgcttcaaaatggacagaatcaattcttgaaaatccgaattggtacctaaaaataaataattacgtccttcctttctgaactgatcgctaatggagagggtgcgtacttgttcacaataattttgtacagaacgtttgtcacaagcagtgaattcagctaattgttcgatagaccaaattttattggaatgatagatggtatcaagaatagtaatctgtaaacgtgtggtcttttccaataatgaataaaaatccatgaatttttaattcctccaatcaataattagtacttaagttatcttgatattaaaaaataatgttattttttaacggaaaatgtatgcagaaaaaacaatttataataaaaaaagtttgttatataaaaagctatacctttagtttgataaacaaaatattgattttattgttattttatttatttgtgaataaatttacttcaaaaaaaataaaaatattttttattcttttatgcttaatttcattataattcatctcataaaaaaagcataattttatactaaaaatagaaaatcgattattttgtactttattttcgtgaaaactggatagttatttaaaaaaagattaaaacttaataatagatttatcattgagatgttgttaaacttcctctgacttaagttgaaaacaaaatctgcacaaaaagatatctttttgattaaaaaatgatagctaaggggtgttgtaatcttttcttttttataacgatcaaaaatttggggatgaacgatagaagggtgacaggaggaaaaaatgaaaaaggattataaaaaaagtatgaaccagaaggcacgggcaaaaagtagatcgaaaaaaatcttgcttgccggtacatccattgcagctggtgtgatgttagggatcacaccaatctcaatggctacgccattatttactattggttctcaacaagtacatgcagatgtaatcagtgggcaactgtttaacaatttaagtacaacgaatactagtgggactacagctgctgccccatttcttcttcagggggcgagtcgggatgttgattttgttatatcagcgaatagtggtattgatgttagcgtgattaatggaacgcgtcgtgctgtcttagctattccagaagaaatgcaaggattggtcactccgaatggaactggtactttctacacagatattttgcttccaggaaatagtttagcacctctattaaatattgtagatggagcggtgactactttggtaggagcagtagaaggtttgattaatttgaatcctttagctacagtgaatctttcggaagtttatgaacaacttgctttattgaataatctaagtacactgacttctgctgaagtagaattgcagcttcaaatgcaaggggatgaatacatctacggagagctagacggtgccttggaaaccgtgatacgagaaaatttaagtaatatattgagcggaatcaataatgcagttcaagcaatcgaggcaacttcaactggagggcttcttggagatgcagcggccggaacaatcaatactgctttagcagttacagtcaagccagcgttcaatcttacgtttaataccgctttggcattggtgaatgtcggttcttctttccttggtaatcttgctgatgcaagtattttgggtgaaacgactgttactataccgacaacgatccaagatcctacttatgcagacttaacaaatgcaggtgtcgacatgactgttccttatgaagcaggatttatcggtaccattcttaaatcagacattctatcgatctctattgcttcgaatgttgatggctattctccagtgttttatgcagctgaagaagtcactgctccttataacgtagaagttacaggtaattctactgatggttatgaggtgactgggatggcagatcccaatgccacagttcgtatttatgatgatgaaggaaatatgattgcagagggacaagcagatgaaaatggtaattttgctattccagtctcggcagaagatgttgtgcccttagaacagatccaattgattgcttatgatgaaaatggtgtagcaagtgcgccaacagcagcaattattccagatgatgatgaaggagatgctgatgccgatgccgatgctgacgcggacgctgatgccgatgctgatgcggacgctgatgcggatgcggacgccgatgctgacgcggacgctgatgccgatgcggacgccgatgccgatgccgatgctgacgcggacgccgatgctgatgccgatgcggacgctgatgccgatgtcgatgccgacgctgatgccgatgcggacgctgatgccgatgccgatgccgacgctgatgccgatgcggacgccgatgccgatgccgacgctgatgctgatgccgatgctgatgcagatgccgatgcggacgctgatgccgatgcggattctgacgctgatgccgatgccgatgcggacgccgatgccgacgctgatgccgatgccgatgcggacgctgatgccgatgccgatgccgacgcggatgctaatcatccaatgggagacatgcattctcatgatcaagattcagtgcagatgccaataagacatggtcattcaaatactccaaaaccaagtactacaggtggctctacaccgaaatccttgccaaaaactgctgagacatttcatagttcactttcttggttaggagcagctctgtctacactatctggtttaggaatttggaaaatcaaaaaaaataaaaaaacagataacaataaataattaagaaagaagccgttgcggcaagcagttccgtatctatgattttttgataaaaacggatgttcagattttgtttgccgcaacttctttttaatatgaggtgattgagtgctagttaagacaaaagaaagctatttgctagcaatcaaagaaatgatagaaacaattgaaacaaatatatcaaaacaattgatgatcgtctctacaggagattttacgaatagaggaaagatctttgaattctacggcagtaattttgatacgatttggcggaattttttgacagcataccatgtcaataagctggatcaggcgacttatttaagaattgatattgttattgaagaagaaaaaaacaactatgagcagtttatacagcacttaaaaaaatcagaagaaataattacattgatttcaatgtaagaattgatgggctaagaaaaagaagtttcttaaaagaagaactggtagcaaatgcgatcatcaaacctagtaaaacacataaagttgggaagaatcttcctgatttaagaatcgacgctcaaaattaccgcagttatgtgaaacgcaagtatggtcgtgaagagacagatctcagctacttggagcgttctgcgttctattactttaaaacaaaatctttttattttgaaggcggtcatatttatcctttgcaagattacggtaatggaaattgcttacgggaagtttcatatgaaaatttatcagaaataacagatctagtgatcgaaaaaggaagtatatatctacaaaaccagctaactgctacaggaaaatttatttacggatattatccttgttataatcaactgcttaaaggttacaattccgtgagacacttttcgtctttatatgcgctagccgaagcagcagaatacttttcggatgaaaaaatgctctcagaggttgaaaagggtttagattgggggattgaaaatctgacttcggagactgacggttattttttaatcaaggattatttaaacacagagatcgaatataagctaggagcacaggctacagcaatcttagctttttcaaaatacatcgaacaaacaggtgatgaacaatacgttccaatcctaaatcgtctgatagaaactgtttccgctaaatttttaacaaatgagcatcgaacgattcatgtacttaatgcacaactagaaacgaaagaaaaatttcggatcatttattatgatggtgaaattttattctctttgcttcgagcatatgagattttaggcaataaagaagtttttgctatatgtcaaggtttgatggaccagttcgtagcgaacgactatcaaaaatatcatgatcattggttaagttatgcgaccaatgaaatgctgaaacatagccagacagaagaatattatcgcttcggtataaaaaatgcgttagataatatcgactttattgataaaagagatactgcttatcctacgatgctggaattgcttgtcgctgcttcaaaaatgatgagaaaattggagttcagcacgtggagaaaaacgatttttgctgaagaaactgacttctataaggtaaaagaaagaataaatacagtaatgaaaaaaagggtgagacatgagattactactggggtcatgttccctgaatttgctcaattcttcaaagaaccagaaacaataaaatatggcttttttgcacgtcatgatcgttttcgtatgaggatcgatgatgcagagcactttttatcaggattgattaactatcgaatgtatgatcaaaagaaggagtgagaagaatggttggattcattcgctttgttacattagctgcatttggtgttttctatttaggtcttaaaatacgtcggaaaaatgatcaaaaaaataatctgaaagaatcagatttaagtcaatataagaaaaatgaagaagggttgtatccttgggaagtggatcaagatgattctccgaaaaggatcgaaccgaatgcctccagatatgtaaaccaggcaaggccaagaagaggcaggtggtaaggcgtctagaaaaaaacaagaaaaacaggaggagagttatgacttcgatacattcattattagttgatatggatggccattatttaaagaaatatagagatttagatagaaatatccaagatgttgaatatttctcaggccacttaaaacgaaacatggattattctgatacgatgtttgtttgtgtttcgccagaaagaaggagttacgtcaatcgaaaggtcgtgaaatggcgagatggaaatgaacaaatcatcggaaaagaaaattggtttggggtgatcgttactgaaaaaccaatcatggatccgtcagtgacgacaccacagttcatcgtagaagatagttggaaatttttattggaattatctgcgaaattgcgttcctgttttgtaaatccggttgttgcgattaccgggtcagcagggaagacttctacgcgaatgatgatcactcatttgcttcaagaagagaaagttttggaaaacaggggaaatcacaacgttcggtttgctgttcctttatacatgagtaaattactttctaatcctgatgtcttgaatcttgaagtttctgtcaatgctttgaattcatatgatacagggtcgatgtctaatttgatacaacaagatattgctattgtgacttcaattggagaagcacatcttagttctttaaaaaatacaaaaggagtagcagtgcataaagcaaaaattttcgaaggcctgaaacaagatggaatcgccatcatcaatggagatataggaaaagaagaattttcaattttagtaagcgctgctgagaaaagaaccagcaaaatagtggtctattcattacatgatgcttcaagagatgtttttgtgaaacaaatctcacaaaaaagagaatattgcgaagtcctagtttcttttttcggagaagatattttattgaaacttgcagtttcttcagaagggatgatcgctaattcattggctgcgttgattgtagcaaaagaactgaaaaaagagatctctccatatataaaaaaatttgagacattcaaaccactacctaagatattggaacgtacgatttatacatcagaaacagggacagacttcacctttattgatgatacgcataacgcttcattgccttccatgaaaaatgcaatcaattactttgatgggatacaaccattttataaaggaaataaagtcttgatacttggacaaatcgctgatttaggcgattcaacaaagcaaatccaccgctttgtacaagaggagttaaaccaatcggctgccacgcatatttatggttatggggaacattttaaattgctttttgaagaaggacagaaaacagatgatcggcttcaatggttcgattcacttcaggaattatgcaatgatctggaaacaaaactaatagaagacagtttagttttagcaaaaggatcagttactggaagtgattttcatgaaatcggcaaatatgtgcgtcagatcggaaacaagcataatatgaaaagtcagactttatagaaggtattagggaaacgccatgttagtctgaacagagtaaagaggaatcgttaaaatgacgggaaaggagtgtggcaggtcgatgtcacactcctatttttgtgaaatacctggttgttcaatttttctagcaaaaaatgcataaaaaaagataaaacggttataaactgcgtatattcgggctttcgaactttttcgtggtgtggtatgatagttaagaattttgagaaaatttttaaaagaatggttattatacaaaaattattttttaaagttttcttatgattaaaaagtgaatttgctgattgaacagttgtatgagacaatattttagaaaatgtgagacagaggtgtactatgaagcaatggcaaaaagttctattaaccttattaggtatactcgttttgctgatagccggattatcagcatacggtatcagatttatgggagaagcgagccaaacagtaaacaaaatatctaaaaactctaatcgaatatcttccaaacgttctgagaaagtaagcattgatgacaaagaaccgttttcggttttgctattaggtttagataccggtggattaggaagaacagaacaagggcgttctgatacgatgatggtagtaacagttaatccgaaacaaaaaaaatcaacgattatcagtttggaccgagatatttatacgaatatcgtagggtatggaacggtagataaattaaatcacgcctatgcatttggtggcgtcgaaatggccatggattcaattgaacaactgcttgatattcctattgatcattatgtaaccatcaatttggacggtatggaagatttgatcaatgcggtcggcggcatcaaagtgaataataaaatcgactttacgttggatggtgtccatgtaccagtaggtgaacaaacattggatggagaaaaaggattagcctattcccgaatgcgacacgaagatccagaaggagatatcgggcgacaacgtcgtcagcgggaagtagtgacgaaaatcgtcaataaagttttaagtttagatggcgtaagcaattatagaaaaattttaaaagcagtcgaaaacaatgtgacaacagatttggattgggatgacatgcttgatgtagcaacgaattacacgccggcgttcgaaacgattaaacaagaccagttgcaaggtgaaggtcaaatgatcaatgatatctactatcagattttaggacaaaacgatctcctatcgattcaaaatgaactgaagaaacaattaaatatcaaaaccagcgacacattacctaatttgaaaaatgagaatgcttcaatgatgttctttgatgattcggaaggtgccgattcgacaaccggtgatgggtcgaatagtgaaggatacactgattattcttcctattcagaaaacacctatgatcagtaccaagatccgaatacctattatcagcaaacagaagatacaagtcagtactatacaccaagtcaagatactcaaagttatgatccttatgctggacaggaacaaaatggttatggttatgaccagaataatgggtatggaacaacaagtgggtactagaaaaaaatagtttggttaataaagggtgccacctaaattagacaaaaaaatctaacttaggtggcactctttttatgtgttaaatatactttcttaacaagtttttagtttttagcacttagtttaaaaaataaatcgaataattcagtagagttgcgaatagtacccataaataataaggaatcatgagccacatgactaggcgatgatgcagccataattgatacataagcactgacaagaaaataaccaaaagtgtaatatcgattgctgcaacgaagatatttcttaaattaaaaaatagagcagtccatatgaaattaaaaatgaactgaatcacaaaaagacctacaaggttgtttcgctgttttttgttgttgtgattaagcaacaaataaagagaaatacccatcaaaatatacaataaggtccacattggtccaaatatccaactaggtggtgcaaatggcggaagttgtaaagaatagtaatattctccaggatttccgctaagcaatcctgataaaaagcctaatatgacaattcctataacacaaacccaaaaacgaatatcttttatcatcttcattctattaactcctttctataataatattttacatgaagaatcacaacaatacctgtatttagtttgtgaagtaagaataatggagaaatattgttatttaaaaaagttaaaaatttgtttatatgaatcatgaatttgaaaaagatcgtattaaataattctcatgttttttacaattcgttattttcttattaacttctgttacaatctatattgtaatcgattacataaaagcttggctgaagtaaaaaattatacataggaaggttgataaatatgaaaagaggtttactcaaagtacttactggggcggcactcagcacgatgcttttttctcctgcattgctgattcaagtacaagaatcatctgcaatcgaacaaacagtagtgactaatcccgattttggagtaggacaaggaattgagtggccaaaacaagtagttgctccttatgtggatataactgcttattcttctgatgaagaactatctaataatggggcattgaacttagcagctgttgctcaacaaacaggacagaaattttttaaattaggttttttacaggcgagaggtattagaaatggtcgaattgattgggcttggggtggttttaatggtctaagtgagattgataatgacgaatggcagtatgaaggaatcaaaaaatctatccgggaattacgtcaaaatggcggagatgtagctgtttcgtttggcggactgaattcaggagcattttgggaggtcactcaaaatcaagcacttttatatgatgcctatatggaagttattcaaggctatggattgacacgtgtagactatgatgtagaagccgctgcgatgggatatgaagcgaatttggcaaatgcaaaagcggtaaagaaagttcaagaagcaactggtgtagaagtaacgttgaccttgccagtcatggatactggcctgatttcgaccggattagcagtgttacaagcttatctggaggcaggagtggatttgacaaatatcaatctaatgacaatgtgctacggaagcagtgtaccagattatgcccaagggtcgcttgatgctgtggataatacaatggtgcagttaaaagagtattatcaaagatttatgggaacgactttgacgacagaacaagcatatgctaaattaggaaccactccatcaatcggatttgaaagtgaagctcatccatactttacagcaacgatgtttaatcgagttgttcagcatgcaaaagaacgaaatattggaatggtttcctactggtcaatgaatcgagattcaaaggtcgatggaggacaaggacaagtcaataaccggtatgaatttttaaatgtggcacaacgttttacagatgacacacctcttccagaggacaaagaaaaaccaactattccagagaattttaaagcagaattggtgacatctaggcgtgctgcgctaagttggtcacctgcgacagataatgattctattggaaagtataaccttcgattgattggaaacgaagaaatagttgaaagaagtacaatagatatcaagtatacttttgagaatttaaaagcgaatacaacttatacagtggaacttacagcagaagaccgttctggtaatatttcggataaaacaacattgacgtttacaacattagcggacaatgaaagtgaatatccagtatgggatcctgaaaaagtttatgcggctggcgatcgtgttgtatacgaaggcatcatctatgaagctaagtactggactcaaaacaataatccaagtgaatctggagaatggggaccttggagacagatttcttgattcataggtatatatgaaaaataaataaaaaatgtaaacaggagttttatttagctcctgtttctttttatttcaatataaaattataaaagcataatgtttgtgttaatataataaagcgtttacaatatgtttatcaaatgaaggaggtttctacatgaaaaagattagtacgttattgtttatcgggttagttagtttagggttgttcggtttcagcattccaggtttcgcacacggttatattacttctcctggaagtcgtgcatatctaggaacatcagcagcaggaaatctaaaccaaaatgtcggaagagcacaatgggaaccgcaaagtatcgaagctaccaaaaatacattcattgatggaaaaatcgccagtgcaggagtcagcggatttgaacctttagacgaacagacatctaacagatggtataaaaatatggtcaatccaggaacattgaatattacttggaatttaacagcgcaacatcggacaagtacttgggattactacattaccaagccaaattggaaccctgatcaacctttgaaatttagcgattttgaattgattacaaaaatagacgacaaagcaaccgtaccaccaaaaacagtcaaccaaataattacacttcctcaagaccgcaaaggatacaatgtgattttagcagtatggaatatcagtgatacgacaaatgcattctatcaagtgattgacgtgaatatccaataataatcaaaagggctgtgacaaaaaacgtgtcacaacccttttttgaataagcagtgttcgcctgccaactcctcggtcacaagtgacaatagtcaccaaacatgaaaagctgttttttgaaattgttccttatgactcggagctgaacggcaagctcacgccttctctcgtttaatcagcaagtctcgtcatcttcacgacaacttcacaacgtgcagtctgaggaaacatatcaacagactgtaaatattcaacattgaactttttacttaaatggaccagatctctggcaagtgtagaaacgttacaggagatataaacaagtttttttggtggaaatttcagtaacgattgaatcaatgcgttatccaaacccgtacgtggcggatctacgatgataccatctggctgaaaaccttcattcaaccatttaggtagaacttgttcggctgtaccgacttcatatcgagtattgtgataccctaatctttccgcatttctttttgcatcagcgattgcttgaggaacggtatccattcctcggacttctttgaccttttttgctacacttaaaccaatcgtaccaactccgcaataagcatctacgattgtttcatcaggctgggcatctaatgctttgattccttcaccataaagcagttcggtctgctgaggattcaactgaaagaaggcgcgaggagaaagatcgaaagtcacttcattgatttgttcttcaatggcttcttttccccatacgtggatcgtttcatcccccattacgagagatgttttttgtgcttggacattttgcatgatcgaaacaacttcgggcaggcgttcattgatctcgcgaatcattgcgtttttttgtgggaattttttactgcgagtaataaaaacgacttgcagctctccagttttgacaccgattctgaccatgatcgtgcggaaaataccactgtttgtccgttcatcatagatgggtgcatcaaatttattcaatagttgaacaacagtattcatcactttttgtgttcggggttcttgtaccaaacagtctgttataggaactaactgatgcgagtttgcttcatataaaccagcttcggtcttttgcgtttgtttattttttcgtaattgaaattgtgctttgtttctataatgccatggatcatccatcccaatcgtcggtaacaactggtaggatcgaaagcctgctggtttgaatttttccaatgcttgcaagagtagatcctttttaaaatccaattgtgcttgataggctaagtgttgtaattgacagccaccgcattcataataaacaggacatggcgccactacgcgatctttgcttggctttttgacttttattaattctccttctgcataacgaggagttgctttcgtgattttgactagtacttcttcttttggtagtgcatacggaacaaatataatcaatcgtttgaaataaccaattccttcgccatttatgcctaaacgcttgattttcaaaggaatcgtttgtccatttttgacaattgtttctgccataagtatctccctttttcttttttctgtggtttattctaacatataatacctgattacggggattttctatggtatgatagagaatatatgttcgaggaggatgtttatgttaaccgttacgagaatcagtaaaggcaaaggccctttctatcgcgtagatttatctgaaggagaagctttacaagtatctgaagatgtattagtacgctatcgtttgttaaaaggacgggaattagacgaagaaactatccaagagattaagaagagcagtggcgctgatttcggatttcagctagcaatgaattacttaagctatcagttacggtcggaaaaagaaatccgaacatacttaaaagaaaaggaaatccttcaagaagatcgaaataaaatcgtagcccgcttaaaagaattggatcttgtcaatgatttggtctatggggaaagttatgtgcgcacgaacatgcgcttaagtgacaaaggtccaaaaaaattgtcacagcaaatgcagcaaaaaggattaaaactagagattattgaacaggcgctcgcccagtatacagttgaagaccaagttcaaaatgcacatcaaacggctgaaaaaacatttggaaaaaatcatgggaaaagccaaaaagaattattgcggaaaatccaacaaactctgatgacaaaaggtttttctcaagaagtgatccaacaagctatggctgatcttccgcaagaagtagaccaggaaacagaatatgattatttagtcaaacaaggggataaactatggcgaagaaattcaaggtttgaacctaaaaaaagaaacctaaaagtaaaacaaagcttatatcaaaaaggatttgatttggatatgatccagcgattcattacggaaaaggaagaggaaagtgaataaagaatgggaaaaatggacagacgaagaaacaaaagaatttcaagatcagttcattcaatggtatgaacaagaaaaaagaaacctgccatggcgctacaatcgggatccttatcgtatttggatctctgagatcatgctccagcagaccagagtagatacagtgatcgattatttttatcgcttcatggaatggtttcctacaattgaagaattggcaactgctccagaagaaaagcttttaaaagcttgggaggggcttggctattactcaagagcccgaaacatccaagcagctgctaaacagatcatgtctgaatttgacggaaaaatgccgcaaacgcctgaagaaatcagctcattgaaaggaataggcccctatacgacaggagcgatagcaagtatagcatttggacttccagaacctgcagttgacggtaacgtgatgcgagtagtcagcagattgttttgcattgaagcagatattgccaaagcttccagcaggaaaatctttgatgaagcgatgcggaaaatcattgatgaaacgtatccaggtgaattcaaccaagcaatgatggatctaggatcagctatctgtacaccaacttctccaaagtgtgaagcttgtccgatccaagccttttgtttagccaacaaacgaggaatccaaacgagttttcctgtaaaaacaaaaaaagcaaagccaaaaaacgtttattatatcagtgcggctcttcaaaatcattcgggagcgtattattttgaagaaagagatagccaaaaactgctagcgaatatgtggacatttccaatggtggaagtgacacaagaggagtacgagcgattgaaaaaagaatgggaagcaaaacaggaagtcgatctgtttgatgatctagtagcagaagacggaaaagagcttcccttcgaaaagcaggaactttttatttggcagacacgtcatttaggagaagttactcatgtttttagtcatctgaaatggcatgttctccttttttacggacgggcaaccgaggaagcagaacaggaatttaccgagaacaaaacttcgaagtggttgaagcctgctgcatttgattcggtcgtttttccgaaggtacaaatgaaactagtggaacagttggagaaaaatcgaaacaataggaatcctttctaggcaaagctcatttttattgatataataattatgatgtcggtgtaatgaacacccaaacacaaagcacaaaatgctgcttaaggaagggttgctatgggagttccaaaagaaggagagtttgtgacgatccaaagttacaagcacgacggcagattgcatcgaacgtggcgagataccatggtattgaaaacaagcgaacactctatgatcggcgtgaatgatcacacattagttactgaatctgacggacgccgatgggtaacgcgcgaaccagcgattgtgtattttcataaaaaatactggttcaatgtaatagcaatgatcagagaaaagggggtttcctattattgtaatctagcttcaccttttttgctggacgatgaggccttgaaatatatcgactatgacttggatatcaaggtgtttcctgacggcgagaaacgactattggatgtcgatgagtacgagatgcacagcaaaatgatgaattacccgaacgatattgacttcatcctaaaagaaaatgtgaagattctggttgactggatcaataatggagatggcccgttctcagaaggctatattgatatttggtatgaccgttacaagcaattgtcgcgtaagtaaacgcaaaaaagaacagtaagccagtgagaaatttttctcaaaagcttgctgtttttttttttgaaaaattttttataaagtctttttcatataaatgtgaggcatgccagcgtcttcaaaaggctcaccgtaagctatgtaaccaagcttttcgtaaaaagcttccgctgtagactgcgctcctaataaaatcgtattatagccttgattcttagcaaaggtttctgcttcttcaatcaatagtttacctaagccttggtgtctgtattcagaaagaatcgccattcgctgtaatttcatttttccgttttctaaaggcaaaaggcgtacagttccttgcggttcttttttatctgagtacagaacgaaatggatgcaatgtgcttcatctttatctatttctcgagacaaagggacaccttgttcgactacaaagacttgatgtctgattcttacagcatctaagtaaatattgctcattgtatcttttgtttgtacaactttcatggtctagccaccttcctttcgtatagtatactggaaaataaaataaataaaaagtatggaaagttttcgaaaataaaaaaagaataaaagaatttttagtgaatataatatatactaggaagaaagaaaggaggaaatctattgtttgaaaaacttagacagtctaaactaatgttttggtcgcttgaattattgatcatagctgcactgatcatgatttcatcagaaataaattttatttttgaaccgatcgggacatttttttccacgttatttgcacccgtactgattgcaggctttctttactatttgctgaatcctatcgtcaagctgctgatgaaagcaaaaatcaaaagaatatgggctgtcgcaattgtgctgctccttttagttgcagcaattatttggattttacttagtgtcattccaagtctagtacagcaaatttcctcattggcatctagtatgcctgattttatcaaacaggtggaaagttggttaaaagaggtagccgaattgcctgtgttcaaggaagttgatatcaataaatattttgaacaattagatatttcttacgggacgatcatccaacaattccttagtggcgtttccaacagtttaggttcgatcgttggaacgattgcttcggcaaccgtagtgatcattacggcacccttcatcttgttctatatgttgaaagatggcgaaaaactagtgccaaacatccaacagtttttcccggagaaaagaagaaatcaaattgtggaattattgggacagctgaataaaacattagctaattatattagtggacaagcaattgaatgtctattcgtcggcacttttacatttttaggatatatgatcatcggtgtagattatgctttcttgtttggggtcattgcaggattgaccaacctgataccatatttaggaccttatctagggctagcacctgcatttttagtgacgatcttcaacgatccgataaaagcattgctttgttgtttagttgtactaatcgtccaacagttagatggaaacatcatttatccgaatgtaattgggaaatcactgaagatccatcctttaacgatcattatcgtccttctagtagcaggaaacattgccggattgcttggtatcttcttaggtgttcctttttatgcaatctgcaagacaatcatttcctatataatcaaaatcatcaaggaagataaacaaaatgaaaacaagaaaaaaattgctacgacctcgtagatatttttagtacacttgtttttattgcaaagaaaattgctttgtgataccattttaacgtggctatagtgccacgtttttttctatcgtaaactaaaaattaattttataaggagagaatgcgattatgaatgctgaccctgagagtcagtcgctgttagcgcagattttattattgatcgttttgacattgatcaatgcttttttagcagcttccgaaattgctgttgtttcgatcaataagaatcgaatcgagcaaaaagctgatgaaggagatgtgaaatctcaaaagcttttaaaaatattgcagaatccaaataatttcctatcgacaatccaagtaggaatcactttggtcaacattttgtccggtgcgtcactagcaaatactttatcggaacggttagctccggtattaggtggcggtacagcggcaaaaaatattgcaaatatcattgtgctggctattttgacctatgtatcgattgtttttggagaattgtaccctaaacgtattgctttaaataaatcagaagaagtcgcaaagttcacttcagggctgatacgcttgatcggcgtagtagctaagccctttgtctggttgctttctgcttctacaagtttgttggcacgtatcacaccgatgacctttgatgatgaagattcaaaaatgaccagagatgaaatgcgttatatgcttgaaaacgaaggcgtattgaacaacgaagaattggaaatgctccaaggggttttttctcttgatacgaaagttgctcgagaagtaatggtcccacgaacggatgcatttatgattgatatcaatgacactgtggaagaaaatgtgaataaagttttatcggaaaactattcaagaattcctgtctataatgaagacaaagataaggtagttggaatccttcatacaaagaatttactaaaagcagcccataaatttggctttgatcatttagatatcaaaaaaatcatgcaggagcctttattcgttcctgaaacggtctttattgatgatctattatatgaaatgaaaaagacacagaatcaaatggctattttattggatgaatatggcggtgtcgttggtttagcaacattagaagatcttttagaagaaatcgtcggagaaatcgatgatgaatcagatgaagttgagaatctttatgaaaaaatcgatgaacacgaatatattatccaaggacgaatgctgattgatgaattcaatgaagcttttgacagtgatttgcatatgagtgatgtagacacaatggctggttatttgattacagcattaggcatgattccggatgaaggcgaaaagttatcatttgatgtcgataatattacgctggtttctgaagaaatggaaggttctcgaatccttaaaatccgtgtcatttttcatgatccggaagaaacagaagcggaacctgaagaagaacgcagatacttcagaaaagaattcgaagatgacgaaccaagaagataattggaaacttggttataaaagaaagacgtgttgcttgaataaacaagcaacatgtcttttctttagtcagctgacaaaaatatttgactcttatgatttggtggctttttcattcgctgaatccatgctatactgattcagttgtagtaattaacagaagttgtgaaaaagctgtcttgtatcaagtaataaaaacagctaagcaaaaacagcttctcttgtttttgggttggtggggattattaccgatgcaagcttttaaacactgtttactcggaaaaagggacggcgacacggcttttgtcacagccctatatgaaattgtctttccttaagagaacagacaatctgtctagaaaaagataaataattgaatggaagaaatggagttaggttatgaataatccagaattaaagcagcaagtggacaatcgcagaacgtttgcgatcatttcccatccggatgcggggaaaacaacgattacagaacaattactattgtttggtggagctattcgtcaagccggaactgtaaaaggaaagaaaacaggtaattttgccaaatcagactggatggaaatcgagaaacaacgtggaatatctgtcactagttctgttatgcagtttgattatcaaggaaaacgagtaaatatcttggacactccaggacatgaagatttttctgaagatacttaccgtactttgatggctgtggatagtgcggtcatggtaatcgacagtgccaaaggaatcgaagcacagacaaagaaattgtttcaagtggttaaaaaacgtggcatcccgatttttacttttatcaacaaactagatcgtgatggtcgcgaaccattagaactgttagaagaattagaagagttattagatatcgagtcttatccaatgaattggccaattggtatgggaaaaggtttagaaggtctttatgatatttaccataatcgtgtagagttttatcgtccggaaaattatcaaggagaacgtttagtagaattggatgaagatggtctgcttcctgataatcatcctttaactgaaaattccttatatgaacaagtcttagaagaagtagaactactcaaagaagctggagatgcatttaatcaagaaaaaattgctcgtggcgatcagacaccagtattttttggttctgcattaactaatttcggtgtacagacttttttagaaactttcgttgaattagcaccagctccttatgggcataaaacacaagatgatcagatggtaagtccttatgaagaagaattttctggtttcgtattcaagatacaagcaaatatgaacccagcccatcgtgaccgaatcgcttttgtccgaatctgttctggaacattcgagcgaggaatggatgtctggttagaacgtacaaataaaaaattgaaattaagcaatgttacgcaatttatggcagattcgagagagaatgtagaaaaggcagtagcaggtgatattattggtgtatatgataccggtaattatcagattggggatacattgttcgaaggcaaactaaaagttgcttatgaagaacttccttcatttactccagagctgttcatgaaagtgactgctaaaaatgttatgaaacaaaaatccttccataaaggaatctatcaattggttcaagaaggagcgattcagctttataaaacatatctaacagaagaatatatcattggggctgttggtcagctgcaattcgaagtattccaatatcgtatgttaaatgagtacaacgcagaagtcatcatgtctccgatggggcacaaaattgctcgctggattgatccggaagatttagatgagaagatgagttcaagccgtaatatcttagcgcgtgatcgttttgatcagccgttattcttatttgagaaccaatttgcggaacgctggtttgcggataaatatccagatgtcaaactgagaagtttgatgtaaagaggttataaaaaatttgcgttgcatcaagtaataaggaaagccaaacaaaaacagcttctcctgttttggatttggttgaatacagtttaccaagaaaccatgagtctgccactcagtttcaagtgcaaataaaaattttgaaaatacattcttatactttgttgttagccgtgacggattttccgttacggttctttttatcatttaaaactataaaaaatgtctaatctaaaaaaatataaaaattactttgcgtacatactattaaagagaggagggtttgtgaaatggaaacagaatggcaaaggcgtcaaagaaaaaaacagaaaaaagcagaaatgttgcgattatgtcgattgttggatgtaaaagactgggacaaaaacgagcagattgcacaagaagtgcaatcaatcatccagaaagaagaaaaagtaaaaaataaagatacgagtagatcaaaaaatgaaaagagaaagacacaaaagaagcgtaaaaaaataaagagccagaaagcaaaagaaacaaatgaggcgtgaatcgtctcatttgcttctttaattatgttcaaaagttgattaaacggctaacgtcgcgtctaattcgtgttttggaatagagatttcaacaagcccggccaattcgattactttgatttcatcctcgtggtaaacagcatctttgattttatccaagaaataatttttagcttcttcgatttctttcggctggattttacgtttatcattgattaacaaaatttcattatgttcaggggcttcagtgtagacaatagtggtatttccggctgtgtagactttgaccagatgggcatcagtgttttcaagctggttcaatacaagacgggaatggctgtttgttacatttaccaatttcatggcgctcacctcttttatgtatttttaattgcttgtttcttttattataatttcttttttataaaatgaacagtattttgacttttctgaaaaaagagagcatgggacaaaagtaaagaacacttttgtcccacgctctaaacacgtataaacagcggaagcagaagcaactccttcggaaataagctgaaattcacaaaaatttgaaaagtaattttcgtgaattccttcttatttcttggagttaaacgcttctgtcccagcctctatatacatactaggtttactcagccgtttcttcggttgattcttttgctaaacgttctggtttagaagtcacaatgatttttccatccttatccaattttgctttcaactcatgaatagaagggtgatcaaggtaaaattcagcgatgccatcttcgatttgttcttggattgttcgtcgaaggggacgagcacccatggatggatcataacctaagtcaactaatttttctttgacattcgtagggacttcgatatgaagttgctgtgctgccagcatttgattgacatcgtctagcatcagtgtaacgatggtcatcaagttttcttttgacaaagcactgaattcgatgattccgtcaaaacgatttagaaactctggtgtaaagtaattattcaattgattcaataccgaacgagtaacaccttcacgtgccgcaccaaagccaacatttgcttctactttaccagtaccggcattacttgtcatgatgatgatcgtatctttaaagctgacggttcttccttgtgcgtccgtcaatcggccatcatctaagatttgcaagaacatgtgcaaaacatctggatgagctttttcaacttcatctaataagacaagactgtaaggatttctccgaactttttctgttaattgaccagcttcttcgtatccaacataacctgggggagaaccaatcaatttagagacactgtgtttttccatatattcagacatatcgaaacgaatcattgaatcttgtgaaccgaataattcataggcaagctgtttggcaagttctgttttacctacaccggttggtccgacaaataagaaggagccaattggacgattctgtttgttcaatccaacacgatttcggcgaatcgctttcgctacacggtctacagcattatcttgaccaatgacatgagccttcaagtcatctgctaagtttttcaattgtgtctgttctttttcttttaattcgcccactggaatacctgttcgttgttcaacgattttttccatatctttttcggtgatgacaggtgtttcttcttcggtgagttggcgttctttcattttttgaagtttgttgatctggtcacggtaataagccgctttttcgaaatcttcttctcgagaagctaaaactttttgttcttccgcttcttgtagttttttctcgattgttttaggatcaacgatttgaattgttaagtttttcttagaacctgtttcatctagcaaatcgatggctttatccggcaagaagcgatcttggacgtaacgattggataaagttgcggctgcttcgatggcttcatcagtatattttacatgatgatagtcttcgtaacgtttttgcagtcctttcaagatactgattgtttcttcgacagttggttcatctactcgtacgggttgcatgcgacgctctaaggcagcatctttttcgatgatgcgatactcgtttaaggtagtagcaccaaccatctgcaattctcctcgagctaaagcaggttttaaaatattaccagcatccatgtttccatcgcctgcggaaccagcgccgacgatttcatgcacttcatctataaatagaatcacattttctgcttgacgaatttcttcaatcaatttttgcatccgttcttcgaattgacctcgtataccagtaccttggactaaggatacgacatctaaacgaatgacttctttgtccattaatttttgtgggacatcgccatctacgattttttgtgctaacccttctacaactgctgttttaccaacaccaggttcaccaatcaagacagggttgttcttagttcggcgatttaaaatttcgatgacacgtttgatttcatcatcacgaccgatcacagggtcgatatccccttgtcgagcttgttcagtgatgttgattccgtattctcccaataaaccttctgtattgccttgaggtggttgtccaccattgaagttgttgtttccaccaaattgtgttggcggtgtttgctcatagtttccttgctgttgcatttggcgagacatggaacgaaaaagatcgtccaaactaccaaatccaaatggatcattttgggccatattagttagacctccattttgctgatttttgattttttgataacagctctgacaataatcaagttgtgtccgctgaccattgacagtggcatacaagtgaatcgttgcctcattcttgccacagttttgacaaagcatgaatcattcacgtcctttcacaaaaatgggtacaaccatattttacatctcgtttttcatgaggtaaaagaataacccctatttttttagggatttatgaggtagaaaaggtaaaatgcctattgaccattcctgacctttgattcttattatactaaaaatcgacagggaagcaagtaattcgtttcatataaaaacaaacaaggtcaaaggaaagaatgataaacgtcaggagaaaagatagcgacaagaaaaagaaaataaacacgtttgttataaaatgtgaagaaaaggatgaaaaagaatccggaataatttgaatacttttatctgaaattgaatgaaaactgttgtatctaacgaaaaaaaatgttaatctttacagatgaaagggtgacacttgttaggattctctgaattactaaaaaagaaaaccctcacataaaaacaacactcacttaaaggagaccgattaatatggaaaagaaagaatttcacgtagtagcagaaactgggatccacgcacgtccagctacattattagtacaaacagcaagcaaatttaactctgatgtaaacttagagtataaaggtaaatcagtaaacttgaaatcaatcatgggcgttatgtctttaggtgtaggtcaaggttctgatgttactatcactgcagaaggtgctgacgaagctgacgcaatggcagcaatcgttgaaacaatgaagaaagaaggcttatctgaataatggttgaaatgctaaaagggattgccgctagtgacggtgttgccgttgcaaaagcttacctgctagttcaaccggatttaacattcagtaaggcaacagtagaagatactgcggctgaagaagctcgtttggatgctgcattagctaaatctactgaagaattgcagcaaattcgtgaaaaagcagcgcaaagcttaggtgaagcagaagcgcaagtatttgatgcccatttgatggttctttcagatccagaaatggtaggtcaaatcaagcaaaatattaaagacaacagcgtaaatgctgaatcagcgctaaaagaagtaacggatatgtatatcggtatgttcgaagcaatggaagataatgcttatatgcaagagcgtgctgcagatattcgtgacgttgctaaacgtattttagcgcacttattaggcgttactttaccaaatccatcaatgatcaacgaagaagtggtcgttgttgcacatgacttgactccaagtgatactgcacaattagatcgcaattttgtaaaagcgtttgtaacagacattggtggacgtacttcacattctgctatcatggcacgttctttagaaattccagcaatcgttgggacaaaagaaatcactgctaaagtcaaagaaggcgatattttggctgtcaacgggatcgaaggcgatgtaatcatcgatcctacagaggaacaaaaagctgaatttgaaaaagcaggtgcagattacgcagcacaaaaagcagaatgggaaaaactaaaaaatgcagaaactgtcacagctgacggcaagcattttgaattagctgcaaacatcggaacaccaaaagatctagttggtgttcataacaatggtggagaagcagttggtctgtaccgtactgaattcctatatatggattctccggacttcccaacagaagatgaccaatacgaagcttacaaagctgtattagaaggtatggaaggaaaaccagttgttgttcgtacaatggacatcggcggggataaagaactaccatatctgcaattacctcatgaaatgaatccattcttaggatatcgtgcattacgtatcagtctatctgaacaaggcgacgaaatgttccgcacacaaatgcgtgcattacttcgtgcatctgttcatggtaacttacgtatcatgttccctatggtagctacgctcaaagaattccgtgcagcaaaagcgatctttgaagaagaaaaacaaaaattgatcagtgaaggcaaggaagtatcagatacaatccaagtcggcatcatgattgagattccagcagcagcagtcttagcagacaagtttgcaaaagaagtggatttcttctcagtaggtacgaacgatttaattcaatacacaatggcagcagaccgtatgaatgaacgtgtttcttacttgtaccaaccatataacccatcaatcttacgtttaatcaaaaatgtaattgatgcagcacacgctgaaggaaaatgggcaggtatgtgtggagaaatggctggagatcaaaccgctgttccgctgctagtaggtatgggtctagatgagttctcaatgagcgcgacatctattcttaaaacacgtagtttaatgaaacgcttggacacagggaaaatggctgaacttgctgatcgtgcattgaaagaatgcgatacgatggaagaagtcgttgaacttgttcatgaatatgtaaaataaacaacgtataaaaaaactggtgtagcttgtaaaagagctacgccagcttttttgttttctgttcttttttaagaaagcgttttcgtaagcaagattagacaaaaatagggcttaagtttgagtgacagtttggaggctatgttatactatataaatgaagggggacgtaaggtgaaggtattattatattttgaaagtgaaaagatgcttgcaaaatctggaatcgggcgtgcgcttgatcatcaaaaacgtgctctgacggaagtcggtatctcttatacactagacgacaaagatgattatgacatcctgcacatcaatacatacggaatcaatagtcataatatggtcaataaagccagaagagaaggtaaaaaagttgtctatcatgcgcattcaacagaggaagacttccgaaattcctttatcggatcgaacaagctttctcctattgtaaaaaaatatctggtaggattgtaccaaaaagcggactatttgatcacgccaacaccttattcaaaacagttgttggaaagctatggtatccgtgtaccgattcaagctatttccaatgggatcgacctagagaaatatcgccctgatccaatgaaagaacaaaagttcagagagtatttcaaactatctccggatcaaaaagtaatcatttgtgtcggtttgtttttcgaacgtaaaggaatcattgatttcgtagaaattgctaagaagatgcccgactatacattcatttggtttggtcatgttccgatgtactcgattcctcgaaacatccggaaaattgtaaaagaagaccatcctgagaatgttctgtttcctggatatatacgaggggaaatcatcgaaggagcatattcaggtgcagatctattcttttttccttcctatgaagagacggaaggaatcgttgttttagaagctttagcaagcaagcaaaatgtacttgttcgagatattccagtgtataatggctggttagaagatagcaagaactgctatatggggaagacaaacgaagcgtttatccaactgattcaacagattaccaatgaagagctaccgagtttgacacaagccggttatcaaacagcaaaagaacgaagtatcaataaaatcggtgaagaacttaaaaacgtatatgaaagtgtgctgaatgaaaaagtctctagcaaattaaaaaaagtacatcagacaaaggactagtttggaggcgaaaaacatgaaaatcggcttttttaccgatacctactttccgcaagtcagcggagtggctacatcgatcaaaacattaaaacaagaattagaaaaacatgggcatgaagtctatatctttacgacaaccgatcctaatgcggacaagttggaaaaagatgtgattcgaatgccaagtgtaccgtttatttctttcaaggatcgaagagttgttgttagaggcatgtggtatgcttatttggttgccaaagaactagaattagatctgatccatacccatacagaattcggagcaggaatactcgggaagatggtagctaagaagttgaaaatacccctgatccatacttaccatacgatgtatgaagattaccttcattatatcggtaaaggaaaagtgatcaggcaatcccatgtaaaatacttatccagattatttgctaatcatacgacaggtgtagtctgtccaagtgaacgtgttattgatacattacgtagctatggtgtagtagcaccgcttcgtgtgattcctactggtatcgacattgagaagttcaaacgttctgatatcactcaggaggatatcaacaagttaagggagtcattaggacttcaggaaaatcatctgatgattctttctttaagcaggatttcttatgagaaaaatatccaagcattggttaatggatttcctcaggttatctcggcttaccctaatgccagattagttattgtaggaaaaggtccttatgtagaagagttagaggaattgatttccgaactgcagttagaagaatttgtgcagtttacaggagaagtggataacaatgatgtagccctttattataaagcggcagattattttgtcagtgcttctacttcagagacacaagggcttacttataccgaagcgatggcagccggcacgccttgtgtcgtagaaggaaatgcttatttgaaccgattgttcgatcatccttcattagggaaaacttttgaaaccgacgaagactttgcacccgcacttattgattatatttccagtgaagcccctagaaatccaaaggttttagaagccaaactttatgacatttcgtctactcatttcggcgaagcaatgatcgaattttatcaagatatggttgtttaccatgaagaagagatgcgaagaaaagaagaagaagcttcgattgaacgaatcaaaatcaaattaaattcatttaaaagataaaattcaaacattttttataaaaaaatccttgtttctagcgtatactagcatagaagcaaggatttttgatttttaggaggtcgaaagaatgaaactaggttttatcggaacaggcgttatgggaagtgctgttgtacgccatctactagaagcaggtcacgaagtcgctgtttataatcggacaaaagcaaaagctgatcctttagtaacagaaggagctgtctgggcggatacaccaaaggctgtagcagaacaaagtaatattctgtttacaatggtaggttatcctaaagatgtagaagaaatctactatggagaatcggggattttttctgcagatgtctcaggacgtattttagttgatttgactacaagtacaccaactctggcagaaaaaattgcaaaaacagcaaaagaaaaaggtgcagatgcattagatgcaccggtgtcaggcggtgacttaggagcaaagaatggcacactgacgatcatggtgggcggagaagaatcggtctataatcaagtacttcctttattcaaggaatttggtacgacatttacattgcatggctctgctgggaaaggtcagcatacgaaaatggctaatcaaatcatgattgcaggcacgatgacaggaatgacggaaatgcttgtctatgcacaaaaaaacggtctcgctttagaaaaagtgattgagacactttcaggcggaagtgcagctaactggtctttaagtaattattccccacgtatcttgaaagaagattacacgcctggtttttttgtcaaacattttatcaaagatttaaagattgcattagaagaagcagaaaaaatgaaccttgtcttgccagcaaccatccaagcgttgaaactatacgaagagttggcagataaaggttttgagaatgacggaactcaagcgttgatcaaactttggtggcctgaagggaaaataccagaaaaaaaatcataaaaaacgagtttttttagagaaaatcaatgcaagtaggctatgcttttgatacaatataacagaaataagaaaaggaggacctccgatgacacattcacaattagtcgcaatcataaaacgactggaggctatggtcgagtcagcagataatgaactgcaagttcgccgttttgaaaaagaaggcgtagaaaagtgtacagtaacttatgataaagcgaccgatacatttgaattaactgaaacagatactcatcagcaatacgaattcgataatatcgatatcgtagcgatggaaatctatgatttaatccaataaattttaggataattgacatttgaagttgaagatgcctaaaagaagccgagaagcagctaatttagttgcttttcagcttcttttttatttaattgctccatttcaatctgttccttttctaattttttgcggtaactaatcaaaatttgtacaggatcgatttcttcttttgataattggcgtttcaaagataaaagagcttcttttttttcataataaaagtcaggtggattgttcccagaagtaatcattgtttctgcaagctgtccgtaacaaataaggtagtgctttttctgactattgtccgctgccagtggcatgctgaatgtgagggatggtgttcttaaaaactgcttttgttcttggatccgtctgatgaaataagtaactaattcgatatctttttgaagcatgccagctttttcgaaattcagctgatagatgaaatgttgttgtctctttttcaagtaagtcagtagctttttattgcgaccctgaaacaattcttggatttccttctttttctgttcaaaagtcatttcctgtaagtcaggaagctggactcgcaaagctaataagctgatttcagacaaccaaggcatttgatacgtttcttccattatacgcaaaatagacggcatttttttatagagacgaaaaggcccgtatgttcgagccgtaggagtatctgttaatacaaatcccttattggaaatatgtacataattgtagttactgaaataattcatttgtcggttataaaaaggacggtaatgttggatcagttgacactcaagcaacaaagcatctaattctgtatctactacgacaaaatcaaaatctgttatatgatgaatcatacgtaatactttttttgaatgctgcttattctgatgaaaatagctgctcactctatttttgagccgttttgctttaccaacatagatgaccatcccttcttggtttttcataagatagactcccggcagcatggggagattttttattttttcttttaacatagggtctcctttcacgctttgaataaaaagactataacaaattttaaaataatggacaagttttagataattggaacattctatcaacaagaaatactttgataatcaaaatatgtcggtgcaatagtttttctaataaaataaataaaaaatgctggtttatcagtttttttaaatgagtaaaatcttaaaataaactcatataacaaaaaaatgaacttttacggttgcattttgaaaaaagttaagatatagtttgaacatcaaaagatttgataatcaaactaattagtggacggtggaacatggaaccagatttaaaaacagtaaatgattatcttgttagtgtcttcaatgatattttgacaatcgaagaatctgagttgaaaaaatctcaattcaaagatctgtcaatcacagagatgcacacgatcgaggcaatcgggatgtacaagaaaaaaacaacttcagaagtagccaaagaactatcaattactgttgggaccttgaccactgctattaacaagttagtaaaaaaaggctatgtcgaacgtatccgcagtgaagatgaccgtcgtgttgtaaagttgggactaacgaaaaaaggaaagttactgtttcgggtccatcagcattttcatcgtgaaatggtcaagaacatcttagaaggaatggctacggaagaacagcatgccttgctggatgcactgaaaaacttgcatgacttcttgcaagactataagtgaggatatttaatggaacaatttggaatgattactgcaacagccagcgtccttcctgaaaagatcattacgaataatgatctttccaagatgatggatacctcggatgaatggatttcatcaaggacgggtattcgtgaacgaagatgtgtaacaaatcaggagacatctgatttatgcctcttagtggcggaaaaaatgatgcaacaaaaaaatctgaaccctaaagatttggattttatcttagtagcaacaatgtcgcccgattactcgacaccatctgtagcagcacaagtacaaggaaaattgggagcagctaatgctattgctttcgatatcagcgcggcatgctcaggatttgtttatgcgttaagcatggctgaaaaaatgatccgctgcggctcaactaaaggattggtaattggtggtgaaacactgtctaagctaatcgattggtctgatcgcacgactgctgtattatttggtgatggagcaggcggggttctcttagaagcaaacccacaaaaaaaattgctgaaagaaaaattagcaactgatggtaccagaagtacctcactgactgctggctaccagcaaaataaaaacccgttctattcagaagattcagaaggttcgtattatttgcgaatgaccggcagagatatttttgatttcgctgttcgagatgttgcaaacaatatccaagaagtcatgaaagacacgccagttgattatctgcttttgcatcaggcaaatctcaggatcattgagaaaatcgcccgaaaagtaaagatgccgcaagaaaaattcctgaccaatatggataagtacgggaatacctctgctgcaagtatccctattttattggatgaagcagtttctagcggaaagatcaccttgggaaaacaacagaaagtaatatttacaggctatggcggaggtttaacgtggggaagtattctcatggggctgtaaactgttaaattataaaaataaaaaagcaaacaatatcggaggaatatattattatggtattcgaaaaaattcaagaaatcattgcagaagaattaggaaaagaaactgaagaaatcaaattgactactgacatccaagaagacttagaagctgacagcttggatttattccaaatcatcaatgaaattgaagatgaatttgatgtaaaaatcgaaacagaagacggaatcaaaacggttcaagatttagtgacttacgtagaaaaacaaactgcataatcattaaaattaggttgggggctgggacatttcctgaaatagggatgtctcggcctttttgaataagaagaatcaaacatatattctggatatattggagaaaaacatgaaaacagcattcttatttagtggccaaggtgcacaatatcaaggtatgggaaaagatttatatgaagaagccgttgtaaagcagacatttgatgaagcaagtgagattctcggctacgatatggccgaactctgcttttcagaaaatgaacgtttggatcagacacaatatacacagccagctattctaacagtcagcattgcgtattatcgcttattgaaggagcatggaatcatcccagatgcagctttaggactgagtttaggagaatattcggcattagtagccagtgatgcgttatccttcactgaagccgttgcactagtagcgaagagaggcgtttatatgacggaagctgccccagctggaagcggaaaaatggtcgcagtaatgaatgcgccgattgagacgattgaggaaagctgtcatgaagcaagcaagtacggcatcgtgtctcctgctaattacaatacacctcagcagatcgtgattggtggcgaagaaaaagccgtagatgaagctgttttgctcttaaaagaaaaaggaatcaaaaggatgatcccactaaatgtcagtggacctttccatacagctattttagcaccagcatcaaaaaaactggcgaaggatctaagtcatattcaattttctgacccttcttttccagtcatcagcaacacaacaacggaaataatgaagaaagagacgattgcgggactactcgaacagcaagtcatgcaacccgttcgtttctacgagagtatccataaattaaaaacaatcggtatcgagcaagtcattgaagtcggtcctggaaaagtattaagcggatttatgaaaaaaattgataaaacgataccagttctgcgtgttgaaaataagcagacatttgatgaaacaatagcaaaattataaggaggaaggttatggatgtaaaagggaaaaatgtatttatcacaggtagcacaagaggaattggcaaagcgatggccttagcttttgcaaacgctggagcaaatattattttgaatgggcgcggagagattccaaaagaaaagatagaagaaattgaagcattcggtgtaaaatgcgtaggagtttccggcgatatctctaattatgagaaagtaggacaaatgatcaaagaagcagaagaaaagcttggatcgatccatatcttagtaaacaatgccggaatcacaaatgacaaacttgtgatgcggatggatgcagaagatttcaaaaaatgtcttgatatcaatttgatcggtaccttcaatatgacgcagcacgttttgaaaaaaatgatgaagcagcgagaaggggccatcatcaatctctctagcgtatctggattgattggaaatatcggacaagcaaattatgcagctagcaaagctggtgtcgtaggattgacaaaatcggttgcacgagaagctgcgactagaggtatcacatgcaacgccattgcaccaggattcatcacaactgatatgacggaagttttagcagataaagtcaaagagcaagcggaaaagcaaattccaatgcaacgtttcggacaagtagaagatgttgcacaaacagcagttttcttagcacaaaatccatatatcaccggccaagtcatcaatgtcgatggcggattggtcatgcacggataagaaaaggagagcaaataaatgaatcgagtggtaattactggctatggagtcacttcacctattggaaatgacgcagacagctttttgaatagcttgaaagaaggtacgaatggcatcgcaccgatcactaaatttgatgcttcagaaacagggatcaccttagcgggtgaagtcaaagatttcccttacgataaatattttattaaaaaagatagcaaacgaatggatatgttttcgatctatgggatctacgctgctttagaagcaatggagataagcggtttagataaagaaaaaatgaatcaagaccggtttggtgtcatcatcggatcaggaatcggtggtcttccgacaatcgaaaatcaagttatccgtctgcatgaaaaaggcgcaaaacgagtttctccaatgttcgtgccaatggcgattgccaacatggcagctggaaatattgctttacgagtaggcgcaaaaggcatctgtacagctatcgtaacagcttgtgctagcggaacgaattcaatcggtgaagcattccgtaacatcaaacatggctattcagatgtcattcttgctggaggaacagaagcaacgatttgtgagatggggattgctggatttgcagctttaactgcactttcggaatcaactgatcctaatcgtggttcgatcccgtttgatgaaaatcgaaatggttttgtgatgggtgaaggagcaggtgttctagttcttgaatctttagagcatgcacaggctcgcggtgccaaaatctatggagaaatcgttggatacggtgcaaattgtgatgcttaccatatgacagcccctactccagatggttctggtgcgtctaaagcaatgaagcttgcgatggaagaagctggtatacagccggagcaagttggatatatcaatgcgcacggaacgagtacgccagctaatgaccaggcagaagcaaaagcaatccaactcgcactaggtgaaaatttcagagatacttatgtcagcagtacgaaatcaatgactggacatttattgggagcagccggcgggatcgaagcattagccactctgatggcattggaacatcaatttatcccacctacaatcaatgtagaaaaacaagatcctgagattgatttgacagttgtcaaaaacgaaagtaaacctgcaagctttacttatgcaatgagcaattcattagggtttggcggacataatgcggttctttgtatgaaacgctgggaggaataattttggatatcaatgaaattagagaattagttagtcaatttgatcaatcttcgctaacggaatttgacttgcgtgaaggtcaatttgaattgtacatgaataaaaataaaacaagtcgaggcatgaatatggttcaaacaaacgaaacgttgccagtttcggagccagttaacgccatgcctgaagaagcaacaactgttccaaaaccaacgaaggaaaaagaatcggtagtatttgatggaatcgaggttgtttcgccaatcgtgggaatcgtttatctgcaaccggcaccagacaaaccagttttcaaaaaagtaggtgatcaagttgccaaaggagaagttatctgcattattgaagcgatgaaactgatgaatgagataactagtgagaccgacggagtaatcacagaaatccttgtagagaacgagtcagttgttgaatatgggcagccactctttaggatccagccaaaataagcaaagcaggaaagagggaaataaatgaacatacaagaaatcaaagaaattattccgcatcgttatccaatgcttttgattgatcgagtggaagagatggttgaaggagaacggatcattgctaagaaaaatgtaacgatcaacgagcccttttttcaaggacattttccagaagaacctgttatgccaggggtactgattgttgaagcaatggcgcaagcaggagcagtcgcattactttctcttgaacagttcaagggtaaaacggcttacttcggcggattggacaaagcaaaattccgtaagaaagttacaccgggagataccttatatcttgaagttgagatattgaaagtgaaagcctcagccggaataggcaaaggaatcgctaaggttgacggtaaaaaagtagccgaagcggaattaacctttatgattggataggtgaaatatgttttctaaagtcttgatagctaaccgtggcgaaatcgctgtgcgtatcattcgtgcatgccgcgaattagggatccaaaccgtagcgatatattcagaggcagatgccgaagcacttcatacacagctagcagatgaagcaatctgtattggtccggcaaaagcggttgattcatatctgaatgttcaagaagtactgagcgctgcaatcgtaacaaaagctgaagcaattcatccaggctttggatttttatctgaaaatagccggtttgcctccatgtgtgaagagtgcaatatcacatttattggtcctaaaagcgcaacaattgatgcaatggggaataaaatcaatgcgcgtcaattgatgcaagaagcaaatgtcccggtcatcccaggaagtactggtgtattatctactgtagaagaagcattggaaatagcagacagaatcggctatccagtgatgctgaaagcagctgcaggtggtggcgggaaaggcattcgaaaagttcaatcaaaagaagaacttccacagcatttttcttcagctcagcaagaagcagcagcggcatttggaaatgatgatatgtatttggaaaaaatcatttatcctgctcgccatatagaagttcagattttaggtgatcattttggcaatgttattcatttaggtgaacgagattgttctttgcaacgtaataatcaaaaagtactggaagaatctccttctgtagtgatttcacaatcaaaaagagaagcactaggagacgctgctgttcgagcagctaaagcagtcaattatgaaaatgccggaacgatcgagtttctgatggatgaagaaggcgaattttatttcatggagatgaatactcgaatccaagtggaacatcccgtaacagaaatggtcacaggaatcgatttagtaaaaaaacaggtggagatagcagccggtgagcctttgaatgtacgtcaagaagaagtagtattccaaggacacgccatcgagtgccgaatcaatgcagaaaatcccgcttttcattttgctccttcaccagggaaaatccaaaacttgctacttccagcaggtgggatggggttgcgggtagacagtgcagtttatccaggctatacaatcccgccatattatgattcaatgattgcaaaaattattgtccatggaaatacacgttttgaagccttgatgaagatgcagcgagccttaagtgaatttatcacagaagggatcattacgaacgcagaatttcagatggatttgattagtcatcaagcagtaatagcaggtgattacagcacagcatttttacaagaagaatttttaccgaattggacaccagaaacggagataggaggcgcatagatggctctgtttaagaaaaagaaatatattcggatcaatcctaatagagagagcaaacctgctaactcgccatctgttcccgataacatgtgggcgaagtgtccaaattgtaaacatatcctttatacgaaagacatcggtgaagaaaaagtatgcccccattgcggatacgcttttcgaatcggtgcatggcagcgtctagctttgatcattgatgaaaaaagttttgaagaatgggatacggatcttgtaaccgaagatccgctagcatttcctgaatatacggaaaaaataaaaaaaatgcaagacaaaacggggcttcatgaagcagtcctcactggtaaagcaaccattcagggaattcccttcattattggagtgatggaccccaattttatcatgggaagcatgggcacgattgttggagaaaaaatcactaggttattcgaacgagcaacaaaggaaaaacttccagtcgttttgttcacggcttctggaggcgctcggatgcaagaaggcatcttttctctgatgcagatggcgaaaatctctgctgctgtcaaacgacacagtaatgaaggtcttttttatctaactgttttgacagacccgacgaccggaggagtaactgccagttttgcaatggaaggtgatatcattttagcagaaccccaaagcttgattggttttgctggaagacgtgtcattgaacagacgatcaagcaggaacttccagaagatttccaaaaggccgaattcttattgtctcatggtttcgtcgatcagattgttccccgcatggaattgaagcagaaaatccatacgcttcttgaattgcatacacagaaaggatggatagatcgtggataaaacagcacatgatgtcgttcagttagcaagagctaaagaacgatggactagcttggacttttttgaagagatcttcgattctttcgaggaatgccatggtgaccgtttatttgcagatgacgaagcgattgttggtggcatcgctcgattagatggcaaaccagtaacagtgataggtattcaaaaaggaagggatctgcaggaaaatatccgcagaaattttggttctcctcatcctgaaggctatcgcaaagctttacgactgatgaagcaagcggaaaagttcaatagaccggtgattacattgatcaatacagcaggtgcctattgcggtataggagcagaagagcgtggcgagggagaagcaattgccaaaaatctgctcgaaatgtctgatttaaaagtaccaatcatcgccgtcatcattggtgaaggtggaagtggcggtgcccttgctctaggtttagcggatgaagtctggatgttagaagaaacgatctatgctgtgctttccccagaaggatttgcttcgattttgtggaaagacggcagtcgcgctgcagaagcagccgagttgatgaaaattactgcaccagaactacgtgagctagggatcgtggatcgagtgattcctgaaacgttcaacggcgagcagttgccacggcaaaaagtcgctcacatcatgaaaaaagcgttgattgaaaaattaacggaacttgttcgattcgaccaccatgaactattggaaaaacgatacaagaggttccgacaatattagatgtttaacaactaagcaaagagtaaagaatgattcttgctcgcttagttgttttttgtttctaaatttttctgtgatcaatctttattttgggtcattttgtaaagaaatgctttttctgaaagagggacgagtatagaggtagttttttttgctgatatgcagtataatacggggttgaggagtactttatgtgctccttcattttttgcagatgaggagacaacatgttttcaaattacaaaccaacatggatggtagaagccatctatcagattacacctgcccaattaaagaatctaggcatcaaagcagtattgacagatttagacaatacgttgattgcatggaataatccagatggaacagaagagttgcttacttggattttagaaatgaaaaatgcaggaattcctgttgttgttgtttcaaacaataattcaaaacgtgtcgcgcgagcgattgaaaaatttgatcttttgtatgttgcacgagcaatgaaacctttagcaagagggatcaacatagcaaagaaacaattggatttagcagatgatgagatagtaatggtaggcgatcagatcatgactgatatacgtggagccaatcgtgcagggatacgtagcatccttgtaaaacccattatcgcaacagatagttggaagacacaatttaatcgtttttgggaaaaaagaattatggcctatctattagcaaaataccctgatatgggctggcgaggtggaatcgaatgacagaagaattacaatgtatcggctgtggtgccgttatacaaacaagcaaacccggtgaattaggatacacgccgcaaacggctttggaaaaagggttagcttccggcgaagtctattgtcagcgttgtttcagattacgccattataatgagatccaagatgtctcattgacggatgacgactttttacgcttactgaatgaattagggcaaaaagatgcattgattgtcaatgtggtggatatttttgacttcaatggttcgctgattccaggactacaccgttttgtcggcgataatccagtacttttagtgggaaacaaagtggatatattaccgaaatcattgaaaaaacctaaattaacacaatggatgaaggaacgtgctcacgaagcagggattcgtccagtagatgtattactaactagtgctaagaaatctcatgagatgacggaactattagaaaaaattgaagaataccgcgatggacgggatgtttatatcgtcggagtaacaaatgtagggaaatcaacgcttatcaatcaaatcatcaaaaatacagcgggagtacaagatgtgatcacaacctcacagtttcccggaacgaccttggataaaatcgagattcctttagatgatggacattttttgattgatacaccggggatcatccatcgtcatcaaatggcgcattacttaggtaaaaaagatttgcggatcattgccccgttaaaagaaatcaaacctaaagtttatcagctgaatgaagggcaaacactttttttgggtggacttgcaagatttgattttatcagcggcaatcgtgcttcatttattgcttatgtgtcaaatgatgtaaatattcatcgaacgaaactggaaaaagcagacgaattttatcaaaaacatgtaggtggattattacagcctcctcgtcctgatgaagtcgaggcatttccggagcttgttcgttttgagttttctgtgaaagaaaaaacagacatcgtttttgccggtctaggctggatcactgtaacagcgccagcagtaattgcgggctgggcgccaaagggtgtagatgtattgaaacgcaaagcattgatttaaggaagaaggaaaattatgagtttaagaggaaaacaaaagcgttttttacgtagcaaagcgcatcatcttcagccgatttttcaaatcggtaaaggtggaattaattcagcaatgatcgtccaaattgaagaagctttagaaaaaagagaactgatcaaagtatctctacttcaaaatacagatgaggttgcagaagaagcagctcaagtattagaaaaagaaatcgactgtgaaatcgtccaaatcattggacgagtcattgtattatacaaaccttctacaaaagaaaagtatcaaaggttatcaaatgaagtaaaagcaatataaggagtgaccatgatgaatacgcaagctaagacatttgttcattcacaactatttcctaaagaaatgcctcaattcttagagaagaaaaagcaagtagggatcctaggcggaacgttcaatcccgttcaccttgctcatttagtgatggctgaacaagctggccggaatttaggtcttgaccgcgtatttttaatgccttcttatcagccgcctcatgttgatgagaaacagacgattgatgcaaaacatcgactcaacatgttggaattagcggtggaagacaacccttttttgcagattgaaacgatcgaattagctcgtggcgggaaaagctacacctatgatacgatgaaggaattgacacaaaacaatccggatacagattattactttattattggtggggatatggtagaatatttgccaaaatggtataaaatcgatgagttgacttcgatggtcaattttgtgggcatacgtcgaccaggttacacaacagatacgccatatcctgtgatttgggtagatgtacctgaaatcgacatcagttccacaaaaatacgtcaaaagatcaaagaaggctgttctatccgctatcttgttccagataaagtaattgattatatccaaaatgaagggttgtatgaagatggactatagtaatgaatatactgcttattctagagaaaacctgatgcaaaaaatacagatgagaatgagcgaacaacgcttcaagcatgtgcttggagtagaagaaacagctgttgctcttgccaaaaaatacggtgcttctcctgaaaaagctagtatcgctgcattgacacatgattatgcgaaagagcgaccagatgaggagttcaaaatggtgatcgtaagagacggttttgatccagaattattgaattataataatgctatctggcatgggcttgttggagcttcgtttgtagagcgggaattaggaatcactgattcagagattcttcacgcgattcgagtgcatacgactggcgctgctaaaatgagtctcctggacaaaatcatttatgtagcagactatattgagccaggtcgggattttcctggggtgcaagatgcacggacaattgcatgggttgatctagatgaagcagtagcatttgaaacaaaacatacgctgtcccatttacttgcacaagaacaacagatttatccaaaaacaatcgaaacatataattactgggtagcaaaaaaataagccactcaatattaggaggaaatcatcatagatagtaaagaacaattaaaaattgcggttaaagcagcagattcaaaacgggcagaagacattatcgctttagacgttcgaaatgtttccttgttagcagattatttcatgatctgttcagcaaatagtgaacgtcaaatcaacgcaattacagaagaaatcattgataaagaagaagaaaacaaatatgaagtaaaacgtattgaaggaaaagaaggcggaaaatgggtattgatcgaccttggagatttgatcgtacatgttttccatgcgccagaacgaagcttctataatttggaaaaactatggtcagatgcgccgttagttgatcttaatgaatggttggattaacatggcttatgaaacatttgctttcatttacgatgaagtgatggatgaaacgctttaccagcggtggttagctttttcgaaacgtcatttgcaagaagacacaaaaaatattttggaactggcgtgcggtactggagcattagcggttgcctttgcaaaagatggatatgaagtgacagggttagacctttcagaagagatgttgatgatcgcaagccagagagcatatgaagaagacgtatcgatccaatttgtagaaggcaatatgctcgatttatcagaaatcggtcaatatcaagcaattacttgtttttctgattcgttgtgctacatgaaaaatagacaagaggtacagcaagtttttgatgaagtctatcaagcgttagaagaaaatggccgttttttatttgacgtgcactccacctatcaagtagacgaggtttttccagaatatagctatcattatcaaggggataattttgcttttttgtgggatagttatccaggaagtgagaaacacagcattgaacattttctgacttttttcgttgaggaaccagaaggatctgggcgatttatccgtgaagatgaactacatgaagagcgtacctatccattggaaagctatttaagaatgctggaaaacagtgggttttcgaaagtcgaagcattttctgattttacagacgaagcagcatcagagaaatcaaagcgctggttcttcgtagcatacaaagactagcaattttgcctgcttgagttaacaagaaaagaataaatcgtcaacataaattatatatccgaacgatataggcattgctcttgcggtgcagcttttcgtcgcagaagtattgtgtttgcgagaatagtttatatagttcgggtattttttctgatttttgacttttccttacttgtctctagtgtttttttatcgataaactatgaaggagggcggacatgaaaagctgcgggattatcgtagagtacaatccatttcacaatggacatcgctatcatgctgaaatggcacgaaaaacaacaggagcagaggtcgtcattgctgtaatgagcgggaattttttgcaacgaggcgaaccagctatcatcgataaatggcatcgtgcgaatgaagctttgcaaaatggtgtggatttagtagtagagcttcctgtcgaatgggcggttcagtcagctgattattttgccaaaggtgcagtgaaaatcttgcaagcattggactgtgacagtttgtgttttggaacagaagaagagacctcgtttgactatggtagtttcggccgatttgttcaacagaatcaagataagatagaagagtcttttcacgaactgtctgatcaaacgtatagttatccgcaaaaaatgactgcagtttttcgcagtctgtatcccgatattgcgcttgatttttcttcacccaatcatattttaggattaagttatgcaaaagaaaatgctaagtatatccaccctatggagttacatccgatccagcgtaaaagtgcaggctatcatgaaaaaacaatcaaagatcaaacaatagccagtgcaacagccattcgccatgcgttagaaaaaggaaaaaggatcgctggacttgtgccatttcagacagaagaagatctttccacttgttcgttacagacttgggaatcctattggccgtatttgcgttatcggttgttatcttctactttgatggaattgacagatatctatcagatgaccgaaggaatagaaactcgcatgaagacagcagctgcaacagctaacggttttgcggattttgtgtcaaaagtaaaaacaaagagatatacatggacgcggatccaaagattatcttgttatgtcttgctgaatatcaaaaagcaagagattcctatccaacaaaataaaaactatcttcgactacttggatttaccgatgctggaagaagattcttaaaagaaaaaaaagagatttctatttattcccgaatcggaaaaaaagaggcacaagaagcggaactgttagttagaagtgatcaaatctatcaattgggaggcaatattccagaacagaatttcggacaaatcccaatccaagtatagacctttgactgaaaatgagaagaatgaaggaagaaagaaaaaaagcttcacagaatcgtgattcacaagtataatggaacaggacgtttttgcgttatgaaactatcaaatcagaaagcgaagtgaaaatatgggacgtaaatgggcaaatatcgtagcaaagaaaactgctaaagatgctaataatagccggatttatgcaaaatttgggattgaaatctacgcggcagcaaaatcaggtgatcctgatccgcatgcaaaccaaaaactacgtttcgtcattgatcgcgctaaaacttataatgtaccaaaacatattattgaccgagcaatcgaaaaagcaaaaggtgcaggagatgaaacatactctgaattacgttatgaaggatttggaccaagtggctcaatggtgatcgttgatacattgacaaacaatgtgaatcgaacagcagcagacgtacgagcagcatttgggaaaaatggcgggaacatgggtgtttctggagcggtttcttatatgtttgacaatacagcaatctttgcatttgcaggagaagacgctgatgagatccttgaatatctaatggaaaaagacatcgacgttcgtgacgtaatggaagaagatggacaaatcatcgtttacggtgaagtagcggatttccatagtatccaagaagcattaaaagaaaaaggaatcactgatttttcaattgctgagatccaaatgattcctcaaaccgaagttacattatcttcagaagatcaagaaacatttgaaaaaatgattgatgcgctagaagatttagaagatgtacagcacgtgttccataatgtggcattagaagactaagcaatcagttttaacgaaaagtattcagtctttttcaaaaagcaggacaatctcactaacagattgtcttgtttttttgtgtgatttattttctattctaattcaacctgtggtatgatgagagcataagtatcatatgaaatgatatgaagtatgtggaagatggacggggaagaatatggaagcaaaaatcactttagaaccttttgaacgtatcttaagcggttaccgcaaagtagaagagttagcagtgaacgtaactgattgttcaaaattagcgcaaaaatacgcaagattcggcgttgaaggctatcgattaggaaactatgtcggtacagggtatctgaaccgttatttagagtgtatggtggaccgcgcaccaatgctgatttatagacaaaaatatttgattccgctgctttttcgtcgttctgattcagcctttcggttatttgaagaagagtatcggatggaggctttctttctactattggagtggagcttaaagcatcatcctgaaaaaattctcatcgaaagaaatgagaagatagatacgaaaaaaaataaagtggtcgatagtgcatacctagcatttcgtgtatcagaaattttggattgtgggggttatccaatcagcaatttccaatcaatcgatcagttcattgaatggaaccgaatttaccgattgatcgataatggcggtattggacgtcatagcaaggtatttgacccagaatatccagaaaacatggaagaactgaaaatgattatttcgcttgtcaaattaaaatatcctgaaacagatttggatttatatatagaataaatgaccttaaatgatgaaattactttttctgcaattattgctgtaactaaaaagacaactgctaacattgacgatagcagttgtctttttagttacaatacttttttctcataagatgaaatatccatattgtttaacaaaggactttcattattggaggtaaaaagtgtcaattcatgcatcgcacgtgtacacatggtgtaaaggatcaatttgtcttgctgagaagaaaaatgatctgcatctacatcccacaagaaaactcggtcaaactccagaccttttgctaaaaaggctggaagtaaaataatggaacgcttcataaaatcactctcatttaaaatcagctggacttgttgtttcaactcgtctggcagttgagcataaagagtctcgcattcttcttgggttttagcaatgattgctgtacgccaataccgggcttttccctgagtcgttcgaatggtatctgctaaccaattcagtttgacatcatcagttgttccttggatgagcaaaggcaaatcgccttttcttgctgtagtctctacttgatgttcttttgcaataaagtgattagcaaaatcagtgatttcttttgtggagcgatagcttgtcgttaattggaaacgggtaacttcacggtccacgaaaagttcttccaatgatcccacaatcgtttcatttccaaagacattttgatttagatctccacagaaagtcaaatttgcttttgggaacaaggcttgcaacaatgccacttgtgatggtgcgaaatcctgcatttcatcaataaagatatagcgagctttgtgtgtgaccgtcaccggatacgttcggcgcattagtaaaaagaataggacagcatcctcttggggcaactctctttgacgcaaatgtgtacgaatagttgctaaatgttcttgccatctggtctcgctgattttatgtcgtgtcagaagagaaagtggcacagtttgtaaaaagtggagatattgtttcgttatattgacaaattgataattcatgattcctcgatgaattcgacggaatcgtttacgtacgatttggttagccagttttttacgtaaggaacgctccttttgttctgtatattcaagattaggatctgttgcgtatagttcttggagctgctcttccgcgagatctttgacccattgctgacgtgtttcatctttttgcagaccgcctaattttttcagtagtttcgtttgtaacagagagagtctgtggtgcaagggaagttgttcatttgtttctttataccattggcgaatcgattccctcgataggatcgtacgaccatttattttcatatcacggaacaagggaccgtagcttgtgatgctttggatatagcgatcaatctgatccactaaggtcaatccgcttttcatctcttgtatcggatctttttcgcctagcaaaaaaccactttcctgttgctgttcgtctaataaagaaaactctggcaacagctgtgaaatataatttttgaatgtttgtgtaggcacaccgctttcacctaatgaaggcaatacagtcgagatataatcagaaaacaaatggtttggtgaaaatagaagcacgttttctgcctctagccatttgcgattatgatacaacagaaaagcaatacgttgaagcagagcagacgtttttccgcttccggcgattccttcaatcagcatcactttacttgttgtgtcccgaatgattgcattttgtgctttttgtatcgtagagacgatatttttcatatggttgcttgatgcttcgtccaatatctctagcaaaaagtcatcgttgattacttccgacgtatctaccatagataaaatacgtccttcttggattttaaattgtcgtttcaactgcagatcgacatctattctatctgtttcagtttcataaaatgcgggaccaatctcaccttcataataaaggttggcaattggtgcgcgccagtcaataacaattgtttcttctgctagatctcttaaagaagcgatacctagatacaatgtttctgtttcacggtcttctttaaaatcgatacgggcaaagtaaggactgtctttcataacagacaacgtttgtaggcgtttttgctgcgcctcaagagtatgatattttaaaagcaattcttgctcatgttgacgatattcaacagcagattcataaaaagcttcattggaaccagctcgaatcttgtgattagctgtgtcttttgtcgaatgattcatttcttgagtcaattctcgttgttttgtatccagcatattttgttcgatctggattagttcgatcgtttcatccacgtgcgtttgttctagttgtttctcattcatcacatgtttgctccttccgccgtaaataacgaattaaaagtatagcacagtttttcgaaaaaaggtactttttaacggatgaatcgaaaaaagtcctctttgctcgatagattcgtttgtcggactggcgactattggaaacgctgatagtgatagttgttttcaattaaggcctattgttttaaaaagtgttaagcaagtactatgcttaagagaaagagaggcaattgaagatgactaacctctaagtcacaaaaaagaggagaagaaactatgacacatttaaaaaaatttttacttactttatttattggcggagtagctttgttaagtgaatttgttttccatcagccgggacttgcttttatgagtgttgcatttactggagggattctcgccttcgtgatgtttttggaaatgatcaaaacattgcgttcaggaagatatggtgtagatatattagcgattaccgcaatccttgcaacattagccgtcaaagaatattgggctagtttgatgatattgatcatgcttacaggcggagatagtctagaagattacgcgaataaacgagcaggtaaagaattgcaatctttattagacaacaccccaagaatcgcccatcgattcaaagaaggaagatggcaggatatagtaattgatgaaataaatgtggatgatcagctgctagtcaagcctggcgagcttgtaccagttgatggtcgagtgatcaaaggagaatcatcagtcgatgaatcttctttgacaggagagtctcgtccagaaacaaagaaacctggagatcagatcatgtctgggtctttaaatggagacggatcaatccaaatgattgctgaaaaacgcgctgcagatagccaatatcaaatgatcattaaattagtcgaagaatcaaaagaaaaacctgcccgattcgtccgtttagctgatcgttatgcggttccctttacattgatcgcatatttgattggcggtatttcttggtggttctcaaaagatcctttgcgttttgcagaagtattggtcgtagcatcgccttgtccattgattttagctgcgccgatcgctttagttgctgggatgagccgttcaagtaaaaacgggattgttgttaaaactggaacaacgattgaaaagctcgcacgtacaaaaacgattgcttttgataaaacaggaacgcttaccaaaggaatattagaagtagaggcgattcaaccagtcaatggaatgaaaaaagaagagctacttatgtatgcagcaagtgcagaacaggaatctagccatatcttagctcgttcgttagtgaacaacgtgaaaaacagccaactgtatcctgttagtcaactgaaagaagtgacaggtcaaggaatccaagcagtagtcaataatcatgacgtaaagattggacgcgcttcttttgtttcagtggaagaaatcgagacttctgaaacagcaatctatgtagccattgatcaatcctttgcaggaaccatcctattttcggatcagattcgctcagaagcagcaaggacaatcaaagagctaagaaatcttggtgtgaaaaatttgatgatgattaccggagatggatcagccattgctcaagcgattgcagaggaagtcaaattagattctgtacatgctcattgcttgcctcaagataaactgaccattttagaacgtatccctaaagatcaacgacctgtggcgatgataggagacggtgtgaatgacgcaccagcacttgctgctgcagatatcggcattgcaatgggcgctcatggttctacagctgctagtgaaagtgcagatgcggtcatcttgaaagatgatcttttgcgtgtagcaaaagcagtagtgatctcaaaagatacgatgagaatagcgaaacaatctgtactgattggcatctttatttgtatttttttgatgttaatagcaagtacgggtctggttcctgcgttattcggggctgttttgcaagaagtcgtggatacggtctctatcctgagtgcgctgagagcaaaaaaagacccagccatttttccggattcagtacccaagacaaacatagtatgatagaatcgagatgaaaaaagaacgatcagaaagaggagagaacattatgccattcgtacatgtcgaattagtagaaggtcgcagtccggaacaattagaaaatatgatgaaagatatcacggaagctgttcataaaaacacgcaagcaccaaaagaacacatccatgttatcatcaacgagatgaaaaaaggaacatacggtgtaaatggggaatggaaaaaataagtttggtttcacacttgatttttctatttattagtggttaaataaacacataattgattgatgagaaagccaactgaatttgagagtcttcgataagagaggaaaagctaggctgaaacttttccaggagaaaaccaaaggatgaccactttcgaaacccttgttgaagcaagggcggtcggaccgttacaacgtttgaggaacgcatgtgcgtttgaacattaggtggaaccacgaacttttcgtcctagtatctcttttcaagagatgctaggattttttgtttttcagcttgatgatctgatcaatcaaaacatttcaaggaggaaactattatgataaaaattacttttccagatggtgcagtcaaagaatttgaggctggtacaacaacattggcaatcgctgaaagtatttcaaaaagcttagcaaaaaaagctttagctggtaaagtgaacggcaaacttattgatttgactcgtccaatcgaggaagatgcaagtattgagatcgtcacatcagaccatgaagatgcacttggattagtccgacattcagcagctcatttgatggctcaagcaatgcgccgcctctatccaaatatccactttggtgttgggccagctattgattcagggttttactatgatacagacaatggacaaaatcaagtaactgcagaagatcttcccgcaatcgaagcagagatgatgaaaatcgtcaaagaaaatctgccaatcgaacgccgtgttctttcgaaacaagaagcattagaaatttttgcaagtgacccatacaaagtagaactgattagtgaattgccagaagaagaagtgattactgcctatcaacaaggtgaattcatcgatttgtgccgtggcccacatgttccgtctactggtcgtatacaagtattcaaattattatcagtggcaggtgcttactggcgtggaaactcaaacaatcaaatgatgcaacgagtttacggaacagccttttttgataaaaaagctttgaaagaatatatccgtctgcgtgaagaagcaaaagaaagagatcatcgtaaactagggaaagaacttgacttgtttatggtttctccagaagttggttctggtttgccattctggcttccaaaaggggcaacaatccgacgcacgatcgaacgttatatcgtagacaaagaagttagtctaggttaccaacatgtgtatacaccgatcatgggagatgttgagttgtacaaaacatctggacactgggatcattatcaagaagacatgttcccgccaatggatatgggagatggcgaaatgcttgttcttcgtccaatgaactgccctcatcacatgatggtctacaaaaacgccatccattcttaccgtgaattaccaattcgtatcgctgaattaggaatgatgcaccgttatgaaaaatcaggtgctttgtcaggtttacaacgtgtacgagaaatgacgttgaacgatggtcatacatttgttcgtcctgaccaaatcaaagatgaatttaagcgtacgcttgaattgatggtcgcggtatatgctgacttcaatattacagattatcgtttccgcttaagctaccgcgatccaaacaatacagataaatattttgatgatgatgcaatgtgggaaaaagcccaagcaatgctgaaagctgctatggatgaattagagctagattactttgaagcagaaggggaagcagccttttacggaccaaaattagatgtccaagtcaaaacagcacttgggacagaagaaacattgtcaactatacaattagacttcttattgccggaacgctttgatttgacatatgttggagaagatggagaaaatacgcatcgtccagtggttatccaccgcggaatcgtttctacgatggaacgttttgtcgcctatttgacagaagtatacaaaggcgcttttccaacatggctagcaccaatacaagcgacaatcatccctgtttctgttgatgcacatggcgattatgcttatgaaatcaaagaacgcttgcaaatgaaaggtttacgtgtagaagtcgatgaccgcaatgaaaaaatgggctataagattcgtgcctctcaaacacaaaaaattccttaccaattagttgtcggtgataaagaattggaagatgcaacagtgaatgtacgtcgttacggaagcaaagaaacagctgtagaagatttgaatatctttattgatgctatggaagcagaagtcaaaaattacagcagagaaaacaaatagataaatcatctataaaaaagcactaaataaaaaaacaatccaaataatagagaacggatattccacaatcccacagatggacaatagaatttgcgggattgatggaatgagctatcctattgtgcggattgtttttttgtttttttatccagtacacgaccgttaacaaggaactgatatggtatacttacatagacgattattaaaaggatggaggaacttatgagcgtaattagtcgtattgaaagtatgatggaagattattcttcagcagaaaaaaagttggccaactacattattggaaatattgagaaggtccccacaatgacagctaatgaattagcggaggcttcaggtttgagtgcgccgacagttgtacgtttttcaaaaaaaatcgggtttcaaagtttgacggacttcaaaatcacgatttcaacagaattacagactggaatcgatgaaggatttagcgatatcgaagcaaatgagtccttttactctatcaaaaacaaacttgggaacaatgcgcaagtagcgataaaagaaacagtagatattctggaagaagaaacgatccaaaaagtcgtagaatgtttggaaacggctgagtctgtttttttatatggtgtgggtgcctcttctttagtggtagaagacattctgcaaaaatggtctcgtgtcggtaagcccatcatttttgaaaaagatatccatgtcttgctcccacaacttgtcagcaatgagaagaagaaagtactttggcttgtttcgaactcagggagaagcgcagatgtagttgcattagctgagctagcaaaaaatatgaatatcgagatcattgcgttgacgcaatttggaaataacccacttagcaagatagccgatgtactcgtacaaacatcaagaccaaaagaaatcaccaatcgaagtgcggcaaccaattcacttttggcccaattcgctacgattgatatcattttttatttttatatggctaaaaacgaatcacttagtgaaaaagtgaaaaaaacaagagaagcaattcaagactattttatggattcaaaataaaaaaactaaatttaccttactatttttgatataagtttttttagaataacaacttatagttttccacaaagaaatgttctattaaagtgtttcacgactttagaaagcataattttcaaaaataagtttagtttttaatgaaaaaaatagttggatatgcaacttcagaggtttgctgtgaaacaaaaagttgattttatcttgaaattaggtaaagaatttcttgctccgctcattttttcttttttattaagaagtttttgggtacaatgaagcatgaatgtaaataggcggaaggataggaaatgatgaaagattttatgaaaaaaatagtaaatacttcttggatagaaaaaataagaaaaggggcacaagagcctaaaaacaaaacgtttcgccggtcgcatgttccttttcgcttaaattttctttttttcattatatttacgttatttgttgcgttgattgctcgattgggctatttgcagatcgtgaatggtgaagagatggaagcgcgagtgaaatctacttctacgattacagtccaagaaagtacccctcgtggaatgatctacgattccacaggaaaagcgttagtcacaaataaagcgaatcaggcaatcacctatacgaggggcacacaagtgacggctaaagacctacttgaaatcgcaacgaagctgaactcgctgattgatgtgccggcagatgaaaatctgacagatagagataaaaaagatttttggctggctgatccggaacatttgaaggaagtcacaaaaagactttcggcaaaagaaaagcaattaggaaacagcgaacaatacagcgcgatggtcaataaagtaacagatgatgagatcaacttaaacgaggaacaattaaagatcgctaccatctttaaacggatgaacagtgcatatgaattaaacacggtctatatcaagaactctggtgttactgaccaagaattagctgttgtggcggaacgtgcttctgagcttccaggagtttcgacaggcacagactggacacgcgaatataacgcagcagattcactgaaaagtattttaggtagtgtgacgactgaaaaacaaggacttccggcagatgaagcagagaagtatttagcaaaaggttattctcgaaatgatcgtgtgggacaaagttatttggaaaaacaatatgaagatgtcctacaaggaactaaaacccaatatgaagtttctcttgataatgaaggcaatgtttcgaatcaaaaagaaatcttctctggggaaaaaggttctaatttaatgttatcgatgaatgcagaattccaatcaaaagtagaagaaatcttaaaaagaaattatcaaacattgatcaataatggtaaagcacagtactcgcctggtgcttatgcagtagccatgaatcctcagacaggagaagtgttagccatgactggtttcagtcatgagcaaggttccaaggaaatcaccgagaatgctttgggtacgatcactagcgcctttgctccagggtctgtagtcaaggctggtactttgacagcaggttgggcaagtaacgcgatcagcgggaatcaagtgttgattgatgaaccgattcgtctacaaggtgcttcagaaaaaagctctgtctttaaccgaaacggacaagttgctcttgatgcagtcaaagcattggaattgtcttccaatacgtatatgatcaaagtggcattaaagatgctaggactagactatactcctggaatgggactacctagtttagacgaagaagctaaagcttatcaacaattgagagactctttcaaagaatttggtcttggtacaacgactgggattgatttgccgaatgaatctcctgggatttcacgctctgttgagtatatgaagaagttcaatgcggataatggcaaagaatggtatactcctggtaactttaccgatttggcatttggacagtttgacacatatacaccgatccaattagctcaatatgcttcaacagtcgctaatggcgggaaacgagtacagcctcacctagtcaaagcaatctatggcaatgacgaaaatgggaatttaggtgaagtgaaaaaagaaattggcacgacagtagaaaatacggtcaatatatctgcagaaaatatggcaatcctccgtgaaggattccatcaggttgttcatggtaccgacccttacacaacagctaaaccattagccagtgcgaaaatggacctttctgcaaaaacagggactgcagaaacggttgcggaaggtcacccagatattacgacagtcaatagtaatatcgtggcatatggaccaacagacaatccggaaatcgcaatcagtgtggtcttgccgaacttattagatgaacaagaccacatgaacttgacgattgctaaagaaataatggacgcgtattatgatatgttcatggcaaaataaaaaagaggtcgtgaaaaagccacttagtttcgagtatgaagaaaaattttgtgaaaatagcttctcatatttttgcttaaatttgacttcataccgagaaactggcttttgaacactatttatcaagagggtgtgaaatcagcaccctgatctgagtattagagaaacaaaatgggaaaatagattttcatattttgctgtttttgagctaataccgaaggacagctgattgagcaccgtttactcggcaaaaaaggttgtgacaaaaattgtcacaaccttttttagtggaatctaattctctattgtagtttaagtaatttttccagataaacagctaaaccgtcttcttgattgctcaaaggagtgacatcatttgcgatgcctttgagctgatcagtaccattagccatagccactccccagcctgcataatccagcagctccaaatcgttatgctcatcaccaaaagcaatcacgtcttgttgatcaatagataggtagttagcaatctcttgcacaccttttgctttttgtattccttttgaaacaatctctaagatcgccgtaggaccgccccacgtacgaacatccacataactgccaaattgacgtgttaattcagcagatacagcttctgcaaaacgcttgtctgttcggacaagcaaagatgtaggatttgtcgtcagatttttaggagaaagcaagtttttttctccaggacgtgaagaagcaaaaattttttcatcaaagaagtcaaagctgtcgataaaaaaagtatcccgattttcagcagcgataaagtctaaattcaattgttttttttgcgataagatttcaaaagcaatttcacgattaatcaatgtttctctttcgccatcccaatgttgattagggatatgcaccagtgcgccgttaaaattaaccatcggtgttgttaactctaattgttggtaaaattgacggctcattcgaaatgggcgtccagtagcgatactgacatgatgaccagcattgattgcttttttcagggtttcttttgttttagaggtaatcatcgaatcttgattgagggtggttccgtccagatcgatggcaattaattttttattcaataaaggtccttccttcctcaactagcatttgttttagtctagcatattttagttaattaacaagaggaatcagttattcctaacaaaaaatacagttatggctatgtaaataaatgaatacgagctaaacacgaacattaagtattgttttcggtttttttgttaaaaaaacgttgaaaaacgaataaaacgtctatataatttgaaattgttcgatggatttgccatattttgcatattttttattattatagttttccatcagaaaaaaattcagggagtggaactttttatggaaaagtttttcggtttaaagaaaaacaatacaaatgtatcaactgaaataatggcgggagtaacgacattctttgccatgagctatatcttattcgtaaatccgacgattttatcagcatcaggtatgccgttccaagcagtatttctagccacaatcattgcatcaatcattggtacgctagtcatgggattgttcgcgaatgtaccatatgctcaggcacctggtatgggattgaacgcatttttcacttttacggtcgtttttgggcttggctattcttggcaacaagccttggcaatggtttttatttgcggattaatcaatatttttattactgttacaaatatccgaaagatgatcattcgggcgattcctgaaagtcttcaacatgcgattggtggcgggatcggtattttcgttgcgtatgtcgggatcaaaaatgcaggatttttatctttttcagcagaccaatctgctatttcgagttctgtcgttgaaggtggaaaagcaacaaatgttacgataaatggcggaatcgttcccgcgttagccaactttgacaacgcacctatcttgttagctgtgattggtttggtgctgacagccattttagttgtaaaaaacgtccgtggtgctattcttatcggtatcgtagcgaccacagtccttgggatttttatgggtgttgttgatttaagttccattgattggcaaacgaattcgttaggcaattcatttaaagaattaggaacaacgttcggtgcagcatttggttctgaaggaatgcaatctttattcagtgattcttccaagatccctcaagtattgatgacgatcatcgcattcagtttatctgatacatttgatacgatcggaacatttatcggtacaggacgccgcacaggtattttctcaaaagaggacgagatcgcattggaagatggccgcgggttcaaaacaaaaatggataaagcgctatttgccgatgcaatcgctacttccgtaggtgctgtctttggtacatcaaatacaacaacttatgtcgaatctgcagctggaatcggggccggcggacgtactggtttgacttcagtagtagtggcagtgctattcgcattaagtagtctgttctccccgctgatcgccattgtaccaaatcaagcaactgcgccagcactgattttggtcggagtaatgatgatggcttctttcgcagacatcaaatggctagatatggaagaagctttaccagccttctttgcatcgatctttatgggattgtgctatagcatttcttatgggattgcagcaggatttattttctatacaattgtcaaagtaatcaaaggaaaattcaatgaagtttctgttgctttgtggattgttgatattttattcatcatcaacttcatcattctagcaacgatttaaataaagagaagggattggaacagcattttttccggtctctttttttttacataaaaagaacgttacatataaaataatctttgcgggatttttctctttttactggcgagatcgttgcttgtttattcgaaaataggtatgataaaagagacgaaagagggatgatagatgaagattaattggagaaaaaatttagtgattgcatggattggctgttttttcactggtgcaagtattagtttagttatgccattcataccagtttatgttgagcaactaggaacaccaaaagatcaaatcgaattgttttcgggactagcaatctctgttactgcttttgcatctgccgtggttgcaccaatctggggaaatctagctgatcgaaaaggtcgaaaactcatgatgatccgtgcagcagctgggatgacgttgacgatgggttctttagcttttgtgccgaacgcgtattggcttttgatcatgcgtttttggaacgggattttgtctgggtatattccaaatgcaacagcaatgattgcttcacaagcgcctagagaaaagagcggatgggcattaggaacattatccaccggagcgattgcgggaaatctgatcggaccttctatgggcggtgcattggctcagtggtttggtatggaaaatgtattcttgatcacaggggctttgttgatgatcacaacggtgttgaccatcttcttagtcaaagaagatttccatccaatcgagaaaaaagatctgataagcaccaaagaaattttttcaaaaatggatcatctctctattttgattggtctcttcatcacgaccttgattttacagatagggatcactacgatcagccctattttgaccttatatattcgtgaattgagcggaaatacagaaaatatcctgtttgtcagcggcttgattgtttcgatagctggtgtttccgcagtcttttcttcaccaaaactaggaaaactaggggataagattgggaatcaaaaagttttaattggcggactcatcttatcattttgctgttatttgcccatggcgtttgtcacgacaccactccaattaggtatacttcgttttattttaggtttttcaactggtgctttgatgccttctgtcaatacactgatcagtaaaatcacgccacaagaaggggttagccgaatctatagctataatcagatgttcagtaactttggacaggttctaggacccatgttggggtcgacagttgcgcatgcttataattacagtgctgtttttattgtgacaagtttattcgtcctgtcaaatattcttctttctctattcaattttcgtaaagttcttcgcagtagattataatagtggtgaaaattggaaataaaaaagagcttgagatatctcaagctcttggctggttttttacgaatgggcagaggtttcttttcttggcgcaactgcaccaatcaaaaggataatgacacccgcaattaatgaaatgattgttgtcaaagtaaaatcatatgttccgcttgttaatgcagcaccaatataaccgactacttgacctagaacgacagcccagaataatgtaacgatatatcgcataaagaacacctcttttctatcttaattttaccagattttctttgaatgtaaagaaacgagactaaatctcaataaaattcgagttcttgtgaaagaactcatttctacagactagaagcaagcaaatgaagcagaacaattaacttcagcacttgttatttaatgaaagtaaaaggatcataccttttaacgctagtgaattttaacgaaaaaaaaaggcggaatgcaagatgtttttcccacaactttatacaattacttcttattctcttttacaaagtacgatccgtattcgagaatatgtacaagaagcaaaaaaacaaggctacacttcattagccataacggataaagatgtcttatacggtgcacctgaattctatcgtatttgtgtagaagaagaaatacagccaatcattggattacatcttagttatacttatgaagaaaaaaattatggtttgcttgcgtacgcaaaagatgagacaggttatcagcaactgatgaaactttccagtcgaaaaatgatccaagaaaaaatggcacttgatgatatgatagaaaccgaccatctagtgtttgtcgttccggcaactcattctgtttctgaggctttcaataaagaggaacattttttcagtcattggcagtttttgcttgaaaatgtttttactaaagatttttatatcggcttgtcagaaaacacgcctaatcaattgcctgaatggtatcagtatgtgacaaaagaaaattatccgctttgtgcattgcatccaatcgctagtttacagcaagaagacctttttgcgcttgaagtgatgaagcatatcaaagagggaagtcagatgcctttagaaagtttatctgcacctttaccatcagcaaatggttacctgatttcagaacaagaaatgatcaaacgattcgaagaagcaggtctttcacaagctgtaataggtgctcagcgcttagctgaatcgatttcatttgaatttcagtttcatcagaaatcactcccgcattatcccgtccctcagggaaaacaagctggagaatatttaagagagctatgctactcgcaagtagaacatcggatcgttgattatacaaaggagtaccgagaacgtttggactatgagttatctgtcatccatcaaatgggattcgatgattatttcctgatcgtatgggatgtaatggcttttgctcatagaaataaaatcgttaccggtgcaggccgtggttctgctgctggttcattagtagcctatgtgttagaaatcacagatgtggatccattagagtatgacttgctattcgaacgatttttaaatcctgaacgttttacgatgccagatattgatttggatattcctgacaatcgacgtgaggaagtattgaattatgttcgagaaaagtatggacaatatcacatggcgcaaatcgcgacatttggtacaatggctgcaaaaatggttcttagagatgcagctagagtgtttggtctgtcacaaagtgaagcaaaccgctggtcaaaagcaataccaaaccaactgaaaatcacattgacccaagcttacaaaacatcgcgtcaactagtagaattagttcaggcaagcgaaaaaaaccaacttttattcaaaaccgcagtgattttagaaggattgccaagacacgtttcgactcacgcagcaggggtagttatcagcgataggaatctacttgaattagtaccgctccaacgcggttctgatgaagcttttctgacccagtatacgatgaatgaggtagaagccatcggtcttttgaaaatggactttctaggactacgtaacttatcgattattgattttactttaaaggctgttaagcgagtagaagggcaggaaatccgattaaaagagattccattaaatgatgcaaaaacgctactcttgtttcaacgaggcgaaacctcaggagtatttcaatttgaatccgctggtattcgaaacgttttacgaagattaggaccagaaaacatcgaagatattgccgcagtcaatgcgttgtatcgtccaggtcctatgcaaaatatcgatactttcattgccagaaaaaaaggaaaagaagccattcgctaccccgatgattcactgatcccgattttgaaaaacacatacggggtgattgtctatcaggaacaaatcatgcagattgcctcgactatggctggatttacattaggacagtcagatattttgaggcgggcagttagtaaaaagaaaaaagacgtattagatgaagaaaagtcgcattttgtatcaggagcattacaacaaggatattcggaaaaaacagcagtgactgtatatgaatatattgaaaaatttgcaaactatggattcaatcggtcgcatgcatttgcttattccttcgtgggattccaaatggcatatctaaaggctcatcatccaggagctttctttaccagtctaatgaattctgttcggcataacacaacgaaattgaaagaatatattgcagaagcacgtaaaaataaactcaaactttcttcaccatccatcaatcaaagcaattatagttttgagttggtcaataaggaagaaatcagattcgggctgacagcgataaaaggcatccgacgtgattttgtagaagatgtattgaaagaaagaaaacaaaatggcccgttcaagtcagtagatcaattcctcatacggatcgataagcggtggctgaaattagagttactgcaatcactgacagcagtaggtgtttttgatgaattatctcctaacaggaaacagttgatgcttgatctcgaaggaaaaatccaaaatatcgtttacagcggtggcagtctagatttgctaggaatcatggcattaaaagaagaagaagttgctgactatacactagaagaacgactgaagctggaagaggaatacttaggtgtttatttgtcaggacatcctgcagaagggtttgaccgacttcgtttagctaaacaggttcagctgattacagatatcgttcctaatcaaccagtcaatttactattgatgataaaggaagttagagagattcggacaaaaaaaggcgaactgatggccttcgtggaaggaaccgatagtagcggagaaatttctgtcacggtttttccaactctttatcgaaaatatcgtaacctgtttgcagttgatcaagtgatttttgttcaagggcgtagcgaaatcagcaaatataaccaggaactacaattgattggagaaagctttgctgatcctcgtcagttagaaacacagtatccttcacaaacgtgctatttgcgtataacagaagaacgggaagaccctgagataatgaaacaattacaagggatttttcagaaacacccaggatatattccagtaattatgtaccacgaaaaaacacaacgaaaagttgttctgtcagatgcttattgggtggatgacagcaagagtataaagggacaacttgtttctctacttggcgaagataatgtggttttcaaataacttacggtaaaaaatactacttgctttcattttttttcatttttttatccgtaaatcaagacaagcgagaaaaataatgttagaatgttagtcgtggttaacgcaaaaatggttgtaaacctaagttatacttaggataaagtattttaatgaggtgaatgtttattatgaaacgcatcggaattttgaccagtggcggagacgcacctggaatgaatgcagctgttcgtgccgttgttcgtaaaggtatttacgaaggactggaagtatacgggatcaattatgggtttgccggtttagttgctggagatattcgtcgtcttgatgtggcagatgtaggtgacaagatccaacgtggtggtacattcttgtattctgcacgttatccagaatttgcaactgaagaaggtcaattaaaaggaatcgaacaattgaaaaaattcgggatcgaaggtctagtggttatcggaggagacggttcttatcatggcgcaatggctttgacaaaacgtggattcccagcagtaggtattcctggaacaatcgataatgatattcctggtactgacttcacaatcggttttgatacagcaatcaatacagtgctagaatcaattgaccgtattcgtgacacagcgacttctcatgttcgtacattcgttatcgaagtaatgggacgcaatgcaggtgacatcgctttatggtcaggtgtagctggcggagcagatgaaatcatcatcccagaacatgattttgatatggcttcagttgctaaaaaaatccaagaaggccgtgatcgtgggaagaaacattgcttgatcatcttggctgaaggtgtaatgggcggaaatgaattcgctgaaaaactttcagaatttggcgactatcatacacgtgtatctatcttgggacacgttgtccgtggtggagcaccaagcgcacgcgaccgcgtcttagcaagtaaattcggtacttacgctgtcgaattgcttcaagaaggaaaaggtggattatgtgtcggtatccatgacaacgaaatcgttgcagctgacatcattgatacactagaaaataacaagcataaaccagacttatcattatatgatctaaataattcactttcattttaagagtgaaagaaaccaagctatttaagctgtgtacagctttaaataaacaaaattgaatgggagagttttttaaatgaaaaaaaccaaaatcgttagtacattaggaccagcaagtaactcagtagaaattatttctcaattgattgaatctggggcaaatgtcttccgctttaacttttctcatggtgaccatgaagaacaattatcacgtatgactatggtccgtgaagcagttaaaaagacaggaaaagatgtcggtattcttttagatacaaaaggagctgaaatccgtacaactgttcaaggcacaacagaagctgattttggtcgtgcaggatacatcaaatttgaagtaggagatcaaacacgcatctctatggatcctgaacatgtaggttcaaaagaaaaaatcgcggttacttacccaggattatttgacgatgttcacgtaggcggacacgttttattcgatgatggcttgatcgacatggaaatcattgaaaaagacgaagcaaaccgtgaattagtcgtagaagttaaaaatgcaggtatgctaggatcacgtaaaggggtaaatgcaccaggcgtttctatcagtttgccaggtattactccaaaagatgctgacgatattcgttttggtttagacaacgatatcgactttatcgctgcaagttttgtacgtaaagcacaagacgttctagatattcgcgaaattttagaagaaaaagacatgactcatgttcaaatcttccctaaaatcgaatctcaagaaggtatcgacaacattgacgaaatcatcaaagtttctgacggtgttatgattgcccgtggagatatgggtgtggaaatcccagctgaactagtaccaatggttcaaaaacgtatcatcaaaaaatgtaacgctgctggtatcccagttatcactgctacacaaatgttagaatcaatgcaagaaaacccacgtccaacacgtgcggaagcttctgacgttgccaatgctgtatttgacggaacagatgcaacaatgttatctggtgaatctgcaaacggagactacccagttgaagctgtttcaacaatggcacgtatcgaccaagaagctgaaaatgcattatcagaattaggtacattccaattgaacgaattcgataaaacagatgtaactgaaacaatcggtttatctgtagctcgtgctgcaaaaaatctaggggtcaaaacaatcgttgctgcaactgaatcaggctacactgcaaaaatgatttcaaaatatcgcccagatgcagatatcttggctgttacttttgacgaacgcacaaaacgtggtttgatgttaaactggggtgtttacccaacagttgctgaaaaaccatcaacaactgatgaaatgtttgaactagcagctaaaaaagctgttgaattaggtttcgcatcagaaggcgatttaatcttgatcactgctggtgtaccagttggcgaacgcggaacaactaacgtgatgaaaattcaaatgattggttctaaattattagaagctcaaggcgttggacaaaaatctgtcgttgcaaatgcagttattgcttcatctgctgaagaagctgtaaaaaaagcaaaagacggaatggttctagttgtaccatcaactgacaaagaatacatgcctgcaatcgaaaaagcagctgctgttatcgttgaagaaggcggattgacttctcacgctgcagttgtaggaattgcacaagatattcctgtaatcgttggtgctaaaggcgcaacaacaacaattactgatggcgaattgattactgttgattcacgtcgcggcatcgtttaccgtggcgaaacaacagctatctaatttagcttaatacaaaataaaaacagctcttcatttacgaagagctgtttttttgtgctgtaacgaattcatggatgacttggactacttgttcttgaagcggtgtgacaagctgttgtgttcgttttgccaatgaaatcaagaagcgaggctgaacttcgtctgaaagtgggaggcaaactaaatgatcttcaggatgtacagcaatctctgtcaaaaaaccgataccaacattttcacggatcatactctttaaaatcgtcaaatcattgctttgataaacaacttttggttgagtgtgtgtttgtttagaaagtttagtgaatgctgctgggtggacataatgttcgttcaataacacaaactgttcatctgatatatctttgaaagagaccgccttctgctgggccagaggatgagtaggcggaacgacgatcatgaaacgtttatccaaaagcaattctgtttctaaatattgatctacgattggctgtgttgagcctaatacggctaaatcgatcctcccttgacggatcattccatataagtcccgagagcctccatcggtgatttcaatctgattcatcaactcatgcttgataaagtaacctgacagttttggaaagtactcattgccgataataggcggcatgccaaaacgcagctttttcttttgtaactgagtgatttcagcccttgcagtagaaatctcttggagaatagtttgtgcatggagaaacagctgctttccagaaggtgtgacgattaattcgtgatgcgaacgatctcttgtgataagtacggcgtcaaactctttttcaagacgttgtaatgcatatgtaatagtaggttggctcacacggaaataattagccactttcgtaaagtttttttgtttgacgatttggacgtagtattcaatatctttcgtgttcataaagatcatccgctcctttgatagaataatgattattgtaaatgattctgaagatgatagcaaacagaggctttctgttaaagatatttctgtttttttatgaactgcaaggtgtcaagaaaatttcattgacaacatggtttttgccctgtataattgcttttgttgcttaggagtgatgaaaaatgaaatggtctttattggaattgagaaaataccaggagacaccgttaacttttcatgagacgctcgacttgaaagccgctctcatgaagcgagacaatttaatacttgatgttgcgccagtggaagtcgaaggtttggtctcagttgataagaaaggctatatcgttcattacactgtgcagacgactttgacagttccttcaacacgttcgctagaacctgttgaactgccgatggatttttctgtagacgaagtattcatgacagaagaacaattccaaagcagagatgagcaaatgtctgcagatgagattttgctgattgaaggtccgttattgaatttagcagagtcaattgaagacaacatcttattggcgattccgatgcgggtattgacgaaagaagaggaagcagcaacagaacttccaaaaggcaatgattgggaagttgtttccgaagaagaataccaacgcagaaaaatggaagaagccgagaataaaattgatcctcgtcttgcaaaactatctgaactttttgattctgaatcaaaaaacgacgataacaagtaagattggaatatattgtatctattataggtgcaagactttacaaggaggtgtagcaaaatggcagtaccagctagaagaacatcaaaagctaaaaaagcaaaacgtcgtacacactacaagttgacaatcaaaggattaaacgaatgtccaaactgtggtgaaatgaaaaaaagccatcacgtatgtgcaaattgtggttactatgatggtaaggacgtaatgtcaaaagaagcttaatacattttaattagaaaatgtaaaacctcaaggctaaccatggagccttgaggtttatttttttataagcggtaaataaaaaatatgttgttctttagtttgcaatgtagccgtgttaagctataatgtaagagattagggagaaatcccgtatgtaggaggagttcatatgtcaaaacaacaaatcggcgttgtcggtatggccgttatgggtaaaaatctagccttgaatatagaaagccgcggctattcagtggctttattcaaccgtacaggggctaaaacaaccgctgtagtagaagaacacccagataaaaatttcaaagcaacgtacacaatcgaagaatttgtagaatcaatcgaaaaaccacgtcggattcttctgatggtcaaagcaggaccggcaacagatgcaacaatccaagagttgcttcctcaccttgataaaggcgatattctgattgacggaggaaatacattctttaaagatacgatgcgtcgtaatgaagaattagccaactcaggtattaactttatcggtacaggcgtttccggcggtgaagaaggagctttaaaaggaccttcaatcatgcctggtggacaaaaagaagcgtatgagctagttgcaccaatcttagagcaaatttctgcaaaagcagaagacggagcaccatgtgttacctatattggcccaaacggagccggacactatgtgaaaatggtacacaacggtattgagtatggagatatgcaactgattgctgaatcttatgacttgatgaagaatattttagacctttcagtagaagaaatggctgatatctttaaagaatggaatcaaggtgaattagacagctacctgatcgaaatcacagctgacatcctgactcgaaaagacgatgaaggcacaggtaaaccagtcgtagatgtgatccttgatgcagctggaaataaaggaacaggtaaatggacaagccaaagtgcgcttgacttaggcgtgccacttccattgattactgaatctgtatttgctcgttacatttctgcttataaagaagaacgcgtacaagcaagtaaaattttgtctcgcacgaacgattttgagttcacaggagacaaaaaagaattggtcgaaaaaatccgagaagcgttgtatttcagtaaaatcatgagttatgctcaaggatttgctcaattacgtgtcgcttcaaaagaatttgattgggatttgccatttggcgaaatcgcaaaaatctggcgcgctggatgtatcatccgagctcgattcttgcaaaaaatcacggatgcttatgacaaaaatcctgagatcgaaaatttattgctagatgattatttcgttgaaatcacgaaaaaatatcagcaatcagtccgagacgtcgttgccttggctgtccaagctggcgtacctgtaccaactttctcatcagccatcgcttacttcgattcatacagagcagaacgtctgcctgcaaatataatccaagcccaacgcgattactttggcgcacacacatatgaacgtgtcgacaaagaaggaatcttccattactcatggtaccatgaagaataatagtctttcggctgttaggaaatgagaaaataaaaagaggacgaaagagctgaagtcaattgttatgagtagacttcagctcttttttaaaactgctattcatgataaaatgactatagatttttaagcagattatcggtataatgatagagtttttaaaaagccagtagatagaaaggataaaataataaatgagtaatattctaatcattgaagatgaaaagaacttagctcgatttgtcgagctagagttgaagcatgaagggtataacgcagaagtccattacaacggtcgtactggtttagatgcggcattaaataatgagtgggatgccatattgttggacctgatgcttccagaattgaacggtttagaagtctgcagacgcgtacgccaagtcaaaaatacaccaatcattatgatgactgcaagagattctgtaattgatcgtgtatctggacttgaccatggagcagatgactacatcgtcaaaccatttgctatcgaagaactattagcgcgtcttcgagcattgttgcgtcgaatcgatattgaaggtgacaaaaatgtggcaaaacaaaccactattacttatcgtgatttgactatcgaaaaagaaaaccgtgtcgtacgtcgcggaaacgaagtaattgaactaacaaaaagagaatacgaattgctacttactttaatggaaaacgtgaacgtggtattagcacgtgatgttttactaaataaagtgtggggatacgaaacggaagttgaaacaaacgtagtggatgtatatattcgttatcttcgcaataaaattgacgttccaggggaggaaagctatatccaaactgtccgcggaacaggttatgtgatgcgctcgtgataaagacgaaaaaatcggaaaaaagagaactgaaagggccctccttgacaatcaagtgggcctttgcgagttctttcttcatattcgtcgtatttacaatttttgcggtcattacctataaatcatctatcaatctgattgttgcaaaagaaagaaacaatgtagaacgtacgatttcagaagtagcctctcgtttggctaactcggatgaagaactgacattagtgaatacgtatcgtaatctgacaaaagcgacaaatgacggagatgaggtcatagatcatacttcactggtcgaaggaaacttaatgaagattgattcctttatagctgagctagggcagccttcgatggatctttatgtgtatgatttagatgagaacttgattttcaaaactcacgaaaacagtcgaaacttgatccaaacaacacgtaaagtgccaacgattgttacactagaagggaaaactggctttttatctatacagcctatatattctaaaggaacaagagaaaagattggttatgcgcaaagcttctatgaattatcttctttctatgatatccgaaataagctattattgactcttattgttttagaagtcgtttctttgattttaagtagtattttaggtttctttttatcttcttacttcttgaaaccactcaaggtactcagagatacaatggatactatacgtaaagatccgcaatcagatatccacatgcctgaaatcgacacgaatgatgaattggcagatttagctgaaatattcaatgagatgcttgaccgcatgcgtttgtatatcgaacaacaagagcagttcgtggaagacgtctctcatgagttaagaactcctgtagcaatcattgaagggcatcttagtctgctaaatcgttgggggaaagatgatcctgaaatattggaagaatcattaagcgccagcatgcaagaaatcagccgcatgaaaagcttagttcaagagatgctagacttatctagagcagaacaagtagatgtccattatgcaaatgaaacaactaaaggaaaagaagtcacctatcaagtttataataatttcaagatattatacccagactatgtgattactttagatgatgatttgacaaaagaagtgaccctgcaaatttatcgtaatcactttgagcaattaatcattatcatattggataacgcagtaaagtattcaactacacgaaaagaagtccatatctctatttcttctactctgaatgaatttgagattgctatacaggactttggtgaagggatacccaaagaagaccttaataagatcttcaatcgtttttatcgtgtggataaagcgagggctagaacgaagggcggaaatggtctgggattgtctatcgcaaaacaattggttgaaaactacaaaggtcgtatcttagcagaaagcgtagttgggcaagggactatctttagaatttttattcctatcgcaaaaacagaagacaagtaaagcatgtgctttgcttgttttttatattatcgattaagaaagaagaagccaaataaaagcagataagaaacttaggatggtcattataaagaaatctagcgaacaataaaatagaataacattcgttggtaaattgtaaatagcttttaggtgaacaaaaaacaataaaaatactttaatattcgtctttaaaaataataaagaaaaataggaaattttctattgcaattttataaagagattgctatattattatttgttctaaatgattcctttaaggtgtcgctaaaaattataaaaaatagtgttgacgcatttttgatatcatgttataataacgaagtcgcttagatgaggaagtttataaagcttgattttatcgaaacaaacttcaaaaaaagttattgacaaataacaaatgaaatggtatgataatcaagtcgctgctaatgagcgataaaggtatttagaaaaaataaacaaaaaaagttgttgacattctcttctggatctgataagattaaagagttgttgaaacaaaaagatggaacatcattcgtcaatgatgttcccctctaatcttagtatgttttttttgtacgaataccgataaactacttttgaatactatagagtaaatcggtcaccacaagatttttatctccttactagtttaaccgcttacaccgaaacgattttatgctgtgaaaaatgaatggaataatctttagaaagaataaaaaaatcttaagataacaacttttttaggaaattttcatttttcaggagcaaaataagaaaaaatgtgaatagagagaagtgatatacgtgacacaacttaaaaaattgtgccaaaatcgtttagcaatcgttttgacagctgttttctttttctggctgaagacgatcattgcctactatgcagatttttcattaggtgtggaaggtacgatccagtactttatcttgtggatcaacccgattgcgactaccttattgttttttggcctttctttgtatattaaaaagccaaagccagcgttagccattcttttgatcattgatattttaaatacgcttttgttgtacttgaatattattttttatcgggaattcacagatttcattacagtcaaatctgtattaggcttttcgaaagtgtcacaagggttgtcaggaagctccttttctttgatgaaaccccatgatgtcatctattggttggatatcgctgtgttcattgggctactggtttggttgaaggtcaagaaaatacctatcaaaagcaaccctgtcagcaaaccgatggctatcgctgttacctgtctttcaggattgattttttcaggaaatttagcgttgagcgaagccaaccgtccccaattgctacagcggacatttgaccgttcctatattgtcaaatatctaggaatcgatgcgtacactatttatgacggaatcaaaacaggaatgactagcagtgttcgcgcgcatgcaagcagtaatggaattgatgaagttttagactatacaaagaaacattatgcagagccaaatcctgaaacatttgggattgctaaaggaaaaaatgtgattgtccttcatttagaaagttttcaacagtttttgatcaatatgaaggtagacggacaagaagtcacgccgtttttaaatagtattttccagaatcaagcaacgatcagttttgacaatttctttcatgaagtaggacagggaaagacaagtgatgctgaaaacatgttggaaactggcacatttggtttacctcaaggctcattattcacagaacttgggtcagataatgtctttcaagcagcaccagcgatccttggtcaaacagaaggctatacaagtgctgttttccatgggaatgtagctagtttctggaatagagatcatgtatataaaaatttagggtatgacaatttctttgatcgatcttattttgatgaatccgatgaaacgttaggttatgggatattagataaagatttattcagagaatctgcccaatatcttgaacatctacaacagccgttttacacgaaatttctttccgtaaccaaccacacgccttattatacggatgacaagaatttcgactttccatctttgaatactggcaatagcacagtagataattatgttcgaacggcccattatctggatcaatcattggaacaattttttacgtatttgaaaaaatctggtatttaccaaaattcaatctttgtgatttacggggatcattttgggatctcgaatacagataataaagatttagcaagtgctcttggtaaagatccagatacatgggatgaatttgacaacgcacagatgcaacgagtgccattgatgatccatatgcctggttacactaaagggacagtcaatcatgaatatggtggagaaatcgatgttttgccgacattactacatctattgggaatcgatgataaagattatcttcattttggtacagacttattatcttctcagcacgatcaagtagttgcttttcgaaatgggaacttcgtgacgcccaaatacaccgtcctaggaggaaaagcttacaataatcagacaggagaaatcatcgatacgaaagcagcaggaatcgacgaggaaatctccaaagatcaggaaaaagtcaagactgcgttaagtctttcagataagctgaatcaggaaaatctcttgcggttttatgtgccaaacggatttgagacgattgatccgaaaaaatatgactataaaaacgaagcggaacgtaatgaagcaatcgaaaagcaaaaaggtgaacattcgaccagtgtcttttcaaaaaacggcaataaaacaacgactatcctatatccagtaacaggaaccaatgcggagcagcaaaaaaatgatcaataaacaatcaaaccaaccttcagggattagacagcagtctcatgcttgaaggttggtattttttatgagaaaaacatttttttatttttttcgtgtattttttatttttaacgtatctatttattgaatgcggaaaatttaaattgaaataatcattcctcttattggcaagcattctggaaaagccaagggttaatttcaattaaaaaaggagaactattatgtatgatggagaattgattaagaagcttcgagtcaacaaaaagctgacacagacccaattagcggaaggaatctgttctaaaacttcgctagtcgggatcgagacaaattcagtgaaaaaagtatcgtttggaacattgaaatcatttttagagcgaatgaacatgacacttgccgaatatgaatggatacgaaatcagcttgatgagccaaaaaaattaaagaaaaaaagacgaatgctagatcggattcaagaagacagctttgatccttacaaagaaattgctaataaccgcaggcactataagaaaacagaagatctgtactatttggttttgaatctgcacatgtccaaaaaaacagaagtatctgagacggaatttgaatttttgcgttatgaatgtcgtatcattgaagaatatttgatgcaagtaccagagtatgggcaatttgaagtatctattctagcagattttccttggatattcagtgatcgttttattgagaataattatttgaaaatcaaaaaaagaatgcgacggatcgcgcaactgaataatcacgagcagtatctctttacttttttgacgaacttgactttgttttatatagaaaatggtcgcttaaaaaaggcacgtagcgtgaatgaagatatgaaacggagtttagcgcataaagaaagaagtacagtgatttatgaaacattgatggcggattattaccaacgactgatttctgctgctttaggggaagaaaaatcggaaaatcaccaagagtttttcgcagtgatcgaatatacattagggaagaatcaaaggaattctttagagaaaaaactgctggccattgctaaacccagcagttagaccaacagtttaggatttgtatcacttcgccgctttttcagacggtttgtttgtatcgaatggcgggaaaaagcgggcgatctcttttgttgcagcatcacgggaatcagaagcatggatgatgttttcagtccccggcagtgcataatctcctcggatcgtacctggaacggcatccgccgcttttgttgctccgaccatcttacggacgatatcgatcacttcctcgccgaccagcacaagataaacgaccggaccagaagtcatgtaatcgataagctcatcaaaaaagctacgttcagtcaagtgctgataatgttcttttgctagttcaggtgtcatcgttgcaaatttcatttcagcaatggccagtccctttgcttcaaaacgttggatgatgcttccgaccaaatggcgtcttacgccgtctggcttgataataacaagtgttcgttccataacagcacctcgtttcctactataattctattatagcgggaggtggaaaatgagacaaataaaactgcgtgagacaggaaatataacgcgtgtattttaaaaaagtatgaaaaacatggaaaattgatttgacatcctcttttttagttgttatattaacgagggaaaaccgaataggatttgttaggtgaggctcctatacaaacataggctactgcccaaaaacgtcgagagacgccaatgggtagaacaggaattgtcgagataaggcttttcataaggtagctaaaagcagatatctgctttttacgttgtacagtgtcaaaactcaacgatgagatctgagaagctttttttgatttgctttttcaaacctttcgctgagtatttggcgagaggtttttttgttgccgcaaatcccataggtgaaaaaacaaaaagggaggtgagcgagttgggaaaataactattcgaaaaatgattggaagtcatgaattaaaattacttagtaaaggagatgagaacaaatggatgacagtcattcgaaaaacaaggatttagaggaaaggccagggctattatctatctgttctcagcccctttcagcattttctctatcgatccgatgaatagcaaaagaccaaaaacagcgagaacagctgtcttttggacacaaaggagagatcgagatggaaaaaaagaaagatacacaaaaaatctatgcagcttttgctggaaaaacgaagcaagaattatttgaattgttccatgcatcaccaaatggattgtcagaagaacaaatcgagcgttcaagagaaacttatggtgaaaatgcgatttcatatggcaaaaaaacaccattcattatagaaatattgaaagcatacatcacaccctttacattagtgttgattgcattaggaattatttcattcattacggaatacgtattagccgctccaggagataaagatctctttggtgtagccattatcttcactatggttatcgtcagtgggacgatgacgttgatccagtctgtgcgttctaatcaagcagctgaaaaactgaaatcacttgtgaaagtaacggcagctgtcaaacgaaatggcgagtatacagagattcctatggaagaaatcgtctgtggagatcttgttcggctttcagcaggagatatgataccagcggatatgcgtttattgtccgcaaaggatctattcatttctcaagcagcattgacaggggaaagctatccagtagaaaagcatgcgaaagtatgtgaagacgatcagcaaagtgaaacaagttatgaaaatcttgtctttatgggaagcaatgtcatcagtggaagcgcggaaggaatcattgtttctgtcggaaatgacacactatttgggcatgtagcagaaacgctatctgaaaaacccatccaatcaagttttgaattaggcatccacaaaacatccatgctgctgatcaaatttatgtcattgatggctccagcagttatcgttatcaatgggcttacaaaaggagattggttagaagcttttctttttggattatctgtggcagttggtttaacgcctgaaatgcttccaatgatcgttacgacgaatttggtcaaaggagcaagtgtgatggccaaaaaaggaacagtcatcaaaaatttaaatgctatccagaattttggtgcgatcgatgtgttatgtacggataaaacgggaacattgacacaagacaaaatcattcttgaatatcatatggattgtgaaggaaatgaagatgatcgtgttttgcgccatgcttatctaaacagctactatcaaacagggctgaaaaatttgttagatgtggctatcattgatgaagcagcagaaactttagatacagatacaatcaattatcaaaaagtagatgaaattccttttgattttgaacgtcgccgtatgagtgttgtagtcgctgatccggctggcaaaacacagatgatcacaaaaggcgcgattgaagaaatgttgaacatttctaaatttattgatcttggtggtactgtcgcaccattaacaaaagaacgaaaagaagcggtgcttgcaaaagtacaatcacttaatgaagacggcttgcgagtgattggtgtcgcacaaaagaccaatccaagcgttgttggagaattttcagtcaaagatgagtcagacatggttctgattggttatcttgctttccttgatccaccaaaagaaacaacaaaacaagcgttgaaagctttaaaagaacatggtgtagctgtaaaagttctgactggggacaatgaattagtcacacggtctgtgtgccgtcaagtaggcctagaaatcaatgaattgattactggtgagaaaatctcggaaatgaatgatcatgaattagcgcaagtagctgaagaacacgaagtattcgtaaaattgaatcctcagcaaaaagcacgattgacgacagctttacgtaaaaatgggcatactgtcggatttttaggagatggtatcaatgatgctccagcaatgaaagtggctgatatcggtatttccgtggatacagctgtggatatcgcaaaagaatcagcagacgtgatccttttagaaaaagatttgacgattttggaaagaggccttctttctggaagagaaacttttggaaacatcatgaaatatatcaaggcaacagcaagttctaattttggcaatatgttttccgtactgattgccagtacgttcttaccatttttaccaatgttgcctttgcaacttctatttttgaatctgatctatgacgtttcttgcatttccttaccatgggatcggatggataaagaatatttggatgagccaaagaaatggaatgcatctagtattggaaaattcatggtttattttggtccaacaagttcgatttttgatatcactacttacttgttgatgtattttgttatttgtcctgctgtagttggtggaagtttccatacattggatagctcacaacaagtgatttttatcgcattattccatgcaggatggtttgtcgaatccctgtggacacaaacattagtactccatgcattgcgtacaccgaaaataccatttatccaaagcaatgcaacatttgccatgctggttatcactacattaggaatcattgtcggttcagtccttccattcacaggatttggtgctgagttaggcttgatgccgctccctggcaattactggttatggttgtttataacagtcgtcgcttatctggcgcttgtgacagctgtgaagaaaatctatatccgtcgattccaagaactcttataagtgatgcggctgggctctatgcttctgttcattttggatcagtcatgctaaactaggtgtattgttttggaaaggattaatgtatagatgaaaggtgcaatatttgatttagatggtttgttagtggatacggaaagaacgtatcgggatggttggctttggggattccagcaatttgatattcatatcccgaaagaaatcgttgacgcttggggcggaaaaaactggaaacaaagttttgatattttagtgcaggcagcaggcagtcctgaaaaagtgcaggaagtccgagcaaagcgtgaagaatatttttatcaacagctgacaagtggagctatccaattgaaaccctatgcaaaagaaatattgacagacttaaaagaacgtcatatgaaactagggattgctacgacaactgttacgaaaagagcaacagatatcttggatcactttcaattagccgattactttgatacgtttacgttcggagatgaagtatcggagaacaagccttcaccagtcccttatctgacagctttggaacgaacaggattagaagctctttcagcttttgcagtggaagattctttagtaggagcgacagccgcttcacgtgcaggactaggcgttgttttgattcccgattccagttttgttcgaaattatagcgtcgaagagaaggaaaaattgaaccttcttgcggaaggaaaagatcttcgaactgttattgaaatgttagataaaaaaacagaaaaataaatatagaaaaaataatttggatttcatgcttgacttttcagttttcctcctgtagattattcccaacaacaaaatattgatttcgttgagaaggaaagtaagcttggaaactttgcagagaggctctggctggtgtgaagagtcaagtaagaaaagctgaaaatggccttggagaataatttgtcgataagtaggcaaattcggaaatgttcgaccgttaaaacgaacgccaatctctctttttgagatgttgggcttgagggaaggaaacttccgaaaaaaggtggtaccacgatacgtcgtccttttactgacatagtttatgttagtaaaaggattttttttttgaatattatttgcattgaaatggtaagtacgatagaagaacctttgacagagagcttcggtagctgagaagaagcaaggaacgactattggaaaatggccatcgagcaattcatcccgagcatagatgtaaggcggtgacggctgcgaccgatatcttgctagagtatgatggtacttgaagaggagttgtgtgtgaacacagcttgaacatgaggtggtaacacgcaaaaaggcgtcctcaagaaaatgactattttcattttcttgaggatgctttttttatagacaaggaggaatgttaatgattgaattgcgagatatttctgtatgtttcaaacaaaaagaaaaagagatacaggcagtagattctgtagatttaacgattgaaaaaggggatgtttatgggatcgtcggttactcaggtgcaggaaagagtacgttagtccgcgtgatgaatttgttgcagaaaccaacagcaggagaagtcatcgtcaatcagacgaatttaagccagctctctccaaaagaattgcgaaaagaaagaaaggccatcggtatgatctttcagcatttcaatctaatggaaagtcgaacgatttttgacaacgtagatttttctctaaagtattctggaaaatcaaaacaggaacgtcgtcaaaaagtgaatgaactactggaacttgtcggtctggaagaaaaagcatctgcgtatcctaaacaactgtcgggggggcaaaaacaacgagtggcaatcgcacgagctctggcaaatgaacctaaagtgttgttatgcgatgaagcaactagtgcacttgatccgaaaacgacccttcagatccttgcactgttaaaaaaactaaatcgtcagctaggtctaacaatcgtcctgatcactcatgagatgcaagttgtcaaagaaatctgcaacaaggtagcggttatggaagcggggaaaatcattgaaaaaggtagcagcatccagattttcagtcatcctgaagaagaattgactaaagattttattcggacagcgacacaccttgaccaagcattggaaacaatcagtgcccatgctgcttttgccgatcagattgcaaataaatggttggtggaattaagttatatcggcaaccagacgaacgaacctctaatcgctcatctttacagcaagtaccaagtaacagcgaatatcttatacggtaatgtagagctattacaagaaacacccttaggaagtttgatcgttactttagctggagaaaccaaacagcggcaaaaagcattggattatttgattaaatctggtgtaaaagtaactattttacaaaaaaatgaattagataaccgtatcaaagtcatcgaaggaggaaactaaaatgactgaattttttaaaacatatttgccgaatgtctatttgattccggatgaattcatcgaagcgacaaagcaaacactatatatgtctttttggacggcattcattggtgggatcatcggaatcatcttaggtgtgacattagtagtgacacgtccaaatggattactagctaacaggctgctgttcgaaatacttgataagttgatcaatatcattcgttccatccctttcattatcttgctttctcttttagctttgactactcgtttcttagttggaacgacgattggtgccaaagcagctttagtccctttgatttttggcgttgtcccgttttttgcccgtcaaatcgagaatgcactgctagaagttgatcctggggtgatcgaagcagcagaagcgatgggcacgagcccaatcggcatcattttacgtgtttatttgttagaagggttacctggtatcattcgggtctcagcgttgacgatcatcaatgtgatcggactgactaccatggctggagcagtaggtgccggaggattagggaatcttgctatatcgagaggatataatcgattccaaacagatgtaacgattgtcgctacattattgattctggtcttagtttttttgagtcaatttatcagtaatcaactgattaaaaaagtcacacattgaaagtggaggagaaaaaatgaaaaaaattattcgttttgcagtcattacatttgtagcaattatttggttggcaggatgcagccaaggaaaagcagctacaactgacaaaaaagaaacgaccgtaaaactagggatcattggggaagatacagatgtatgggacgatgtgaaagaccgtttgaaaaaggaaaacatccatttggaatatgtgaaatttacagattacaatcagccaaatgcggctttagcagatggatcgatcgatttgaattccttccaacatcaattctttttagacaattacaatgaagaacacggaactgatttagtatcgattgggaatacggttaatgcaccgttgggaatttattccaatacgttaaaagatgtggctgatatcaaagatggagcaaaagttgcaatccctaatgatgtcacgaatggcggcagagctcttctgttattgcaaactgctggattgatcaaagtggacaaggcaaaaggccaagcgcctaccgtttctgatattaccgagaataaaaaaaatctagacatttctgagttagatgcttcccaaacagcacgtgctttgtcagatgtagatatttcagtcatcaatagcggtgtagctgtagatgctggatttaatcccgcttctgatgcaatcttcttagaaccagtcgatgagcatgcacgtccttatgtcaatatcatcgttgcaagaaaagaagatgaagacaataaaacgtatcaaaaaatagtagatgcctatcaaacagaagaaacagccaaagtaatcgaaaaaacatcaaaaggttcaagcgtacctgcgtgggaaacattcgggagaaaataagaaaaaacgactagcataggaggaaatttttatgacaaccacactctcaacaaatcaattgaaggatctgattcaataccgtttaccagaatatcaagcacttgcactagctatccacgaccatcctgaagtaagtaattatgaattttattcctcagcagctttaatcaaacaattggaaaaagaagggttctgggtagaaaaagaagtagctgggcaccgaacaggctttgatgcacgttatatttccaataaaccaggtccgacaattgcctttttggcagaatttgatgctttaccaggtattggtcatgcatgcggacataatttatttggtacttactccgtattagcagccagcatagtgaaacaattcattgatgagattggcggagaaattcgtgtgtatggtactccgggggaagaaggaggcgaaaatggatcagctaagggaagcttcgttcgggaaggtttttttgaggatgtcgatgcagcattatgtgtccatccagcttttcgttatgggaaaacgacagaatctttagcaaatgatccagtcgatatcaaattttacggtgtcgcttctcatgcagcagcagcacctgaaaaaggagtaaatgctttggaagccttgatccaagtgtttaacggaatcaacgctctacgcttgcaattgccaaaagatgtcaatatccatggaatcattacagatggaggcgtggcggccaatgtcataccagactacgctgctggacgtttctatttacgtgcaggaaatcgacaaacattagacaaagtatatgaaaaagtggaaaatatcgtacgaggtgctgcattaagcacgggtacgacttttgagtttggattgttccaaaatgcagtcgatgatgtcatcgtaacgccttctttcgatgacttattcttccaacatgcaaaagaagcaggggttcctgatgaagaaatagaaacggaacaaagaacaagtctaggttcttctgatgtaggaaatgttagccaagttattccaacgatacagcctactgtagcaatctctgagacatatattgccggacatacagaagaattcaaagctgctgctaaaagtgaaaaaggacttgcttctattgcgattgcagcggaattacttgccaatacagctctagatttattgagagaacccaagctattagaaaaaatcaaacaagaacatcaagaaatagtagcaagaaaaaaacaagagggcgctactttctagtaaaaagataaagttgtgcgcgaaagttataaaaataattttcagaaaaatgaaaaaatattttctttttcattgacaaatgatcttatggaaggtaaacttcatacaagtcaacttttcacgcagtagtggttaggtgttttgttcagaaagtcggtggtcgctgtgaaccgatcaagcctaattgacgaattacatggaaagtccatacatttgaataatcgtttgaaagtgaaaaacagatctgtttttaattaaggtggtaccgcggagtcattcgtccttagttgaaagcaggtctttttatttttataaaggaggaatcgcggatgaattgtggcggagtaatccgatatcttaacttttttagaacataagaacaactaaaaaaggagagattatcatggaaaaaaaaggaacaccaagttttttagaagcaacacttgtattgatggtcattgttttaggcattgcgattggcgttgtcggattaaaggtttcacctaatatcacgattttggcagctatcggaatggtcatgttgtacgcagtgataaaaaaatacccgacagattggctgcacgaagggatcatcaatggcatcaaaccggggatcattccaatctttatttttattttagtcggttcattgattgctgtatggatacaagcaggaattattccaaccctcatggtcattggatttaaattgattagtgtccagtggttcgtcccttctgtatttgttgtttgtgcaatcgtaggtagcgctgtagggagtgcctttactgttatgtcaacgattgggattgcatttttcggtattgggacaacactaggactaaatccagcccttgttgttggagccattgtttcaggtgccgtttttggagacaagatgtctccattatccgaatcaacaaatttagcagcagctattgttgatgccgatttgttcaaacacatcaagcatatgatgtggtcaactgttccggcatttgttgtttctttctttttattcatgattttaggacacacaagtaaagccgcaagtctttcatctattcgtgaagtgactgatattttagaagcaaactttactatttcgatctggtcactgattcctctatttttaatgctcttgtgtgcatggaaaaaggtaccggcaattttgacgattttgttgaatattgctgtagcagtaggaatgatctttattcaaaacccacaaacttccttaacgaagttggcaggggtcatcgaatcgggatttgtttcaaatactggaaaccaacaaatcgattcactacttagccgtggaggaatcgaaagcatgatgccaactgtgtcattgattattctaacattgtcattaggtggtttgttgatcgaatttgggttgatctcaaccgttatggaacgagtatcaagaaagatgacgaacaccccaaaattgatttttacaacattgatgacaagcatcggagtaaatatctttattggagaacaatttctatctgttatcctgcctggtaatgcatttaaagaaacttacgaaaaagcaggatttgatccaactgtattagggagaacactagaagatggtggaacagtaatcaactacttagtgccttggggaatcgccggaagtttcgtagcaagtacatttggcattcctacactcacttacttgccattcgtgtttttcagtttgctttcacctgtgttttcgatggtcagtgcctttacaggttgggggatctcaaagaaatttgtgaaaccgcaagaagcagtaagcaagacagcgcaattagaacaataaaaacgtaaaaagggagtgtgacaagacttttgtcacactcccttttacgaataaacggtgttcaaaagcttgcatttgcggtaataagcctaaccaaacgaaaaatatgagaagctatttttgtttggctgttcttattacttgatgcagggcagctttttcacaacctctgattcacggtgttccagaagtagcttcttcttatttcttgaagttgatcacttctggaacatcctctttttttatttggatggataatggtcattccatttctttgatcatttttttcattttgtcgatttcttcttcttgtgcctgaatgatttcttccgctaatttttttacttcaggatcttttaaatcagctcgtttacttgtcaagatagcaatagagtgatgagggatcatcgccttcatccacgccgtatcgttgacagttgtttggcttcgtaccataaataaggaaccggcaaaaacaagaagactagcggctaaaatcatagcatttatctttttgttttcatacattttccacatgaacaacaacatgatgactgccatgactgcacccatcatcaacgccatgaatacacgtgtgcgactgaagaagatatgatcaagcgcataaacattcaaatacatcataccaaacatgactaccgtcgaaacaccaatcatcaacaaaaacttccaatactttttcatttaaaacaaactcctttttcttcattcctttcttctatcatgtcatgagcgtggagaacaatcaattaatctgcacagatggtttttgaacaccgtttattcggaaaaaagaactgcaacaatttttgtcgcagctcctttttttcaatagctccagatattcaatataaatagaataaaattctctattggtttcattcattcgtcaagacgaaagcatcattctttttttgataactgaaataaatgaacaggtaaagcaaaccggtcaatacagttaccccaatggagttcgtgaataggataccaaggaaaatcaaccctaagactgctaatgcaaaaaagctgattcctttgtcccataacgttcctttccttagtgtcagtacaaaggacgcagcactgataatgatccagatcaataatactgtataggaaagagaacctgccagatagccaaataatttgtcaccgacaaaataagaaagagccacacctagataaagaacactggtacaaaacagcacagcacgttgcggtacttgatgcttgtttaaaacagctagttttctagaggaacctttccgatctttcaagcggaagaacaaaattctcgaagaagcatatacacctgaattgatagacgagaacagagcaagaacaatcacgaaattgacgatatctgccgcaaatggaatattcattttttcaaataccatcacaaaaggactaacgttcgtgcctgctaaagtattccaaggaaaaataatcaaaagcaaaaataaaggaataatgtaaaaggaaatgattcttcccatgacgcctttgattgctttaggaatcgcacgtttaggatcatctgcttcgcttactgtgatagcaatcaactcagaaccgccgtaagaatagataactacaagcaaagaactgatgattcccttcataccgtggggagtaaaaccaccatgatcagttaattgttgaagggtagggaaaacaccagtacccaacatttgctgaccgacaagataagcagcaaaaatgatcaataggataatgacactgattttagcaaaggccagccaatattctgtctctgcgaataatcgtaccgaataaagattgatgatagtagttaaaacagccaacataaaaacaaatacccaagctgggatgtgggggaaccacaactgtaaaaaggaagcagctgcaacagcttcagcaatgatattgataatccacatggaccagtagacccaatcggtaaaatcggcagcatgagcacctagatatggacgaatcaatccagataatccgtggtgcgtatcaccaccacttaaaacaatttttcccagacctttcatcacgatatataaaattatgccgccaatcaaaaaagcgatcaatacagaagggccggcgattccaatcgcttcgccacttcctttaaatagacctgcaccaatcgctccacctaaagctagcatggtgatatgtcgggagctaagttgttttttcaattttttatcttccataaataacctctttcttttaaattcacaatcaaaatgtatagtaagaataaatagtaagaataaatagtaataataacaatgactaatgataacaaattttcagataattacaactattcagaaaacttttaggcatattttaatggaagaatgatttatttcatcgtattttcatagaaatgttaaatttttataaaaataataggaagcgttttactggctttttactatttaaacaggctatcataggaaaaagtgacagagaaagtgaggaggaacagatgaacaaaaacgacgtattgctaattgcgaaaaataaatcactttatttttttccttccatccgctctttagatgtttggtccggaaaagatttactacagtcggaattcattaaatcagctcgacaacagttggcaaattatcagctgatcgtttttttagattatggatttgatatggagatggctcgacgcgtgcgtccatttaccaatgcaaaaatcgtgttatttttttggaaccactttaaagcagaacacgaggcgatgctgaagcaggcacaagatgaaccggcaatcgatgagatttatcattttgattttttagaagcgaaagaacttggactaaaacataatagttccttttattcgaaacatatggatttttcttctagcgaaccaaagacggatctattttttggtgcaacaaataacggcagaaaagaacgggcagaaaaatataagcaggaatttacaaaaagaggtgttacgaccaattactttattcttccgcttcgaggaaatgaacaacctggataccttacttatgaagaatatctgaaaaaaaccggggaatcgagggggattctagaactgttgcgggaagggcagcaaggagtgactttgcgaacgtttgaatctatgtattttcaaaagaaactagtgacagataatcaagccatagctcattatcagttttatcatcctgaaaatatttttttgcttcaagaacgtgatttagatgaattaccggaatttttgcatacgccatttcaaccaatcccatcagaactgttggaattttttgatgcagaaaattgggcaaaacgttttttcactactgactccgctatttatgaacaatatgaatacgatctttcctctgttaaaaataaataaaagtgccaaccaatcatagatgaaaataaacaagcgcaattcttatggcaacatgagaattgtgtttttctttttgatctttcatgggggtaaaaaaatgagaaccagctgctgatccagctgattctcatcagagagccttttattctgcgccaaggattccttcttttgcatggactaattgggtcaaaaaggcacaatatggtgtagcaatatcatatttttgtccttttcgccaaacggcaccattgatgtagtcgatttcagtcaaacgatggtttttgatcaggtcttggtacatagatgggtaatgcaacccgatgttgtcaggatcataagtagaagcaatatgttggtacacttcttcttgatctaatgtgattccttcttttgctgcgatagaagcaaactcagatacaatcgttcgaaccatgccctctgccgctttttgcgcacctaattcagcaatattacaatccaatatcgtgcataatccatttaatgttccgtttacacaagcttttcgccaaatggaataacgaacattatgactatagattggattcaattttgcttcttgaaagacttctacaactttttttgtaaatgcttcgccttctggttccaagttctctagttcgatttctccatcacctaataatgtgacttttccgggaccagctagaccagctgtccacatcgtgatcccaaataagatatttttctttggtacatatttttccagtacatcttcatgacctaatccattcagtaaacacaaaacataagtattctcagtaataatggattggatcgaacgaaacatatcatctaattgattcgcttttgtcaaggctacgatcaaatccacgtgtttgttgctttcgatgatttcttctggtgaatagattggcagttttgcaactacttctttgccattaaagtcagcaatcaatccatttgtacgaatggcttcaatgtgagcaggccagcgatcgatcaagacgacctcatttccgctttgatgcaacattaatccgattcggctgcccattgctccggctccagctattgcgattttcatgttttttctctcctttattcaatgagttcccttttagtatatagaaaaacagaagaaaatagcattgttttgtttgaaaaaagtgaaaaaaagtgtcttacttaagaagaaagtgagggatatagatggatattttggcggcaatcgattcatttaaaggaagtgcttcttcatttgaattaaatcaggcagttctaaatggttgggaagaccgtaaaggaagaaaaatcaatgtgccgattgcagatggcggagaaaatactgcagaagcaatctattacgcgctcgggggaacctggcgtacgattgatgggatggatctcttatttcgtcagcgaaaaatcagttatttattgacgaactggcaaggaaaaaataccgcagtcattgaatctgcacaagtattaggattagatttacttgataaaccaacggatcaaaccatccgacttgcttctagttatgccttgggagagcttatcaaagatacactgcttcaagaagtggaacaaatcattgtcactttaggaggaagcggatgtagcgatggtggtctaggattactccaatccttgggtgcttctttagaagggtacacagaaggaaatcctttgttatctactagaaaacttcatttggatcgaaggaacgttcttgtttctaaagtaaaagtgatcatcgctgcagacgtgaccaacccatatacaggtcaacaaggagctgcttggcaatttggaagacaaaaaggaggaacggatacgacgttagctttcttggataaacaagctgaaaagattgctcagcagataaaagatgtttgggaggtggatttagatgacatcccaggaagcggagcagcaggcggtattggcggagccctttttttgttaggagcgaagatggtctctggttttgagttggtcagccaaatcactggattagaaaaacagatcgaacaagcggatgtcatcattacaggagaagggcggattgatcagcaaacaatccacggaaaagttccatatggcgtagcagtgcttgcaaaaaaatatcgaaaaccaataatcgctatttgcggaagtagagaccaagagctggaaggactctctgattttctccccattgtcttaagcattcaattaggaccaatcgatttagaggaagcaatggaacacaggcaaacattagaaaaaacagaaatcttaggacagacactcagcagatttttcaacattctcccgaagtagttgacaaaaacaatttctttatgctatcgtaatttcaaatataggacaaagtgagggatccgtgcattgaaaaattaagtcgattgatgaaagctgcattcagactgtaccttgtggagacaagggagcagtgtgcagattttcgggattggcttggttctttcgatgtatgggtctttttgtgtgccccaacccttgcatcctctttagccagttctgaaaataggactggtctttttttacgaggtgatggaataatgtctaaaatcgaaataaaaaatctgacattcggctatgacagccaaggcacattattatttgaacaagccaatctaaactttgacacacaatggaaactaggacttatcggacgaaacggtcgaggaaagacaactttactgaatatcctgcaaaacaaactcccttatcaaggccaagtgatccatcagcaagcgtttgtctatttcccgcagcaaacaaaagataaagagcgtttgacctattatgtgttaaatgagattatggattttgagatatgggaaattgaaagagagctccaactgatgcaaacagatcctgaaatcttatggagagaattcagcacactatcaggaggagagaagacaaaagtcctactggcactcttatttgtggatgacactcatttcccgttaatcgatgaaccaacgaatcatttggatatctctggcagaaaacaagtagcggcttacttgaaaaagaaaaaacaaggattcatcgtggtgagtcatgatcggggatttatcgatgaagtagtggaccatgttttagcaatcgaaaagagccaactggaactttatcaagggaatttctctatctatgaagaacagaaaaaacttcgtgatgaatttgaaatagctaaaaatgaaaaattgaaaaaagaagtcagcaggctaaagaaaacagcagctgaaaaagcagaatggtctcgttcccgagaaggagacaaaacaaagaaaaaagtcggattcatcgatacggaatctaggcgagtgaataaaggagcagtaggcgctgatgctgcacggacgatgaaacgatctaaagcaatcgtgaatcggatggaaacccagatcagtgagaaagaaaaattattaaaagatatcgagtatatcgatgctttgacgatgaatagccaagtgtctcatcataaacggctgttaagcgtagaaaatcttcaattagggtatgaaaatctgttattcgagccagttcattttacgatcgaacctcatcagcgggtggcaatttcaggtcctaacggcgcgggaaagtcatccattatccattatcttctggggacattcaacggcaaggttgtaggagaaaaatcccagcccaaacatttgaccattagttacgtacgccaaaattatgaagacaatcgagggacattggcggaattcgcgaagaaaaaccgagtagactatcaagcatttttgaataatctccgaaagcttgggatggaaagagatgtttttcataataaaatcgaacagatgagtatgggacaacggaaaaaagtggaattggctaaatctttatcccaaccagctgagctctatatatgggatgaaccattgaattatttggatgtcttcaatcaagaacaattagaacaactgattttgaacgtgaaacctgctatgttactagtggaacatgatcaaacctttctagataaagtatctactgagattatttctcttgagaaaatctaaaccttgtaatctcaaagacaacaaggtatggttaaggagaactttgtcaacgaaggagagaatcacatgctttatgtaacgagacacggagaaacaacttggaacgcacaaggattagtttgcgggcgagcagatgtgccgctgactgaaaaaggacagatgcaggcacaggcactagcagaaaaggtagtagatttgcctgttccaatcacgaaaatcatccattcccctcttcaacgagcaagagatacagcacaagcagtagctgatcgtctcaatttgccgatgtccgctgatgagcgattggtagaaatggattttggggattatgacggactgccaagcaaagatgaaaactttcaaaaagcgcgtttagcgtttgctgtacgtttcccaaatggagagtcggtcttagatgtgtacgcacggatcgttcctttattgaaagaatgcatggaagacgaagaaaatgtctacttgttagtctgtcataatgccttgataagagtgatcaatgcttattttcatccaatgcctaatgaagggttctttacattcatggtagacaatacagaattaatttcttatgagtaattagacttttgtgttatttaaataaaatgtttcaaggcactgcttttgcttagcagtgcttttttgtggctgtgtcaattcttttggcattataaatccaatttttagaaataaaatttaattattttaacaaaagtattgaaattttgtttctttagatatatactctagtcatagaaatgaagacggatacagaaaaagagggataatatgtttggcttttcaatatttatgaatgattctttgtcagaagagaagaaacagtatatccgccaaatggcatccaatggctttgtcggtattttcacttccatgcatataccggaagatgatgtttcggcttatcaaaatcgattgatcgaactaggaagcgaagcgaaaaagaataaactagagttgatggtcgatatttcaggagaggcattgaaacgagctggcttttcattagaagatctaacacccttgaaagcaattggtgtaacagggttaagaatggattatcatatttctaatcagcagatcgccgactggtcacatcaattgaaaatcagtttgaatgccagcacgatcacgcctaaagatatagatgagttgaaagaagcagcggctgatttctcacagattgaagcttggcataattattatccacgtcttgaaacagggctggacaaagaatggtatcaggaaaaaaatcaatggctcaaaactcaaggattccttgtacaaggctttgtaccaggagatacagagttgagaggtccactgtatcaaggattaccaactttggaagaacatcgagggatccatcctctggcaggtgctcttgatctattagcaagtaacacggatattgtttatatcggagatgcaggtctgtcagaacacgttcaggagcaatttgcttctttccaaaaagaacagacagtcttgctccatacggaacctgtagatgaagttttttacgaatatatattaggaaaacatacgaatcggcaagatgatgcaagagatgtcatacgaagcgcagatgcgcgttttcgagagattccgccaatcccagtaagaaatacagctaagcgtatgaaaggatctattactttagataacgaaaagtatttgcgctatatgggtgagatccaattaactaaatatgatttgccagcggatgaaaaagtgaatgtagtagccaaagtcatcaaagaagaactaccgctgatcaaccaaatcaaagctggtatgaactatcaatttataagaaaagaaggaagataaaaatgagcaaaatcaatttagagaacctaacaacggaacgcagaaaccaagaaacttttggattagatgaaatgagtatttctcaagcagtccaactcatgaacaaagaagatcagaaagtggccgctgctgttgaaaaagaactgccaagtatcgagccagtgatcgccaacacgattgaatcctttaaaaaaggtggtcgcttgatttatatgggagctggaacgagtggtagacttggtgtattagatgctgctgaatgtgtaccgacattcggtgtagaaccggaaatggtcataggcctaattgctggtggagaagaagcaatgactgtagccgtcgaaggagccgaagattcttatgaattagggcaagaagatctaatcaagctgaatttaacaaaaaatgatatagttattggtatcgcagctagcggtcgtacaccatatgtgattggtggattagattacgcaaaatcgattggtgctgttacaggaacgatttcttgcaataaacaagcagaaatcagcaagcatgcggatttcccaatcgaagtcgatgcaggaccagaatttttgacaggctctactcgattgaagtcaggaacagcacaaaaactgcttttgaatatgatttctactatcagtatgatcggtatcggtaaagtattcaataacttgatggtcgacgtcaaaccaacaaatgaaaaactaattgaacgctcaaaacgaatcatcatgcaagcgacagaagctgactacgaaacagctgaaaagtactttgaggaagcagatcaaaatgtcaaactggctatcgtcatgattttgacaaatagtgataaagaggcagctcaagcaaaattagctgaagcaaacggttttgtaaaaggaaccttatgagggggaaaagaccatggcaaaaaacgaattgactttggaagaactggcaaaacaaatttatcaaggagcaggcggtatgggcaatgttgaaagcattgtccactgcatgactcgtgtacgtatgaaggtcatcaatgatgatcttgtaaatgtctcggaattaaaagcgattccaggagtacttggcgtagtagaggatgaacagctccaagtcatcatcggacctgggaaagtgaacaaagtagcgcaggaaatggttgacttagcaggcgtgaaattaggagaaaaacttccttctgctagtgcaactacagcaagttcttctgcatctggaaaagaccgtgtaaacgaacgggcacaagaaatgaaagcggcacaaaaatcgaaacaaaaaccctctaaaatcaaatcggtattaaaagacatctctaatatctttgtaccaatgatccctgcatttgtcggcactgggatcgtggcagggattgccgcagttttagcaaacttagtcacagctggaacactagacgcaggaacatggcaacaatatatcgatgtgatgaacatcttgaaaaacgggatgtttagctatctagttatctatacaggtatcaatgctgcacaagtttttggtgcaacgccaacgcttggtggagttatcggggctgttgtgatgctgacagggatgaatccagaagcaccactgaaaaacttgtttaccggtgaagctcttgcagctggacaaggcgggatcttaggtgttatcttcgcagtttggttattgtcaatcgttgagaaaaaactgcataaagtagtacctgatgcggtagatatcatcgttacgccaactctttccctgattgccatcggtctgatcgaaattttcttcatcatgcctttagcagggttcatttctgacggcatggtcggtgggatcaactgggtacttggtgttggaggagcatttgccggcttcgttctaggtacattattcttgccaatggtcatgttcggactacatcagatcttgacgccaatccatgtacaaatgattgatgaaactggtcgtaccttattgcttccaatccttgcgatggccggagcaggacaagtgggtgcagcattggcattatggatccgctgcaaaaaagacaaagaattaacagaaatgatcaaaggggctttaccagtcggaatcttaggaatcggcgaaccattgatttacggagtaacattacctctaggacgtccatttattactgcttgtatcggtggaggtatcggtggggcagtgatcggaatgatcggaaatgtcggagcaatcgctattggaccttcaggagccgctttgattccattgatctctgatggtaaatggttaggctatatccttggtttattggctgcttacgctggtggcttcgttgctacattcttcttcggtattcctaaagaccgtttagaaaaagaagaactagcgaccgaaacagccacagtaaatgaagtacctgaaaaagcagtacctcaagcttcagctgaaagtgtgactatcttatcatcagttgctgacggaacagttgtttctttagataaaacaagtgacccagtttttgcacaaaaaatgatgggtgaaggttactttgtagaaccagaaaacggacatatctattccccggttactggagtaataagttctgttttcccaacaaaacatgctatcggcattacgacaccaaatggcttagaaatcttgcttcacatgggcatcaacacagttgacttaggcggtacgccattcgatgtgaaagtaacagaaggacagcaagtgacacctgatacgcttgtagcagaagctgacttagaagcaatcaaagcagcagacaaagaaacctccatgatcgtcttggtaaccaatatggatcgtgtaaaaaactttgtcttggaaaaaacaggtaaagcgaaagcaaaagcacctgtgatggatgtcaaagcttaataagaatagaaacaatagagaacataaaaagaagaagccgaaatttatttttcagcttcttcttttgtgttatttatttttttctgccaaaatttgataaacgcgtgtcacatcagatggtgttccccgtaattcataatctgccaagaaaggaaagccgaatctttgtgcgtattgtttggctgtcagacaatattgattgttgaagtttttattaccgctaccgactacaccaaggcaaagtttatgattgtcttcgtattccagatattcgcgcatcgtttcggtcaagatttctgtgtcaccgttgtctaacccattcccgccgtctaaataagtaggaacgaaagtaaaaaatggttctgtttctttcgtaaaatcactattttcatggatttcttttaaagtaacttcaggattgacaggatcttctgcatgcattttttcagcatattctgctagatgtttggcaaaagcacgcgtatttcctgaaatcgatatatataaaatgttcatggatcatcccccaattctttccctttagtatagcatctttttaagttttttggtggtataatttggaaagggactaggcgctttgcttgtataatgagaaaaaagtcggtagaattatatttctattaaagtttttattaattaagtaaaaataaaaaaggtttgttatactttttgataaaagcggttttactttggaggatgcttacatggatacagagcaacagaaaaaaggaattggtttgattccacttgctgccttagtgattggttcagcgattggaggtggcgtatttggtattatgacggacatctccggatcggctggtggcccagctatcttcagctgggtactcgtaggaacagcaatgttgatgctctccttatcgatcaataatatcaataaaaaacgtccagatttaaaaggcgggatctttagttacgcagaagaaggttttggccgtttcgctggttttatcagcggttggggttactggctcacatgctggttaggaaacgtggcgttcgcaacattgttgatgagtgcattaggttatttcttccccgtattcgaaggtggtcaaaatgtggcatcgatcgtgatgagtacgatcttcttatggggatatgcatggctagtgaatcgtggagttgaaaatgctagctttgtcaatgctatcgtcacattttgtaaattagtgccattatttttatttattgtagtagctatcagcaccttttcgatccaacaattcattaataacttttctagcgatatcatattgaatgcgaatgggcagccgatcccgttttctagtcaagtattgagttgcatcatggtgatgctctgggtattcgttggtattgaaggagcttctgtcgtaggttcacgagcaaaaaaacaatcggatgttgggaaagcaacgattctaggaatattcggtttgatcattatttacgtcttggtttccatgcttccatatggcacaatgacgatgaatcagctgcaaacgatcaaagcgcaacctgctatgggatatgtatttgaaatgatggttggtaaatggggggcggtcgtgatcaacggcggtttgatcatttctttagttggggtttggctctcatggacaatcttgccgattgaaacaatggggaatatggctgaggacggacttttgcctaaagcatggggaaaactcaacaaaaatggggcaccaacttatgctatcgtattgacgacgttatgtacgaatgtctttttactttcattattattcactgacagtgcatataactttgcttatacacttggtacagcagcgattttcttcacgtggcttttcttagggctgtaccaaatgaagctttcttatcagcggaaagagtgggtccaatttttagtagggtttttagcaagtgcttttcaagtatgggccatgctagttgtagcctttaatgaagtgatgcttgttcttgttcttttcttaccaggtatttatttttacctcaaagcacgtaaagaacaaaacgaacctgtacaacatatccacttagataagattttacttatcggtgtgacgatggtcggagtaatcgcaatggttttatttgccactgggatgcttcacgtatagaagtataaagagaggctgtgaagcctgtggtttattcaaaaaagaagcggtgacaacattcgtgtcatcgcttctttttttgaataaatggtgttcaagaagtagcttcttctaaaaataagccgaaatttcttgaaactggccacttctgtcacaacttctttgttaatgaaccatcatacattttttcgcttgaatacgaggtatcccaatgctaagaacaaagcaatgtaagctaaattgccaaacagcatttgattagtagaaagatgagtcaattgcttcataatctcttcgttgccaatttggttttgcagattcagcatactgattggattccatttgatccactcccatttttgaatgagtgcgatgaggataccagatatgattgatgaagcaaaataaaagacgatccctgctgagatggaggcaccggaactattgataaaacaagcaatcatcaacactaaacttaaaattagccataaaccgatataactacccaaagtataagtgaataagctttggatcagtgtctgaccagtagaaatcttctccgtaaaggaaatcgaagggaaaaggatcagtttcatcaacacggtgacaataatagctaaaaggtataaataaatagaataaataactaatgtgatccatttacttactaatatttctcctcgagaatactttcgataaaggagatttttcaatgtaccatattgtgattccattgaaatgatcgtacttgcagcagcaatcatgataaagacaatccaagatgtggcactgaaaagctgagcagtcatttcaactggatcaatgatcgtcgtgtattttttggctagaagtgctgttcctatgagcaaagcaactaatagaacagataaaacagcagttgactttttcttgatcaatttaaataattcttgttttataagcaatgtcatttttcttcttccccctttactgaatccagaatttccaatagggaagattccaaatcattcgtcagatgctggacatctgtcacatggacattttctgcagacaataactggataacagttcctaataactcttcgtttttttttagaagcttgattttatcaggatcttccaagggatatccagcgtctgtcaagatcgttcgagcagcttgatcatttgtcgtagagataacgatgaaatcttgcgctgtttggttcaattcagccattgtacattgtttgatgatttttccttgattgatcaggatcagctcatcgaccattttttcaagctcgctgagtaagtgactggagatcaagaaagaggtgccctgagtagccaagtcggtaatgatttttcgcacatctcttgttgcttgtggatccaaaccgttcatcggctcatctaaaataacgatagacggatggttcagtaaggcaagagcaattcccaatttttgtttcattcccagcgagtaggatttcgcttttttgtgaatgtatttttccatcttgagctgtttcacgatagtgtcgatagcagatacatcgtttgtttcagagaataacttcagatgatcataacctgttaagaatggatagatacccggatattcgatcaatgctcctacttgttctaatcctttatgactagagggagaaatctcattttcaccaatacggatcgttccttctgagtaatggatcagtcctaaaatagctttcatgatcgttgtttttccagcgccattaggacctactaatccaacgattttgccaggagataagctaaaactgacatcgctgagggcttgtttgtgaccaaagttcttggataattcttggaccgaaagacttttcaaaaatattcactccttttctatagatagtacaagcatacacctgatgagtagagaagtcgctaggtcattagtcttattttcttgttttttcatagaaagaggaatatcaaataaaaagccccgctttttctgatcagtccttgtctgcttgtctaagtatctagtgaccgctagtgattttgatgccaatgatgctgatgagcagcaacccgacaaagaaccaagtggaaagattcagcttatcatgaaacaagaccacaccaataatgaccgaaccaactgcgccaatccctgtccaaataggataagagagactcataggcaaacttttgattgcctttgacaaaaagtaaaaactagcaatcattccaatcactgtgtaaaaagaataattgattttagaaaaaccatcactccatttcatcatcgttgaccagaatacttccaaaattcctgctatgattaattccatccatgccatacatacgttcctccttcaatataaaaaatacacaaaaagaggagaatcatcccttcaaagacctaatggaatgatcatcctcttttttactacccggtggcagatcgtatatctttttctgtagtatagcacacctatccagatatcggcaatctcatactttttagtaaagtgtaacaagcattgacggatatatcgttagcagaaaagaagatgaatgctttgcaatttcatagaaaggagttgttatttattaatcatttaaaaaaacagtaactagaccttatttttatatattagcaggcaataaattaaaaaaagctttatcttacaataagtaaggtgaattatataataaaaaaataacgaaaaatatttaaaaatagtgtctatttcgtgagaaaacaactatattttttatgtgttttgctttataattaaaaaaatattgtcattttatggaggaaaatatatggaaaattatcttagccttttaggcgtcttgattgttattctcgggtttgcatttaaattagactcgatattgatcgtaatggttgctttagttgttacagctttgactggcggtcttggcattcaaggaatgttagaacttttaggtacaagttttgtaaacaatcgcgggatggcgatttttatcatcattatgttggcaacaggaacgcttgaaagaaatggtctgaaagaatcagcggcttccttgatcaagcgattcaagaaagtatctgctggtatgattgtagatatttatgggatctttcgaatgatctttgcggcttttaacgtgagttttggtggagttgctggatttgttcgtccaatcattttaccgatggcattggggaccatcgaatcaaaaggattagaagtccatccgaagcatgaagaagaactaaaaggtatggcttcggctatggaaaatgtctgctggttctttggccaagtactattcatcggaggagcaggggcgttgctagtccaatcaacactgaaagatctaggatatgacgtaacattgggacagcttgctttagtggaagttccagtggctatcacggctttagttgtggcaagtgtctacttctatcttaaagaaaagaaattagcgaagaaatattatctaggaaaggggcaataagatggacttttttacaaatcctgatattttattaggcgataaattactggagatcctttatatcgtgatgggactcgtattgatttacactggagtaagaaatttaacagataaaaccaatcctcatcgttatgggtcagcctttttctggacggtcttaggggtagttattgcaggaggaagatggcttccggcaatcgtgaacggtggcttgatctttgcgatgaccataccagcaattgctaagaaagtcagcaaaggagaaagccggcttccatcaaaagaatatatggaaaaaatgtcagacaaactaggaatgaaaatctttattccggctttgagtatcggtgtctttgcgatcttgtttgctctatttaccaatttaggtgctttagtcggcgtgggcgtcggtgtttttgcagccatgctaatcttgatgttcttttctcgagataatcgaccaagtacatttttagatgatgcagcagatatgctgggcacagtagggccgttaagcatgttgccaatgcttttagcttctctaggtgcggtatttacaagcgctggagttgggacagtgatttccaatgcagtaggtacgatcgttccagaaggaaatgtgaacatcggcatcatcatttacgctcttggcatggtgatatttacggtaatcatggggaatgcatttgcggccatcaccgtgatgacggttgggatcggtgcaccattcgtatttagtcatggagcgaatccagcgttaataggaatggttgcattgacttgcggtttttgtgggaccctgctgacaccgatggctgctaacttcaatatcgtgcctgtagcgatgctggagatgaaagacaaatacggagtgatcaaaaaccagttgtttattgcgttatttatgctagttttccaaattgcttatatgattctatttaaataatagaagagaggggttgtgacagaataattgtcgcaacctcttctaacattgtagtggaacactatttttttataagaatatattaagtttgatctgttatgttatttaaactattgtttcctttatttacgctgtgcaaggaaaatggtatgataaaagataaccatatgttaaatcaatcggacggaggaacaacagatgaaagtactagtaacaggttttgatccatttggtggggacaaagtgaatccagcctatgaagcagtaaaaaaaatgccagatgaaatcagcggtgctgaaatcatcaaagtggaagtaccgaccgtattcgaaaaaagcagtcaagtagtcaaagaagccatccaacagcaccagccagatgtcgtgatctgtgtcggacaagcaggtggacggtcagcagtctcgttcgaacgtgtcgcaattaatctagcagaagcaagaatccctgataatgaaggaaatcagccattcgatacggctttagaagaaaacggtccagccgcttactttacctcattgccaatcaaagcaatgacaaaaaatgtacaagatcatggtctaccagcgtacatctcttatacagcaggaacatttgtctgcaacgatatcatgtatcgtttgcttcatttgatcgaaacgcaattccctgcaattcgcggtgggttcatccacgtaccattctcaccagatcaagtgatcgatcgtccagtgggtacaccttctatgtctctggaagacattgcttcttctttgacttatgcagttgaagcagcagtagaaaataaagaagatatttccgggaatgccggaacaactcactaatttagcaagaaacactggctggttgctaacgttatgttagtagccagctttttgtaattagaaaggaaagaaatagccgtggaagaatggcaatccgtctttgaagaatggtttccaaaagaaatcaacaaaagctatcctattaagatctctaaacaatacacaagcagtcaacgttgggagatctatgcaaaattaacaaaaaaacagcgggaactagtcgataagcaccgccgatatctaatcagctctcgttttatggaagaacattatttggccgcaacagattgggtgttttctgacttcaagatcaatccgttttttcgaacaaaacgaagccagcaaaaattgtattgcgaatgtgggagagaattaaaagtgcaatatatcgtcaaatcgccaaaaaccggaaagaccctaaagctaggtatcaaccactttgccgatcacctgcatgtttctccgacagtagcagcttcgatccatcagggaatgacaaaagtcgatctggccttagatgaattattatggcttaagcaaaagaatatcgattttcctgaagaactatggcaaaaatactgttttgtcctgtaccaaaatcgacggatgaaacagccgtatttaccggatataaaattagcacagcgtctcgcagaatttcgccaagcagaaatgccgatttacatagcggattatcaagcattggaaaatgaaatcaagaaaatcagtgaacacatcaatgggcagccaaaaaagcgacagataaagaaagaactgtttgacgactttgcagaagaattagtaaaggatgtagaagaattcttgaacaactatcgcacatttttacgtaaagattggcaatccatcgtttatgaagaagtgccagcacatcctaatgcttattttgaaacgtttatttccgcattgagaaagacaaaacgtcagcgaacaccagaagtcattgctcagatagaatattttgcgaaaaaacaacggttcatccaaccaaaaatctatctatttatttggaagcaatattgtcgctatggttttacggaaggattcttcgacagcattcctcggatagtcagaaatggttttttaaaagtattgcgtaaagaacgagaagccgtacaatctgctgataagaaagagcgcgcagtctcaaaagaaaaatggcagctagtagtgaaggatatccaatctgggaatgtacaagagacgatcgacaaatggaaagggaaacattatcgttttactgaagcgcaaaaacaagccttagaatattatcagaagttagaagaatcactgcgtttcaatgatgaggcaagaaagtatctgaaggaattactataaaaaataggctttctctctatttttagagaaaaagcctattttttatgcgtgttgctgtgcgttgtagtattcttcttccattttttgcatacgttcacgttctttttggttataccaaggagaaacggtaaatgcaaggacatcattcagcaagtaaacagagctgttcacgaacattgccaaacttgcagatccatgcgtaaatgaaatataccaaaggaccatttgtgcaagccctgaagctaaccaccagtaatattggttattgtaacgcaagaaactgatgataccagcagtcaagctaatggaaaaagcaatggcatctacccatgggcgaggatcatctgtataacgaccaatcaggaatcctgaaacaagatagacaaggaaagtactgacgactgcgataaaccagctttttccagtgaattttcggatttttgaagccatattatgattccattctttacttaacaatacggggatatccaatgtgatcatataagcaatctgttcaccgatacttaaatagttctttgctgaaaatccaacgataataaaacaaatcgcagacaaaatacctaaaataccgttgactgattttgccgcattgatggataaaatacacaatacaccaagcgtggtaccgataaatgtgataacggacagccaagtgatgggactattgacaagagtcatgacctgacagccaagactgaaaaagaaaagataataattttgttgcggccagccttttagctgatgagctaaaaactgaaaatatgacttcatgtatgaggactccttaagacactaaatgtagtgtgttctgtatttactaacacaatctattgtatgcttttcttgaaaaaaaactagtctttcaattataaataatttgtgttatgataattttctgtttgttttcttgaaaatataatttcttactttcatttattatattgggaacaggaagagtgtcttggaggacctactttctgttttttttgccttttttcttataaaaagaaaaaacagctatttttttcaagctgacacatttacaatagagctggagaataaggtagatacgaatttaaacgaagaataggagtgcttatatgaaccttacaacgatccatcatgtagccatcattgtttcagattatcagaaatcacgtgatttttatgttaataaattaggatttgaagtaatcagagaaaactaccgcaaagaacgagatgactataaattagatctgaaactaggaagtgccgaattggagatttttggaattgccaacgcaccacaacgaccaaactatccagaagcttgtggcttgcgtcatcttgctttcaaagtagacgatatcgaagaaacaattgcagaattgcattccctagggatcgaatctgaaccggtaagagaagatacgtttacaggtaaaaaaatgacgtttttctttgatccagacgggttgccgttagaactacacgaataaagataacaaaattgtcacttttttttcgtttcattcgatttttcgttcgttcatttcttgatattcttttaaaaaaagaaacaggagaatgaagaatgaaaaaaatgatgtttggtgctgctgccctcatcgtaatattgattaccggtatgacaggattgctcagcgccgcttttcacttggatgatattagtgatcaagaatatcggatctcattgaacgaagcagcagcaatcgctaaaaaagaaataaaaaaacacaatatatcttctatccattttacagtggaaaaagaattggataatcctacgaatgcaacatatgaataccagtttttttgtgaaggacaagtcatagcagtcaacccgaccactgggaaagcaactgtaaggaatcatacagaaaaaacagcagaacctctatttgacatagaaaaaacggaagagttcaagcaaccgcaagcagcgatgaaggaagcagtcagctactacgggaaaaaagcaaaagtgaaagagtgggcgattgtagttaaagatgaacgaccgtattatcaagtccaattaattgatggaaaacagactcaacaggtatggatatctgcatagaaaaaggctatcgcttctctttttttcaatataagagtaagctaagagggtaaagatgaaaggaagttgagataacatggaaaaaatgaagtgccctaattgcggaaaaaaatttgcatacgaagaagtcaataatgtagtcgaacataatgataaagaaatgccaatcgtctgcccttattgccgaactgaagcggcaagaatcgttactcatggttatttcattactgaaaagatagaagattttttaaaataacgattttgcgatttctttttctgcatgttagaatggagaaaaggagaggaaactatgattcgttttgcgagaaaagaagatgctccagaaatcgctccattgatcttagtaattctaaaagacatggaattgccatttttgaagcagacaggggaacaaaagactttagagattctagaagaagccatcactgatccaaattatcgctacagttattcacgaggtatcgtagaagaaatagacggtaaagttgcaggagttgcttacggttatacagatgaagaagaagccatcatcgatcagccgctggtacctatcttagaaaaatatcagttagatgcgtctacacgtttgttcattgataaagaaacgtttcccaatgaatggtatttggattctatcagtgtatcagaagattttagagggcaaggcatcggttcacgattattagaagcattacctaaattggcgaagaaagcgaatcgctccgtcatcggactaagtgtggatgaaaaaaatccaaaggctaaaaaattatacgaacgccatggcttcaaagtggtcggtcagcggatgatcagtggtcatctttatgatcatatgcaaaagaatatctaaaaagatgtacctgaaatgcggaaatacgcatttcaggtacatctttttaacttaagtcaagccgataagaaacaggcttatcgcgacttttgtctttacggtaaagccagtaatctaaaaccgcagcaatacaaatacaaataggagcatcttcatcatttgagatatccagtacatagtaatctcctgaaaaaagcgtagctttatccatcttcatgatttgttgattgaaatggtggatttgatattgatgattatagatatcaccttggactgtccagtgaagcctacgaatataataaaaatcaccgggccaattgaatattttctgcatggttcccactttttcgaactccttatacagctcaaaacgcgtaccgaatgtcaggcttatttgcttgatgtgggcaacaagatcgccattcatggcataaagagacaacgcatcgccctttgttccccaacgaccaaccatcaaaaacagggaatgccctttttcgtttttgacgattgtccgagtcgcacgtccaagctgtttttcctgaatgaaaaattctgacatctatatccctcttttctagataaaactataagtcttctgcaatcgcgcggaatatggcttttcctacgccagattcaaggttcgtgtccgttgtatatttggcataatcttttacttcgatttctgcatttcccattgcaaaactgactccagccacttgcagcatactgacatcattgaaattatcaccaatcgtcatgacttcttctaaagaaatgccacgctcatgcgcgacgtgggcaacggcaatccctttttgagcgtttttatggttcacttcaatattgttttgaccagaagaagtgacagctaaatcacctaaaagagaaatctgcttaccaactggtcctaacacagcaggtccttctgtatgaaaacagatgattttcaagacttccagattcttttcttccaaaatggtacgaatactgtctacatatgtgatgtgcaacaactccagcttagctgaggccatggcaatcgccattttatacgtaaggtgaggtaaatgggtagcgaccatggaagcaaagctttcgatccgcttcgcttgattttcagaataaagaccatcgttggttgctacttcatagtaaataccgttagcgtctaaaatatccaaaacagaggttgcttgattatttgggatggatacggtaaacaaggaatttccttctttatcaaatacctgtgccccgttcaaagtgatcatcgcacaatcgattcctacttcatccaaagcggcgcgagcttcttggtagtttcgtccagtagcgaccatgaactcaacgccggcatcgtttgcaaaacgtatcgcttcggcattttcaggagaaacactcatatgggcatctaataatgtgccatccatatctgatgcaattaatttgatcataatgattatcgttcctttctgcttcttgttcctagtttaccatattaatcaagtgctgagggggaagattgtcccttgtgattgaagaaaatgtgagttattctttttattaggaggtggaggttttgaaagaaatcattcataacagttggcaagaagttttgtcctcagaattttcaaaagattattatctgcatctaagagaatttttaaagaaagaatatgcgacccaaaagatccatccagatatgtatcatatctatgaagcgttggaattgactccttatgaagaagtcaaagtagtgattttaggacaagatccttatcatggagaaaaccaagctcatggattatctttttctgtgcagcccggcatgaagatcccgccatctttaagaaatatctacaaagagcttcatgatgatcttggtatcgtacctgttcaacatggaaacctagtgtcatgggctaaacagggagtcctcttactcaacactgttcttactgttcgggaagggcaagcttattcacatcgcgggaaaggttgggaaagattaacagacacgatcattgaaaaattaaatgaacgagaaaaaccaatcgtgtttatcttgtggggaaaaccggcgcaagaaaaaatcaaaatgatcgataagagccgtcatatcatcattacatctccacatccgagtccgctatccgcaagtcgtggcttttttggttccaaacccttctcgaaaacgaatgatgcactccttgcgttaggagaagaaccgattgattggcaactgcctgaaacagtgtaataaaacagcgctttcctgttatagcgcagtttgccatatatgtgaaaaacttcatttttccggcatttttgactgatacagataaaataaactgttctttttttatggaatagtgtatgataatacatataaaaacgtctggaggtcatcttgtggaattgtttgatagtttaagatttaagattgttcgccgtgggatcaaaatcgttttcccggaagctactgatgctcgaattttaggtgcagctgctcggttgaaagcagaagaactggtggaacccattttagtaggaaacgaagaagaaataagaaatgcagcacatgccagaggaatcaaaacatctagctttacgatcattagtcctgatacttatgataagtgggatgaaatggtagatgcatttgtcgaacgtagaaatggaaaggcatccaaagaacaagcagaaaagattttaaaagatgtgaattactttggtacgatgcttacgtatatgggtgttgcagacggcatggtctctggagcaatccattcgacgggtgacactgttcgtccagcactccaaatcatcaaaacaaaacctggtgtcagtcggacaagtggtgcgatgatcatggtacgtggaagagaccaagaaaaatacgtcttttctgattgtgcaatcaatgtgaatccaactgcacaagaattggcagaaatcgctgtagattctgcaaaaacagctgaactgttcgatatcgaaccaaaagtggcgatgatgagcttctcgacaaaaggttcagcgaaatcgccagaagtagacaaagtagttgaagccactaaaatcgctaaaaaactagcaccacaatatttgatcgacggcgaattgcaatttgatgcttcttatgttccttcagttgcacaactgaaagcgccagattcagaagtagctggtcaagcaacagtctttgtatttccagaattgcaatcaggaaatattggctataaaattgctcaacgttttggtaactttgaagcaatcggaccaatcttgcaaggtttgaacaaaccggtttctgatttgtctcgtggggcaaatgaagaagacgtatataaattatcgattatcacagcagcacaaacattgattgattaacaaatacacatggactagtccaaaaacggcagctgctgttcttggctagttcgtttttttctttaaaaaaacttcattacgcgatatactggcaaaaagaaagaagagcgggagaagatgaaaaatgatcgaactatcaggattaacaatgacagaacaatttgcagaggcaattggtcattccgccatgccaggtgataatctgatattgactggtgatctaggtgcgggtaaaacaacattgacgaaaggtatcgcccaaggactgggaataacgcaaatgatcaaaagtccgacatacacgattattagagaatataatcaaggcaggattccgttgtatcacatggatatttatcgggtagcagctagcggagctgacttagggttagatgaatattttgaaggagatgggctttccgttgtcgaatggggaaacctattagaagaagcactgccagaagattatttggaactgattttagaaaaaagtgatacagatttagaaaagcgttatgtgaaattaatctcatatggtgaacaaagtgaaacattcaaacagcgaatcctagaaaaatgggttgaaaaccatgagtgaagaaattggaatcatcttgcgggaagcagtgccagatgatgcaaaagatattctttcgatgatggaacaagtcaatagcgagacagaatttttagctttaaatgaagctgaacttcttttacccccagaaactttatcagaagagttgagttatatgtacgaaagcaacaataatttattgctgcttgctatcaatgaggggacgattgttggaacagcatcagtcaaagcagacagtcaatttcgtttatctcatgtgggagaagtcggtatcagtatcctgcaggaatattggggaatgggactaggtactcttatgctagaagaaatcatcaattgggcgaaggaaatgggtgtactttttcgattggagctggatgttcaagttcgtaatgaaagagccgtacgcctttaccagaaaatgggtttccaaatcgaagcggtcatgcctagaggggcaagaacagatttaggtgaatttttagatgtatataaaatgagttatttgattgaatagaaaaaataagaaaagagttaagaaactgtcatccttttgggaaggcagaaaaacgtatgaatggactgtgacaaaagtcgtgacgcagtccatttttttgaataaacggtgttcaatcagctgaccttcgatattcgctcaaaaaacggcaaaatatgaggaactattttgccgtttgtttctctaataatcaggtcaaaacgctgatttcacaacctctttgtgcgtttcataagtaaatgattgctttactttatagtcacgagttttttcaatggatctgtcccgaattttttttcttgataaagcaggatttccgcacacgcacgactatcttccaatgcatcatgatgatgatctaattggatgttcaaattttcgcacacagtgttcaatcgatgatttggaaattcagggaacaagcgacgactgcttttcactgtacataaagaaagataattaggctgttcgaggtggtaataatctaaacaacctgctaagacctttgtatcaaaagcagcattatgtgcaacgactaaaagatttttttgaaaatatggttggatagtttgccagacttctggaaatttcggcgcattgcgtacgtcttcttgatggattccgtgaatttggacgtttcgccagaaaaaaggagtttcaggctgtatcaatgtatagaattcatcgacgatttggctgttttttaccatgactaacgcaagagaacaagcgctataaggctgatgattggcagtttcaaaatccatggcaacaaaattcatttctgtaaaacctccttggaaaattactgtaacatacttttgaaaaaaacaaatagttttaacaaaaaacataggattttttatgtagtttttgtagagaaaagctattttttgaactcattccttgcgactcggagttagacgagaggatcatgacttctcggtatcagctcacaaaacggcaaaatatgaggaactattttgccgtttgtttctctaatacacagatcaggacgccgatttcgcaacctcttgataaacggtgttctcctgccaactcctcagtcacaagtcacaatatccaacaaacatgagaagctgttttttgaaattgctccttgtgcctcagagttaaacggcaggctcacaacctctcaataaatggtgttcaaaagccagtttctcggtattaagccaaatttatgcaaaaatgtggaaagccattttcacaaaatttttcttaatactcgaaactaaacagctttttcacaacctctttatttcaaatctaattctactggacaatggtcactgcccataatgtccgtatggatctttgcatcagccagtcttggcgctaaatctttgctcgtcaaaaagtaatcgatccgccaaccagcattgttttttcttgaattgaatcggtaattccaccaagagtaaacaccttcttgggttggataaaaataacgaaatgtatcgataaacccgttatccaacagtcgagaaagagccgctctttcttctggagtgaatccagcatttttttgattcgttttccagtttttcaaatcgatcgtttgatgcgcgacgtttagatccccgcaaacgatgactggtttttgtttctttaaattttctagataattataaaaggcttcttcccattctaatcggtaatctaaacgtttcaattcactttgagaatttggcgtataacaagttacaagaaagaaatcggaatattccaaagtgatcagacggccttctgtgtcgtggataccgatacccattccgtaagtggcattcaatgcaggttctttagcaaaaatggctgtaccagaatagccttttcgttctgcatgattccaatattgataataaccaggaagatctaaatcgatctgtcctgcttggagctttgtttcctgcaaacagaaaaaatcggcgtctaactcatgaaaaacttctaaaaaatttttatttacgatggcacgaagcccgttcacgttccaagagataaatttcaataaaaacacactccttcgaattaaattccttacctttgcgatactattgtacctcattttagtaaaaaatggtgtaagatgaaagtaactaaatgatccaggaggaaagtcgatgaagattggtgtaatcggtgtagggaatattgcagaaaaagcatatttaccaacctatgcgaaaaaacaaggaacagttgatttttattttgcaacacgaaataaagaaacaaaagaaagaatccaaaaagaatatgggttccaacatctatatgaaacgatcgatgagcttttagaagaaaaaatcgaggcatgcatgattcacgcagcaacaaaagtacattatgagctagcaaaaagatgtctagaaaatggtatccatgtttatattgacaaaccgttgagtgtccatctaaacgaagtgcgtgaattgcaagaattggctgataagaaccaagtgatcttgatggtcggttttaaccgacgctttgctcctatggtagaagaattgaaacgtatcccagagaagcggctgatccaactgcaaaaaaatcgaatagcggcaaaagagacgacagaattcgtcctttatgatttatttttacatctcattgatacagcggtgtatttattggatgaacccattttgagaacaaaatatcagataagagaaacaaaggaatatttggaatatgccattttacaattagaaacacaaaatcaaacggctctattaacgatggatctagcaagtggtgctaatacagaaaaatatcaagtaacaagtaagaatggtacttatgaagtaagcgacctgacccagcttgtcattcaagatgctgatggaaaaaaggtgaaagaatttggcgactggacgaacacgctagtcaaacgcgggtttgagccaatggtagaggccttcttatctcagatacgttcaggtaaaccggaagcagaactgcttaagcagcaagaagttgtaagaagtcatgaattatgcgaggaagtgcttaaagagcactaccgtcatcaactttgaacaagactggcaagattgtattaagcgtgatagaataatggggacgtttgagaaaagaaaggaaaatcctcagtgaataaagaagaaatagttgaaagcttagccacgatcactttattgtttgatgaaccattgatgaactatacgtttacgaaaacaggcggaccagctgatgtccttgcattcccgaaaaagcaagaagaagtaaagcaaatcatcgattattgccgaatccatgatataccttggatggtactaggaaacgcaagcaatctgatcgttcaagatggtgggatccgtggtgtagtcatcatgctgactgaaatgaaacagattcatgtcaaaggaacgatggtcattgcggaagcaggtgcctcactgattgatacgacttatgcagctttggccgaatcattgactggatttgaatttgcttgcggcatcccgggaagtgtcggtggagcggtttatatgaatgcaggtgcgtatggcggagagatcaaagatgtttttgctgaagtggatcttttgcttgaagatggaacattgaaaactttgacaaaagaagaaatggtattttcttatcgtcacagtaaaatccaagagctacgtgctatcgtattggaagctcgattcagtttgcaaacaggggattatgaagcaatcaaagcacgaatggatgagttgacagaattgcgtcaatccaaacagccattagaatacccttcatgcggcagtgtctttaagcgcccagtaggacattatacgggtcagctaatccagcaagcaggattgcaaggtctgaaatggggcggtgcacaaatctctgaaaaacatgcaggattcatcgtcaatatcgatcatgcgacagcgacagattatattgaattgattgcgcacatccaagaagtgatcaaagaaaaatttgatgtgtctttagaaacagaagtgcggatcattggagagaaacaagcactatcagaaacaagcagaagtttagcgaattaataagtaattgcacttaaaataagtaaaagagcaggacggaggacgccctgctctttttgtggttgtttacgcaaatggtgcaaatcttgtacattttaacacaataaaacaaaaaatatagaatattttcccgtaaatttttccattttttgtaatattctcaaaaaaaagataaaaaatgtgaataactgatgaaaaaacaggtgtaatccatcataaaatcagtataggtgaaaagatgaactttcatctgcatatcaagtgattggtatgaggcatttttttgaggtgtaggatatgaagttggattaccttatcgaagaggaagatagagaaaaactgctgttagccagatatttagaatttgagaaaaagaattacgtcgtgttgtctaagttatatgaaacattaggtttatctaaatttaaaacaagaaattatatcatagaattaaataaagaattttctgaattcaaatcaaagccagagatccaaatctcagaagaaggagagattcatgttgaacggctaaatttgacggatatcaaaaatttaagaagaatctactttcaacgatcaaaaattgctcgactgttaacggagatcgtggattcaaaagtaacaattgaaaaatttgcagagaaccattttttaagcatatcaagagcttatgtaaaaagaagagaattagtctcttttcttgaacagcatcaaataaagttaaagaaaaacatattagttggggaagaaataaacatacggaacgtattatttggggtatattttggggtctttaatggtttttctatgccatttagagaaagcgtcatgaatgaagcaaaaagtatcgtgcaatattttgaatatctgttcaatttaaagttgtctgccacaaagcgaatcaaattcaatttgctaactactgttagtttgttgaggatttatggaaatcaaccaataggaaaacgtttcttttcagatgaatactttaagagctcagaaggaatgaagattattaaggatttatcgcatatttcttttctacatatccctaaagagcagattattgatgagatttcttatatcatgttatttttgattacggaagaagaatttgaattagatggtgcgtttggacttgcagaagctcatttccatgatatccatatgattagtcaaaaaatgtcagtggaattgattgatcaattaccattttcaactgaagtttctgaagaagaaagactccatatacgaaaagaacttcgtatggggatgatgcatgtcaatcggaaaaattggatattcgactttgagatgactagttttacgtctaaaaagcagttgcagtttttcttcgaaacgtatccaatattcagtacagcgatccaaaatgtcatacaagataataaacactatttcttggaaaaagatgaacgtttcatgattcgcttattttatgattatctttttttattggtcggtatttgtccagtctcttattttgaatcaccaatccatgtctgtattgatttttctcaaggatctgcctataccgcttatattatttctcaagtgaagggatttaaaaattacaatattgtgattgaaagtcgaatcatttcccgtacggatatttatttatctgattgtttgcttgaaaaattcaacaaagagcagataatatggaaaaatccgccgacaccagatgactgggaatattttgggaatatcattatcagagaaaaaaatagacatttaactgaaaaaatcagctaatatttatggatgacaactttgtcttacctatttattagctgatttatgttttttttcaaagaaaagatgactagatatcgagagatattgcttgacaaaattaaaaagtacataagttattattacgattttctttaaataataaaaaatcaagaaaaatactgtcccaattgaccatctttttttgattttatctatataataaaatcatcttatgaaaattactacttcatgctgaggcaagagtagggaggactaagaataaatgtgttcaaaaagacaacctaaaaaactaaataaacacgcttgccgtttagacaaagaacgatcgtgttctgaaaaccgctatgtcaaatttgtgatgcgtacgatgctgatcagcttatctgtaggtgtctatatgaatgtacccgttcaggcaacggcacaaaccatcaaaatcgtacgtacatctgtctctgagacgactgattctcctattactattacccatactttcactgatgtaagtggaacacagctacttccttctttgaattcctataataaagtcagttatcctccaacgataaaccactattggttaattcctaacaaaacattatggacatcagaaactggaagtagcgtgccgctttctgtcttttccggtatgactgatccaacaaaaggtgatcagctaaaacagatcattgatagtttaaatcatgctttgacaggtgtgaaggacggtggaagtgcacaagtctcttatgtatatggaaaagattattcacagttcaaaggcaaggaaatcaacgttctggcagggacaaaaatttcgatatcggatctggtagaaagcttgaggaatgcagatggaacacaaggagatatgtccaaagtaatttcaaacaatgggaatatcatagacacgacaaatacaggagtatctactattgacttgtcttattttgatccaattgctttaaaaacaatgactgcatctgctgtgattcatgttcatgttgatcaaacagctatcaaaggaaaagaacttcatctaataacaggagagaattacgaccctaaatctcttatcgaatatgtaacaaaaagcgatggaacttcagggaataaagaagaaatcaaaatgagcgggacagtagattctaccacaccgggagaatatcccgtcgtattaacttatgcagaccctcttacatcaaaaatggtggaaacaacagctgtcgtttatgtagaagcacctgctgtttcatcgactgtcatcactcattttattgatcgtcaaacgaataaagaactgcaagcagaaacacgcataagtagtgtagaacttattccagatttacaactccctgctgaattttctgatcgagtgccgaatgtagatttgtcgacttatgaacaagacggaaaagtcacttctatttctgactggatgcaagcaaacggattagacagaaacagtaactggtcggtgattcttgaagctattcactcaaaactgatgaataataggaagcaatcaggagaggaaattaccttcacttatgtttatgtaccggataatagttcattagaaggtcatgttgttattgctcagccaaatgaaaaaataagtaaagaagagttgatcaaatccgcaacaaactccttaggtaaacccgtaccgtcaaaggatgtagaggtcacaatcaacggagaaccattggaggatggttatttgaccaaacaaacaggcgattttacgattatgtatagttatcatgacccgtattcactccaagaactccgtgctcagtcgctattacatgttttaccattaaataaacagataaaccaaaaagaacaaaaaagacaagaagaaagcttgccagaaaaaaaacaataaatggctcatgcagtttctccaacagggaaattaaaacaaataagaagcctagaaccagtaagaatatctataaaaagctcagaatctaacaaaacgatagggcaagaagatcctttggtcccacaagtttctgaatcggaaaatgaaatgttagagtctaaaatagaacaacaacaatcagaaaaagaaattgttactaaacagtcggaagatcaaaatgaatcagatgaccacaaggaaacgaagaaaaaacgcttgtcaactattgattccaccaatgagcatctgcagccgcaagtaccgcttcctagtccgggaacacccgcacctggtggaggcgtcccttcttcttccgttttaggagatgtcatgcgaggtatggcaggaacatgggtatacgctaatcgaaatgaatttgacgcagatgactggttctgattcatccccctatctgctatagtcaaataagtagctgagttatctgttatttggcataatggatacgaggagggatagaaaaatgttagataaaacgttgccttacgcagaaatctggatgacaagaccacttcaactgcctgtgccaatgacgcctttagcggaaggctttaaatttcgaacctatcaaaaaggggacgaatctgcttggtcagagattgaaacttccgttggggaatttcaaacgacaggtgaagcacttgagtattttcaaaaaaactttgctccttatcctgaagaacttgaaagaaggatgttttttgtagagacaaaaaatggagaaaaagtagcaacctgtaccgcttggcgaaaaaaatcaagagaacgaatgtatccggtttttcattggttggcagttaaaccagtttaccaaggaaaagggctcgcaaaagcattgactgctaaagtcttacaagaatttcttaccctccatacggatggaccaatctatcttcacacacagacatggagccatcaggcgattgctctttataaaaaaatgggtttttcttttattgctgaaaatctagatggcacacctaattcagattatgaaaaggttatgcaggttttaagtcaattggataaataaaaaaatggtgaaatcagctcacaatatgagaagaaaaacggaaaagtagttctttctatcttactgtttttgaattcatcctgttggctagctgatgatacgctatttattcgaaaaagaagaggtcgtgacaaaagtcttgtcactgcctcttctcttatttttttagaatttttatcgtttgatttttttgggaataaaattcttgatgaaagtaaatttttggtaatcatttcgactatacaagtaaccaaatatactgaaaacgactgctccaataaaattaacaaataaatccttcatagtatctatgattcctacatctaaataaccattttggatgattattttatctattttaccgtctgcattctgactttcaatgactgtccgagtgatatcaggaacatgatagacagtgtttccgtctttgcttaactccacactattgatttgctggatgatcgtatctttttgcatatcgaattgtagcaatttatctgctgaaaattcaacaaactcccacataacaccaactgtcatcgaaaaacaaaaggaaacgactgctaataacagaggagtcaagttcatcgtttttgtatttttattgagcaaataaacaagtgaaaaaccgacacccccagctaaaaatccgctgaatgcatgtagaaaagtatcccacattgaaaaatagccataaaaatcgcttaattctcctaaaaccgttgaactgaaaataaaagataacaatatgatttctaacatatttggaatctgtatctttaatatcttttccagaaaataaggaatttcaaataaaatcagtgtcaataataaaagcatcgtatttccccaatgttggttccaaatctgatcaaccaacataataacaacgatgatacgtaataaaatatagattccatttgtgattttgccagcagtttttgtactgttcgtaaaaaaggttttcaaatgattcataaaataactccttcatgtatatccttaattatactaagaagcgcgtgtttaccaaaactatatgtcttaaagaaaaacagagttgatattgtgaaaaaaatcacttaatataggcataaggagaaaagggggataaacatgaaaaaattagttgttggtttattaacggcggtttcgcttcttgccatgagtgcatgtggcgcagatcagaaaaatacagcacagacaagttctagtacgaaggaatctgccgaagtgtcatcaggtgcttctaaacaagcatataccgatccaaaagaaatgaaagaatcttatgatatcgtaatcgtgggagctggcggtgcagggatggcagccgctatcgaagcaaaagatgctggtttgaacccagtgattttcgaaaagatgcctgttgccggaggaaatacgtctaaatcatcaagcggaatgaacgcttctgaaaccaaattccaaaaagaagagggaatcgaagactccaatgaggcattctatgaagaaacgctaaaaggtggcggaggaacaaatgataaagaaatgcttcgttactttgtcaatcactctgctgatgcaatcgattggttggatcaaaatgggatcaaactagataatttaacaatcactggagggatgggtgagaagaggacgcatcgtccgtctgatggctcggctatcggtggatatttagtggatggattattgaacagcgtccatgagcgaaaaataccgatttttgtcaacacagatgtgacagatattaagaaaaatggcgaaacagtcaatgaagtgactgtacatgtccaaggagaagaaccaaaagagatcaccggtaaagcaatcgtcgtcactacaggcggttttggtgctagcaaagaatttattgaaagatatcgtcccgatttagctgattatattacgacaaatcaagaaggatcaactggagatggtattaccatgatcgaaaagttaggcggacaaaccgttgacatggataaaatacaaatccatccaaccgtgcaacaggatgagggaatcttgatcggtgaagtggttcgcggagaaggagcaatcttggtgaatcaagaaggcaaaagatttgtgaatgaaatggatacaagggataaagtatctgcagccatcacagcgttgcctgaaaaatcagcgtatttgatttttgatcaaggcgtgcgtgatcgtgccactgctattgaattttatgaccaaaaaggatatgtcacaactggaaaaacaatggaagaattagcagaaaaaattgatttgccaaaagaaacattagcaaaaacaattgatggatggaatgcggatgttgcggagaaaaaagatgctcaattcaatcgtgccacagccatggaacatgatctatcgtctccaaattattatgcaatcaaaatcgcgccagggatccattatacgatgggtggtgtgaaaatcaatacgaataccgaagtattggataaagaaaatcagccgatcagcgggttgtatgctgctggagaagtcacaggtggcttacatggagacaatcgaatcggtggaaactcagttgcagaaatcattatttttgggcgacaagcgggcatacaagcagctcggtttgcttcggaaaatgaatgaaatagaacgtaaataaaaagaggttgtgaaaaagctgccttgcatcaagtaataagaacagccaagtaaaagtagcttcttatgtttttgacttggttggacttattaccgcagatgcaagctgattgaacaccgtttgttcggaaaaagagcgtgagacaaaagtaaagaacacttttgtctcacgctctaaacacgtataaacggcggaagcaggagcaactccttcggaaataagctgaaattcacaaaaatttgaaaagcaattttcgagaattttttcttatttcttggagttaaacgcttctattccagcctcttttttgatcagcatggttttattcagttatcttcaaaatgatttttccgatgtttttgtttgcttccatatattcatgcgcttgtttgacttcgctgaattggaatgtacggtcaatgattggccgaatcttgccattttctagaaaaggccccactttttccataaaagtttgtgcgagctctgctttatactgatcacttctaggtgtcaataatgtaccaagaagttggacacgtttcccaatcaatacaccaaggtctatctcaggcacaatggttccgccaagcataccaatcaagacccagcgtccatcaacggctatagaagctaaattcttttcccagtaagaagcgccgatgaaatccaagataacatcgactcctcgaccatcagtgatttttcttacctcttcttgaaaatcttgttttttatagttgatcaattcatctgcaccaagttctttacaaaaggcgagcttttcttctgatcctgcagtaacgatgattttcgcgtgagaaagttgtctagctaattgaatcgctgctgttccaacaccacttgctcctgcgtggatcaaaacagtttcgccttcttgtaattttccaagccaataaagtgtttgataagcagtcagaaaaacttctgagattccagcagcagaaacataatctaacgtatcagggagaaggattgctcgatcggcaggcatcacagcatattcagcataaccacctagattgactaatccgtacacttttgttccagtagtaaaagtggagatatcacttttattctcaactacctctccagctacttcgacacccaaaatagggtagggaggttttaaagagactgattctcttttcatgatatctgttcgattgaccgctgctgtatggacttttatcaataattcgccttgttttggttcaggaacaggcacttctatttgttctaatacatctacagaaccaggatgcttgattgaaatggcacgcatggatctattcctcctttgcccattcttggaatgctgtattcaactctttgctaccttcagaaagtactagagtcgtacgggaaatatccgtttcttccactagagcggcaagtacagcagcaactgtagagcgagtgatcgtttttgatgccttctcattaggcttagttaattgaatggaagtaacttcttcatcgttcgtcaatgtgactggttgaagaatgacaaaatctaagttagttcgtttcagccattcatctgcataatgtttagtaatataataatctgtcatggactcaggccattttgctggttcatccgcataaacagcactgaccatcagatagcgagaaacatgcgcattttcagctgcaatcactgttttgattgcgccatccaagtctacttgcagaagattctttccttgagaaccggcagcaaaaatcaatacatcgatacctttgaatgcttcagccattttttccacggaccaagttaaatcaaaagagacatacgaaacattctctttttttactaatgtctgggaagcgacatctcttaccccagcaaaaatttcgtgggagcttgaagctagatcttttatcaggtgtcggccaatctgtccgtttgcacctacaacaaaaattttcatttggatcatcctttcgacgtcaaatcttactatttaatagtaacaccaaaagagaaaaaaatcagacatcggctacgataactatcagtgatgaagagaagggcgcttgaagtatcttagcaagacattgcatactgccgcagtcgcaaggccagcgacgattccttcaggtacgccacttgtaaaaataactgcaagaatagctgaataaacagcatttaaatttgtcccgatgactttggcgtaatcttgctggaataaaaagtagatcatattcatcactaaaatcgtattggtcaatgagccggcaagtcctgctaagaataaagagacggtatctgctttttgtttcatcagtttgcgcagaccattataaacgaaataaggaacaacaccaatcaagatccgagggataaacgcgatcaacaaggctttccagcttccatgttcagttccgatgactgggatgaacggagaaaagacaaaagacaaaggtgtttggataaccgtacttcgaatcatactgatcagtccaaatgtaccgccaagaaaagcacctagtcttggtcctaaaacgatcgaagcaatgattacaggtatatgcatggttgttgcatttattgggccaataggaataaaccctagaggcgtaacagctaataaaatcaaaatagctaaaaacatcgcagtcaaagtaaagttttttgtatttttcataagtactccttttccactaaacatttctttcgttaagagtcagcatgacctgttcgatgatcgtctgaatatcagctaaggcaccttttccaaaatctccgcaagctaaaagagattcttttggttcgatttcctgatagccgacagatctcaatgtttccagattacgctgagtgatcgggttttgatacatattcgtgttcatggcaggggcaatcagttttgatgttcccgccggaagcgccattgcgactgttgaaaggagatcgtctgcaatgccgtttgctagcttgccgataatgtttgccgtagcaggtgcgatgagaaacaagtcagcttgtttggctagttcgatatgattgatcacctgtggatttgattcttgcatgacatctgtatggactgctcgcttcgacagagattgcaaggttaatggcgtgataaaatgtgtgctgctttgagacataatcacatctacttggacacctgatttgacaaattgacttgtaagatcggcacttttgtaagcagaaatacttccggtaacgcctaataagatctttttcattttgattcctccaatctaattttttcagtaatcaatgcagcaatctctgatttactttgtgcttcttccactgtcccatctttagataagagataaccgtggtgtgtctcgccatggatttctgtcaaatcattcgcgaaaataaaatcagttttgttatttatcagactgtttttggcgactgtaagaagagattcctttggtacgtctactaatagtttaaaaccaatgattttcgctttcggctgccattcacgcagataagaaatgatttttggcgttttcttcaaaacgagcacaagatgctcggtgtcagaagagatctttgaagcagagttctttatttgttcattttctgcaaaccaattggccagttcttcttgtgttgaagaagcgggtagtttttttgccaactgttcttctgaaaaactaaaagcaggagtaaaatcactgactgccatactgtggataattgcatcatagtgttctttttttgtgagtgcttctaattgtaaaaacaagtcttgggcagactcaatcgtatagatcgttatattggaacgtctttccggtttcagtgcttgtctcgtagtcacgtaatcgactgtggtatctgggttggcagctaagtaatcagctaaagcttgtcctaatcgtcctgtcgaatgattcgtaatagcgcgtacctgatcgattttttcagttgtccctccagctgtgatcagaaccttcatttttggtcacctacatttaccagtgttcttccttgatgtgtcccagcaagtagtttagttgctgtttcaggcaaatgctccagagttacttcttgggcgactagatcatctgctatctgcaaatctgccatctgttgccataaagaaggacgttgttcaataggtacattgacagaatcgatcccaatcaattggatgtttcgcagaataaaaggcaaaacggtcgtgtttagtttgattccccctgcattaccacataaagctgctacaccgttataagagatcaatggaagaagactacttagttgctcaccgcctactgtgtcgatgacagcatcgatttgctgttttcctaaagcttttgttgtttctggcagaaattcatcaggacgtacgacttgagtagcacctaaactttttagccatgtgacagactcttcttttctggaaaaagcgatgattgactggaatccgagtttatgtaacagggcgacagctacactgcctacaccgccagaagcaccagtaatgacaacttttttattggaggttatgccttgacggattaaagcgttcacacacaacatagcagtaaaacctgctgtaccaaaaatcatcgcttgacgcagtgtcatatttttcggtagagggactaaccagtctcctggtactttttggtattggctgtaaccgcctggataggtgacaccaagcccaaaaccagtagcaagtacaagatctccttctgaaaaacgtgtatctttactttggacgacagttccggataaatcaatccctggagtcattggatatgttcgtatcacctgaccagactcgctcattgccaatgcatctttataattgacatcagaataggcaatttttaccaagacttcattttcagccaattcagtaaatggcagatcactgactgctgtatggaaaacaggttcatttattacctgaaaagatcgaaaagcgttcattcgtgagacactccttttaaaaattttcttttatcataccacaaagcctacttttttattctggttcttccttaaatttagacaaaaattaggtgaaagaggcagaaaaaagaaagaatcgaataagtagaaatgattcgaaaagataaagaaatattcagcaaaaaaaatgttaaaaagggttgccttttgcaataaatttcgtatactaatacgagtggtagtaaaccagaagtttactattagaaaacttcatacggaggaaattatggaaattggtgagaagttaagaaatttgcgcatccaaaagaatttgacacaagaagaactaggcgaacgcacagatttgtcaaaagggtatatttcccagttggaacgagatttaagttcaccatcaatggaaacattcttttctattcttgaagtcttaggtgtcactccagaagaattttttcatcaagaagcagcgaatctgcaagtggtttattcaaaagaagatcatacggtttatttcgatgaagaaaacgggtatgaattggaatggctggtggctgattcgaatgaaaaagaaatggagcctgttttactaacttttgaaggtgcaggagaatataagacgtttgaaccttcattatctgaaacgtttatttttgtattagaaggggaattagagttaagcttaggagagacgatctatgtggcaaaagcaggacagtcgatctattatcaagcgacaaaacaacatcaattaaggaatcatctcaaaaaacgaacaaaagtattgattgtcgcgacacaatcatatttgtaatatagggggtaaaaacgtggggaaaccaatcatttcatttgatcaagtagtgaaacgctatgatgatgaaacagtattaaaaaaagtaagttttgagatcgaacaaggaaaattttatacactgcttggtccttccggctgtggtaaaacaacgatcctacgtattatagctggattcaccgaagctacagaaggggacatctattttgaagggaaacggttgaatgatttgccagctaataagcgacaagtaaataccgtcttccaagattatgcactttttcctcatatgaatgtttttgataacgttgcttttggattgaagatcaaaaaaatgtccaaatctgatatcgaaaagaaggtaaaagatgcattgcgtatggtccagcttcctggatatgagaaacgggagatcagtgaaatgtctggtggtcaaagacagcgtgtagcgattgcacgagcaatcgtgaacgaacctaaagtattgttactagatgaaccgttatcggcgcttgatttgaaactacgtacagatatgcagtatgaactgcgggatctgcaacaacgattagggatcacgtttatttttgtgactcatgatcaagaagaagcgttggcgatgagtgatgagatttttgtcatgaataaagggaaaatcgtccaaagtggtacgcctgtagatatttatgatgagccaatcaatcatttcgttgctgattttgttggggaaagcaatatcgtggacggtgtgatgatcgaagataatctagttgagtttgttggtaagcaatttgaatgtgtcgatggcgggatgcgcccgaatgagccagttgaagttgttttacgcccagaggatttgacgatcacgacaccagataaaggaaagctagtcgtaacggtcgatactcagctgtttcgtggtgtccattatgaaatcatctgttatgatgaacagcaaaatgaatggatggtccattcgacgaaaaaagctaaagaaggaagcaaagtaggattggcctttgagccagaagatatccatgtcatgcgtttcaacgagtctgaagaagaattcgatgcacgtcttgacagttacgaagaataggggggacaagaatgaaaacaatgcgcaggatctattccgtcccttatattttgtggctcggtttattcgtgatcgcgcctgtattaatgatcatttatcaatctttttttgatatgaatgggcaattcacgctgaataactatctatcttattttacgtcggggacatcgctttctatgacgatcaattctgtatggtatgcatttttgattacgttttttacactgatcatcagttacccgactgcttattttttaacaaaactgaagcacaagcaattatggctgatgttgattattttgcctacatgggtgaatctgctgcttaaagcttacgcatttattggaattttcagtgttcacggcagcgtgaatcatttctttgattttatcgggatcggaccgaaacagatattgttcacagacttcagtttcttgttcgtcgcaacgtatatcgagattccatttatgattatgccgattttcaatgcattggaagagatgaatccttctttgatcagtgccagcagagatttaggagcgaatagctttgagaccttccgacgagtgatttttccattatcattaaatggtgtgaaaagcggcgtccaagcagtctttattccttctctttctttattcatgctcactcgtctgattggtggaaaccgagtgatcactttaggaacagctatcgaacagcatttcttggttacgcaaaactgggggatgggttctacgatcggtgtgattttaatcattgctatgtttatcgtgatgctcctgacaggcgagaagaaaaaaggaggtcgctcataaatgaaaaaatttaaatggtcgtatctttatttagggatcgtctttttattcttatatgcaccgatcttctatctgattttttattccttcaatgaaggaggaacgatgaacagctttacagggttcacttgggaaaattatgaagctgtttttgaagatactcgtttgatcattatcgtattgaatacgttcatgttggctttcttatctgcattgatcgccacgatcatcgggacatttggggctatggggatctattacacgaagaaacgacgtgcacggacagcgttgttgagcatgaataacatcttattagtatctcctgatgttattatcggtgctagtttcttgattttctttacactactagggttcggattaggttttcagagtgtattgctttcccatattgctttcagcattccaatcgtcgtcttgatggtcttgccaaaattgcaagaaatgaacgattcaatggttgatgcggctagagatcttggtgcgaataatttgcaagtagtcaaaaatatcattttgccttatctttctccagggatcatagctgggtattttatggcatttacctattctcttgatgattttgcggttacgtttttcgtcacaggaaatggctttacaacgctctcagtagagatttattctcgtgcaagacaaggaatcagtttagaaatcaatgcgctaagtgcattagttttcttgttctccatgatattggtcattggttactacttcattagtaaagaaaaccgtccaaaacggttgaagaaaaacagaagagtacgcgagggggtggcacggctacgatgaaaaaattacaatctctgtttttaggtattcttatcattattgcggtgctacttcttggtgttcgtcaacttgaaaaaacaagtggcatgagtggagcaaaggtacttaccatctataactggggagattatatcgatcctagtttgatcacgaaatttgaaaaagaatatggatacaaagtgaattatgaaacatttgattctaatgaagcgatgttcacaaaaatccagcaaggtgggacaaactacgacatcgctataccaagtgaatatatgatccaaaaaatgatcaaagaaaaactagtacttccattagatcattcgaagatcaaaggattaaataatattgatccacgatttttagacttggattttgatccagataatcagtattcgattccatatttttggggaactttagggatcgtatataacgataaattctttgatgcagatcaaattaagcattgggatgatttgtggaagccggaattaaaagacagtttgatgctgattgacggtgcacgagaagttatggggctttctttgaatagtttaggctattctttgaatagtaagaatatggcacagctgacagaagcagcaaataaattgaatcatttaacgccaaatgtcaaagcaatcgtggcagatgagatcaaaatgtatatgatcaatgaagaagcctccgtggcagtgacattttctggcgaagctgccgatatgatgtgggaaaatgaacatttacattatgtgatcccaccagaaggttccaatctttggtttgataatatcgttatgccaaaaaccgtgaaaaataaagaaggtgcctatgatttcatcaactttatgctagaaccggaaaatgcggcacaaaatgcagagtatattggttattctacaccaaatgaaaaagcaaaagcgttattgccaaaagacatttcgtcggacgaacaattctatccatctgatgacacgatctcccatcttgaagtctacgaagatctaggatcgaaatacctaggcatctataatgacctattcttagaattcaagatgtatcggaaatagcgagaaaataagcaaatttgcataactataataaaaaggacttagttttgatgggaaatttttcaaaattaagtccttttttatgtggttgaaacgggtatgatcattttaaggaagtgatctaagatgaaaggacgactgaataattatcatattagaaaagctttattgtattccacaaacaaattactaagaataacaaattagtttttgtttgttcttattccctattgacttttctttcaaacatgctattctaattttattctaatagtatccgatgagaaggaaagtagacagaaaatggttcaagagaggctttggttggtgtaaaaagctagaagttgactgtcgaaaatggccttagaggattttttgtcgaaaggtaggcaaaaacgaacagtctttcgttaccaagaccactgattttattgtcaggctgagagaaagaatgttttttctgaaaaaaggtggtaccacgagtataatcgtccttttactagtatttgctagtaaaaggattttttttacaaaaaacaaagaaaagagtgagtgaaatgagcaaaaatagaccatttacagtagatcatgtcggaagtttcttacgcccgcaatcgatcaaagaagcaagaaaaaaagttcaagaaggcttactttcaaaagaagaacttcgtgcaatcgaagaccaggaaataaaaaaattagtggaagaccaaaaagcagtcggcatcaaaggaattacagatggtgaatttcggcgtggattttggcatcttgattttttagaagaactaaatggtatcgaaggctatgttccagaaactggatataatcaaacattccacggaaaagcagcaccagcttataatattcgggtagtagataaattatctttcaatccaaatcacccatttttaaaagattttgcttttctgaaagaagtagtggaaacagatgatacttttgttgcaaaagcaacgatccctagtcccacgatgattttacgacaagagatcctatctaatgatggttcttcaaaaatcaaggagatttatcctgatctatctgatttttatgaggacttgtcctctacttacaaagcagcgattcatgctttttatgaaaaaggttgccgttacctgcaattcgatgatacaaattgggcgtttctagctgatcaaactaaaagagaagcacttcttcaaaaaggaattgatccgaaagaaatggcccatatttgtagagagattatcaataacgcactggaagacaaaccagaagatttgacgatcacaacacatatctgccgcgggaatcacgcttcttcttggctgttttccggtggatatgaacccattgcagaagagttgttttcaacaaattatgatggtttctttttggaatacgattctgaccgagcaggagattttactcctttaagacattggagtaacaaagaaagtaaagttgttttaggattagttacttctaagtttccagatttggaagatacggagaaaataaaagaacgaataaaagaagtacaacaatttgtaccattggaaaatctaagtatcagtcctcaatgtgggtttgcttcaacagaagaaggaaaccatttaacagaagaagaacaatggaagaaaatccaattattgcagcaagtcgcaaaagaagtttggctataaaaatgtgaggcttggcaaaaaaaagcgtcccaaaaagtcggcttttcatggagtggagaaatccactcttttttatttaccttttatattatttatttgttaaataaataggaacaaaaaaattaaattacttaatacacacattagggatcattcattgaaggatcagaagacaacgaggatggcgaaaaatatgattacaatagaaaagtcgttctaaacaaatcagttcctagtatcacacaacgcaagccagtcgatttggtgagattagaggagtgaaagcaaactttattatataagaaaaaatattcgaaagggatgctagtttaggtactagtgctgatgaattaatatgatgcctcgtaatattaggcgtagttactctagagacatcactatggactatgatttgtctcagagtcacaacatgtttttttatgaaaagaaacagctaaaataattaaattgcgcaatgtttaaactttcttaaactataacctaataaatgtgaagaaataatgcacaatttcttcacatttatcttctattctatgtacataccaaccaacaaccctatatactttttcatttttactcctcaagtaaaaataactcctagaccgcggctacccaccgcggtcgtttttttattcttcaatcaaaatcgctttgatacccaaacctgccaagattcgggcagaagtataagtattcaatcctcttctgaaagtaatgtaaacttttttatcttttgggatttcattgattcgatctcgtaactcattcattggaatattttttgttgccgtgatactgccagaaggtgctttattagtttcacgtatatctaaaaagaacgcttctttcaaatcgttttcgggtatatcacttgctttgatcgtttctacgatattcgtcatttgattgattgcgacataaccagctatattcaacgggtcacgggtagtagaatacggtggagagtaaggcaactccaaatcaggcaaatcaaagactgtcaagtttccggtgatcgctatagaaagttctcccatccgtttatcgacacctttttctccaaatgcttgtccacctaaaatacgaccgctatctgcatcaaaaatcagctttagatttaatcttgtagcttctggatagaaataggcatggtcaaaaggagtgataaaaacagttttataatttgttatgcctgatgcttttaatgcatgttctgtcattcccgtataacttgctgtatgatcaaagatttttgcgacacctgcaccaatatatccgcgatagcgcataggcgtaccatttaaaatatctgccaacatatgtccttgacgattggccgcactggaaagcatactttggatcggctgaccagtcactacactagtcgtttcgataatatcgccaatcgcatagatgtccggcagattagtttgtaactggtcatcaacaatgatctggcctgtatctgataattgtatgccggctgctttcaccacttcattattcggagaaacaccaacagcaaagattagcatatcagcagaaaggacggagccatctgataatactatttctcgacctttatcacggatctcagtaactcttgtttctaaatgaacggctaatccttctttcagcaatttgtcataaactaaatcagcaatttctggatcataagggaaagcgacttgtggcaattgatcgattaaagtcacgtctaagccgcgatgcttgaaattctcagctaattccagacccataacacctgcaacaagaatgacgacatgttgtggatttttttcttcaaggaacgatttgattcgatccgcatccgtcacactacggaggacaaagccgttttctgcttcaaaaactccgggaatatccggataatctggtctagcaccagaagagatgatcaacttatcgtaatctgtttttgtttcttcatttgtggataggtctttaactgttaattgcttagtagaaggatcgattgctattacttcgtgtttagtaaatacgtcgatgttgttttttgttttcaatatttctggtgtacgttcgatcagcgagtcacggtccgtgatcacaccacctaaataataaggcaaagcacaacttgcgtaagaaatattctctccgcgttcatagataatgatttcgtgtgcttcattcaatcgacggaaacgagtggcaaatgaaggaccgccagctacaccgccaatgacaacaactttcataaaaacatctccttttctatgttgatcgtactatgttatggcaaaaaacagcaaataattgtgccggaaaattattgtttattttgtcagtagagaaaaatagtaagaaaaaagagaacggtttcgctatgtttctgcataaaaaagaaagaggctatgacaacagtactgtcacaacctctttccattggcttttaattctcgtattcttctaattccaagcttagttcttcccattccgacaattttgtttcttgatcttgtctagctgattctaaagcttggttcagctcattgagttttacgtgatcttccagattttctggtgcgaccatttcttgttccaaccgatcgatccattcatcgatccgcgtcatttcttcttcaacctgagtgatttttcgttgaaggctgcggataagcttttgctgttctttgctctggtaataatcggatttattcgtaggagcaggagcggattctggctcatcttgtgccaataattcggcgatttcttcttcttcctgtttcttctctaaataataatcatagtctccaagatagactttactgccattttcagagagttcgacgacttttgtcgcgatccgattgataaaatatcggtcatgggaaacaaaaagcagtgtgccatcgtaatcgatcaatgcattttctaatacttctttgttgtcaatatctaaatggtttgttggttcatccaaaatcaaaaaattttctttgttcatcgctagcttggctaaagcaacccgtgctttttcaccgccgcttaacagagggatcggtttttctacatcttcgccagaaaataagaaagcacctaaagcacttcgaatgtctttttcaggagtggtaggatgctcatcccacaattctgctagaatcgtcttgtttgtatgcagatcagcttgcccttgatcataatagccgatggtgacatttgtccctagcgtttctttgccacggataaaagggatctggtggatgatcgatttcagcaacgtcgattttccgataccattcggacctactagagcaatcgcttcttgtcggcggatatccaaattgattggttcagataaggtgacatcatcatatccgatagcggcatcttcgatttgcaagacaacatttccagaaggtttttctatactgaaaagaaagtttgcttgtttctcatccccttgaggacgatccagacgttccattttttctaatgtctttctgcgactttgcgcccgtttagtggtagaggcacgaacaagattccgagcaacgaagtcttctaatttgtggatctctgtctgctgcttttcataagccttccattcacttgtcagctgttctgctttcaagtctagatacttcgagtagttgcctttgtaatggcgcatttttcttctgcttagttcataaacttcattgactactttgtctaagaaataacggtcatgtgaaacaatcagtaatgcaccggtatagctttgcagataattttcaagccaggaaagcgtctcgatatctaaatggttcgttggttcgtctagaatcaaaatgtcagggtgttgcaaaagcatgcgagctaaagctaaacgtgtacgctgtccacctgataaagtatcgattttctggtcataaaaggaagaatcgaatttaaaaccatgcaatacggaacgaatttcattttcataaccatagccgtttcgatccgaaaaatcgtgttgcaggcgatcatattcttttaaataagaagtataagcgggtgtatctggcgtaccttcgctaatgaaaatctctagttcgcgcatccgctgttccatttgtctaacttgttcaaaagctttcagcatctcgttccacactgtttcattggaatcaagtcctgtgtcctgagcgaggtatccgagagtcgctgttttatttttagcaatctttccatcatctggtgcttcaattccagcaatgatcttcaataaagtcgattttccagcgccatttctgccaactaaagcgacacgagcgcctgtactgatttctaaatgtatattttcaaataagacttctgcaccaaaatggcgagcaatctgattggcttgtaataatatcatggaatcctcttttctactttgtgaattctcctcaaataaaaaactatttttcaattagtagtctaccataaattccatcatactgcgagatttgcagaaatgataaataaatgaataaagaataaaatttcacaataactgagcaatggaattgattttttcctataaatactgctatgatggagaaatcaaagatgtaattagacaatacgtggaggtcatttcgtgaaagatcatattattccaaaggcgacagcaaaaagactgcctttgtattatcgttatttaaggattttaaataatgctggaaagaaaaaagtgtcttcaactgaattaagtgaagccgttcaagtagatagcgcaacgatccgtcgagatttttcttattttggcgaattaggaaaacgtgggtatgggtatgatgtagaagatcttatgcacttttttgcgaagacattaaatgatgatcaattgacaaatgttgcgctgattggtgtagggaacttgggaagtgctttactaaaatataaattccatcaaagtaatagcatacgcatcagttgtgcttttgatgtgaatgaggaaatcgttggacgcatcgtagacggtatccccgtttatccaatggaagatatgtcggaacaaatcaagatccagcaaatcgaagtagcgattttaacgattcccgctgaaagagcacaagaagtagtcaatcagttaacggaagcaggaatcaaaggaatcttgaactttaccgctgctcgattgaatgctccgtcagatgtcttgattcaaaatgttgatttgacgaatgaattgcaaaccttaatctatttcttgcattctgacgcaaatgcgcattccgaaaatacagcagaataaaaataaaaagcgattgaacaaatgaaggcaaaactttcacttgttcaatcgcttttttctgtttggataatgattattctgttcgaaagatttcttcataagaaagagagtcatcttctgctgtcagttcatctagtaaatgccagatttttttaaagtcgatgaaccgcgcttgccgagagatctcttttccatgatgaaaaatcagaacaactggcgcagtcaatacttcaaatctgctagctacttctggtgtttcgaatgcatccaaatgaagtgctggaatatcataatgggtgagcagctcctccaatcgtggacgaacagcgtgacaaacactgcaattaggcatcgaaagataaacgatggcaacggatgattgttgcagtatgtcttgaacttcagacaagttagtggtttgtttcattttcattctcccttttgtaatagaagtgatatgtacgagatcttaatttaatgggaataatagaaaaagtcaattgaattgcttcgataaaaaataagagttgtgtaaaaattgacagagcaacttgtttttttttgaataaaagcgtatatttgcaaagcgaatgaattagaaatgaaaaggaggaaactcatgttttcttttattcccaattcggttttgcagatgagtacgattttcttatcgatcgttatcgaagcattaccctttgtactattaggttgtcttatctcaggcgccttacaagtatttttgaccccagaacgtgtgaagcgatggcttcctgaaaatcgtatattctctatttttactggttcgatcttaggatttttctttccatcatgtgaatgcggcatcgtaccaatcgttcatcagtttgttaaaaaaggcgtaccagtccacacagcgtttgcttttatgctgactgctccgatcatcaatccaatcgtgattttttctacttttatcgcatttggcaattcttggcagatggcaagctggcgggtgataggcagcttttttgttgcccttgtgattggtgtctggcttgcctattttcaaaaagacgctgtattgaaagaaaaaatctcctctaaagtagtagaagaacaccatcatcatgtccatgaagaagaacacggcgataagaatgaaccaaaaaatcggctgatccatcaaacggggcatgtgctgacacattcaatcgatgaattttttgatacaggtcgttatttgatcattggtgggttaatcgcagctgcgatgcagacttatttaccaactagaatgatgctaacgctcggatcaacaaagattttagccatcattatcatgctgttattagcttttacgatgtctctttgttcagaagcagatgcgtttatcgggtcttcattgttaagtctgttcggcacagcacctgtagctgcctttttggtctttggtccaatggtcgatatcaaaaatctattgatgatgaaacgatattttacaggacgttttattctatcgctgatcggactgattgcccttagcgttgttggattcacattatttatttaggaggaaaaatatgctgcggtttttgattttatctggctatttcgaattgatgatgtatttgcaagtctctggcaaacttgatcaatatatcaatgtccactatcgttatttagctattctttcgatgattttatccgctcttttggctttagttcagctgtatttgtgggtcaaaaacggaaaagcagaggaagagatgcacgagcatgatcataatcatgaccatgggttatcaaaaccttatcaacgtggaatcgcctacgtactgcttgctttgccagtgatcgttggtacattgtttccaacagttagtctggatactacgatcgtagaagccaaaggatttaattttccggtaagcaaagaatcagtaggggacccggagatgcagacgcaatacctaaagccagatacaagtatttatttcaacaaatcagactacttagaccaaatgaatgaactgaaagagaagtatggggataagcagactatcgagatcacagatgaaaattatttagaagtcatggagctgatctataattaccctagcgaattcattggcaaaaaaatcagctatgaaggatttgtttaccaaacaccgaacgatagcaatgcagatgtcttcttgttccgcttcggtattatccattgtgtggcagattcaggagtctttggcttgttaacacatatgcctgaaggagtaacggttaaaaatgatgagtggtataaaatagaaggaaccatccaatcggactattatcaaccattcaagcgtgaaattccatctgtagttgtgacaaacgcagagaaagtcgctgctccgaaaaatcagtatgtgtatcgttctttttaaaagaaaaaaataaatgaacatagctcagacagttgacgtgtaaggacgtcggttgtctggctttttttgtatgagatatttggctatttgatatgttttgtaaaatgatatttattttagaagttgcatgctgaatgtagttaatagcggtttcaaaggtgttggaaaagattgtgaagagaattacaatttattcctaacatgtatgttgaaaagttgtatgaaatgattttgatagtaaaatatcgagtggaggtactttgtatgataacacgtatatttattttggatgacagtttggtttttgaaaaaatgatagaagatattttggaagaatccagaaatttactgattccttggaatttcgagataatcaagggattgaacgtcatgcagtttgttgaatttgtcaaaaacaatgacattcgttcatcggatattttttttcttgatatcgatttgaacgcttatcacagcgggattgaactaggagaaatgcttagagaaaagaacgcgaagtgtaaaattgtttatttgacctctcatccgaataaagcaatagctgttattaaccgaaatattacgcctagcgggtatttgataaaagaattcacttatgaaaaaaataaaaaaaacatccaaagttacttattgaaagaaaaagagaacgagcctgttcaacaagcgaacaaaaaaaagtggacgtctgttcgttatggcaatagcgatcattatatccattacgatgagattctttatctaatgagcatgccaggctataaaaataagataggcttggtattgaaagacgaagagacactcataaacggcacaataaaaaaatataaaaaaacactggaatatgagtatttatgtaaagatttaaaagcctacatcattaatactgaaaacattacatctattagccgagtaaatgaagtagtaacgtttacgaatggagaacaactagagatgggtaagagaagtattgataaactaaagaaatttattcaagaaaagataaggaatgaatcattttaaaaaattaaaaataaaggatcatatctcactttttagtaaacagacttaagttaatcatgcaagttccttcttccattttgtttctctaatactcggaccaagatgctgatctcaccccttctactaaacagtgttccagaagtagcttcttcgaaaaataagataggattcacaaaaatttaagaaaccattttcgtgaatcctgtcttatttcgtgaagctaatcacttctgtcacaaccttttctttgttacacttcgtttatttaaaaagccgtttttttcgtttcaacatgatggcatcacgctttactttgaagttgcggatgttatggttaaagacttccgataatacgagacctaaagcaattgctccagctatcatgattgcttggaccgcatagtgagctgcttcttgataggattcagtaacgagattccgaaccgcttgataagccaaaccacccggaactaaaggaaccatcccaggaatattgaaaatcgttacaggcattctcaaacgcttagagaaaagatcactgatgaatgcaactcctaaagagccaagcaatgaaccgaaagcagcagatccgcccatttgaacacagatccagtagatcatccagccgaaagcaccagaaagaccacaacaaatcaatgaacgcctagggacatttgtaacaatggcaaatgccgcagtcgctaaaaaactaaaagaaaattgaataaatatcgtgcccatactcgtgctcctttcttaataaaaaagctggaaaataaaagcaatcgcaaaaccaatcatcgtagcagtcatcatcgcttctgttccgcgagaaacccctgacacataatgaccagctagcaaatcacggatagcattcgtaatttgaaccccaggaaccaaaggcatcacacatccgataataattaaatcctgattgcttcctaagccaaaacgaacactgtagatagcagctatgccaatcaataaagaagataaaaattccgataaaaatttgattctaaaaaatttcaaactatacagataaactgcgtatccccatccaccaataattaaagtcacaggcaaatcggtcatctttccgccgaataacaccatgatcgttccactgataactgccgcactaacgatctgcaaccagacaggaaagaacgaacggtctcggtcgattgcctgcaattcactgtaaagttcttctaatgttagttctgaagcaacatacttacgtgaaagatcattcacttttactactttttctaaattgatcgaacggttggtgatttgttccattcgaatggtcgaggtacgatcaagaccaataaagagaccagtctgcgtgacatagctgaccaaacggaaatttccagaagctaaagcaatgcgactcatcgtatcttctacccgatacatctctgcattgctttccatcatgattttcccagcgagtagacaagtgtctagcagcagatctaattcttttcccgtcatagcatcttctccaataattgattgattagttatattttactacaaaacatatcgaaagcgtaaagaataaaaaaacttgaggaaggagtgaaagaggcgtatactgtttttgtatcgcgggtgtagtttagtggtaaaatcccagcttcccaagctgatgtcgcgggttcgattcccgtcacccgcttaaaagaggctgtgaaaaagctgccctgcatcaagtaataagaatagtcaagcaaaaaagcttcttatgtttttgacttggttggacttattaccgcagatgcaagcttttgaacactgtttaccaagaggtcgtacagaagccgtttagttttgagtattaagaaaaatttttttaatgataataaataccttgtaaatagtgttttgtgattgagtagagacgatgaatccgtctcttttttgtattcttaagccgtctaaaaactggttttatttttttactgtttctatttctttccagtatttatttataggggaacatatgttaagatttagggagctgttagtaaaggagtaaagaaatgagcaaaaaaacaaccaaggcgatcgtggggatcgtcgctgctgtgattgcaggggcactcggtatttccaccacacaaaaagattcagatatcttccaacaaattacaaccatttttgattccacaccgcaagcttctcaagtagcggatgtgccagaatatgatggaaaacatcaagaaatagaaatcaatgggaatcagccggagtttacaaaagaggatcttagtctttccaaagggacatgggaaagctattcaaatatagacaaattgaacagagtaggacaagccaatgcgatgttgggaaaagacttgtttcctactgaaaagagagaacctttgtatattgatccgacaggttggaaacaaaagaaattaagtgacggacaatggttatacaaccgcagccatttgattggtttccagttgactggtcaaaataataacattaaaaacttaatgacagggacacgttcgttgaatgctccgtacatgcttgcccacgaaaatgatattgcggcatatatcaaggaaacaaatcatcatgtacgctatcgtgtcactcctcatttcgagggaaatgaactggtagcaagaggcgtgcagttggaagcagaaagcattgaagacaaaaaaattgaattcaatgtctttatctacaatgtccaagatggctacaccatcaattatgagacagggcaagcagcgaaaacgaaaaattagtagcagcaattcgaattttttatgaactttatgaaaaaattgtgtaaaaacatactttcaaagaaatatagcgtatactttatggaaagagggcttttgaaaaagccacagaaaaaaggaaaaatcagacaaatcgtgtttcttaatttattcagaagtttggaatatttgtttgtagttttccctttcttcgagtaaaataagggtgtagaaggtaagctggaattaccttgcgggaaagaggtgtagaatcatgggttttacagatgaaaccgtacgttttggttttgacgatagtcgcaaaaaagaagtgagcgaaacattagcgattgtttatcgggctttggaagaaaaaggctacaatccaatcaatcagattgtcggctacttgctttctggagacccggcctacattcctcgttatcgtgatgcacgaaatttgattcgccgtcacgaacgcgatgaaatcatggaagtaattgtcaaagactacctctcaaatcatggagtgaatttatgagagtaatgggcttggatgtcggttctaagacagtaggcgttgctgtgagcgacccctttggctggacagctcaaggtgtagaaatcattcgaatcaatgaagcagaagaagagtttggctttgatcggttgaaggaattagtggcgcagtacgaagtagaccgttttgtagttggattacctaagaatatgaacaattccatcggaccaagggcagaagcttccatgtcatatggagagaagatcaaagaactattctccttgccggttgattatcaagatgaacgactaaccactgttcaggcagaacgtatgctagtagagcaggcaaatacttcaagagcgaaacgaaaaaaagtcatcgataaattagcagctgtgatgattttacaaaattatttagacggctcaggtaagcaattattttaataataaaaagaaaagaggtaatcttatgacagaacataaccattcccacgaacacgaaggacacgaacacatcacattggtggatgaccaaggaaatgaaacattatacgaaatcttgctaacagttgacggacaagaagaatttggacgtaactatgttcttttatatccagctggtgtttcagaagatgaagatgtagaattacaagcttatgcatacatcgaaaacgaagatggaacagaaggcgagttagaacaaatcgaaacagacgcagaatgggatatgatcgaagaagtattcaatacattcatggcggaagaagaagaatagaataaaagaatcgataaggtgtaagaaaagctggactctctgaaaagtagagcccggttttttcgtttagcactaaatttccttaaaaagtagaaaagctttcgaagcctcgtttgtttcttttactgtataataaaagaaaagagtaaaaatcgctaaaagatataaacaagagaaaggaaatacaagatgattggtctgatttattttgtggtgatcgttctggcgaacacagttggcgctatttccgggatgggtggaggcgtgttgatcaaaccgattcttgatcttatcggtgcccattctgttgcagggatttctttttactcaacagttgcggtattcacgatgtccattgtttcgactgtgcgacaagtatcaagcgggaaatcactgaattggcagattgtcggttgggtatctagtggagctgttgttggaggagtagtcggcaacattgtattcgaagtttttttacagttatttgaaaacgagaagcatgtgcagctgatccaaatttttttgacggtattgaccttggtttttgcgttcttctacaccaagcatcatcagccaaaatttcatttgacgtcatggacttggtaccttatatgtggggtggttctgggctttttagctagttttttaggtattggtggtggaccagtcaatgtttctttgttgatgctgatgtttgcattgccaataaaagaagcaacactatattctctatctacgattttcttttctcaactggcaaaattggtaacgattgctttaacaagtagctttatgcgctttgatttatctatgttgttttatgttatccccgctgctgttattggaggtttgtggggagcaagatttagcaggattttgtctccaaaaaaagtgacctttatttttcaagcgattgtcatcgtggttcttttgatcaatctttacaatgctttcgtcatcttgcaaacattagaaggatctggattcaagcaagtcaaaatcactgaaaagtctttttttaagtgaaaaaaggagtatactgtgataaaaaaattcatttaaaaaaataaaaattggctggtgatttggatgttgcgggaaatgcgtttaggagatgcagaagcactacgagaaatcaatgcggaacaattagggtatgatgtaccattaaccgttacggtgagacaaatgaagaaactgttgaaggagccagaaaaaaattttttcttggtttatgaagatcctacttctaaaaaagcagctggctatgtacaagcggagtcctatgaatcaactttcagcgatccgatgttcaatattatggcacttgctgtgtctaaacatgctgaaaaaagaggaatcggaaaggccttgatgactggcgtagaagaagaagcgaaaagacgaggaatatcagcaataagacttaattctgcagaatacagagtagaagcacaccgattttatgaacgcatcagttatcattccgataaaatgcaaaaaagatttttgaaaatcctgtaaatttttatcaaaaaatacctgatcatcaagccgatacttgatgatcaggtatttttttgactaagaaagtaattgcatcaagaaacctgagatgatcaaaacgatggcaccaccaagccgattgcccatttgagcaaaagcaataagttccatccgattagctgcagataagacagctacatttcctgtaccacccatcgagttgttgcataagccagcagtaatagttgattcgattggatataaaccaaacaaacgaccgacaaatcctgaaactactgaaatcgcgataacacttgtcaaacataagacaacaaattgccatgtcaaagcagaagccaatacatttagattcaataacgcaataccgataccggcaagaacagctgctgtcaagtttttgacaatcaagttgttgaacatgatagctgcatcttcgtaatattctggtaataggtttgcgattttacagataacaacgataatgatcatgaatgcgtaagcatggactttaggaacaaaatagttaccgatttgtcctaagatgaagaaagtcaatgataccatcaaaccgacacctaattgtggaatggaaggttttacatttctaggttttccatcgccaaggtctcctttttccattaatttaccattaccgttgaattttggcattgattgtcccgcacgagcaactaacgctgcaccaatgatagctaggacatttgtcattgctgtagcaggaatcaggcgggaaatgatagaagaagcgtccgtacctaaaacatttgcataaatcgtcgataaaggtacagctccggctccaacaccaccagccattgcgggcaatgagatatataaaacggaatttgcaaaaccatttccgataagcatacctacgagtcctacggcaaaaaaggagacgaccattgaaataagtgcaacgggaataaaacgaacagaagctttcatcaatagattacggttcataccaaggatgctaccagtaatcaaggcagcaatataaaagtctaaaaagcccatattgctgacaaagttttctgtggattttactacatactcaggtaagatcccaaatgtagcaatcgcggcagaggcaaagatcgcaaaaacggagccaccacctaaataacttttgacgatagggatttttgttccgataaaatgaaataaattaccgaaaatgaccaaaacagcgattgggccaatcatattcgtcggtaattttcctaaagccattgcaatgatcaggacaaggaccatgatcaaataaaggggcaaacttacgccggtaatttttgttgaccaaaacccttcttttttcttttcctcaactgcagttgcagttgttgttttttgtgccatttttacagatcctttcttattctgtatcgtatgaaaaaagccaaagagaagcggcaaaagagcagtagttggctggctgctgttttgccgcagtcgcttttttctttttagacgtcatacaaagtttctgtatgttcttttactataacaatcttaatcttctaaagatttatattcaggaacccatttagcagattcaacagcttctttgatatccgtgatttcttcacgattcaatttttgtgcaacaactgattttgcgacagtttcagcaatcgtttgagagaattcagtgatttttgctactggaggcaagatagctgctcctggttttgttacatcaacgattccgcctaatgctcgactagcttgagaaatgatttcagcatttactcgtgtagctgttgaagcaatcaaaccaagccctaaacctgggtacatcaacgcattatttgcttgaccgatttggtaagttacaccgttatattccacatcagcagcagggatacctgttccaactaaagcttttccgtccgtccattcaatcaaatcttttgcttttgcttctgccaattttgttggattagacaaaggcatgatgattggacgtggggtatgagccgccatttctttcacgatttcttcagtgaatgctccaggttgggtagaagtaccgatcatgatcgttggatggattgcttttacaactgcttctaagtttgtcaattcatcagcattagtgaattctgagcgtttacgagcgaatgggatttgaccaggagtcaacccttttgtatcttcaaacaataaaccctgtttatctacttgatagaaatgttggcgtgcttcttcttcaggtacaccttgacggatcatttcatctaaaaggatgtttgcgatacctacaccagcagtaccagcaccaaatgtcaagatcgtttgatctttcaattgctcacctgatatattcaatccacctaatacaccagctagtacaacgattcctgtgccttggatatcatcattgaaagtagtgattttatcttcgtatttttctaaaatcgttgcagcatttcctcgtccaaaatcttcccaatgtaataacaattctgggaataattcagtagctgattgaacgaattgatcaatgaattcgtagtaagtttcgccttctacacgagcatgacgattccctaagtataatggattattcaataattcttcgttattagtaccagcgtcaatcgatacaggcaagacttgtgcaggattgataccagctgcagcagtgtagaccatcaatttaccgatagcgatgtcaacaccgttcacaccccagtcacccatacctaagattccttctgcatctgtcacaacgattaaacgaatgtcgcgtccatctgctgcgtttttcaaacttgctttgatattttctggttcgtcgattgaaagaaatgcagcatcttgtggtttcaagaaaatttcgttgtattgttcgattgaatccgcaacgacaggatcataaacgacaggcatgaattcaactaaatgttcgcccatcaatttataaaacaatgtccggttcgtattgaatagattcattaagaagatacgtttttccaaatcggtctgtttgcttaagtattgaccgtaagcttggacagattgttgttccaatgtttggacagtacttggaagcataccagtgattccgtattttgcccgttcttcttttgtaaaagctgttcctttatttagaaaaggattatttaataagtttagccctgtaagcatgaatgattcctcctaagttttaatacaaacgaagtataggagtcagatgaggatatagtcaaaaagagcaggtataataaattttatttatatgagtaatagagtcaaaagaaatcaaaatagcggtatttgttctttttatatcaacaatccttgcttgattactatgcgtatctcttatatgctaaagaaagaaaagtagaagaataaaagatatgttaataaatagaatctctgaagaataaatcacgtgatcgtgacgataaagttcacttacgtcaggtgataaaaaatacataagtagaaaactaagaggaggatcagaaaatgaaagaagttcaattgatcagaaaaagcgaactatcagaaggtggttgcaatgcatgcggcgtagtagaagcaacaagctatacattaaagcttggtgccaacaaagcgataatctctgagttgacagtaggcggtcttgtggacagtctggcgcttgctgaaggttttattggagaagatatttatgagatgttttcagaaatccgtcagttaaaaaaaggggaaaactgcatagaggttcatcatgagagcccgaatgtgagagattcaaacgtggtgataatgagatgatcttcaataatcatgtgtccgatcacaccgagctatatggaatcgtgaatcaaatactaactgagctttttggattgggaccttatgcgttcaaggaagaaaacggtaatccaaaattaaacgaagaatggcaagaaacgattgaaacacaaagaaacaacccgcacttatttcaataggcatccacagtatttcgtaaaagggactttgacacgacttttgtcaaagtcccatcgttttttatctatttgtgttctaaacatttctttcagagtagtaacaactggaatgactgaaatgtaaacagattatttgcctgtatcaatacggaagagtaatataaaatgtgtaaacgctatcacgttattcattcaattttttatagagggaaggcattgaaatggaaaaaacgtatcaagcaggtacaaatgaaggaatagtggattttatcaatatggaagatttagaaatagccgcttcacaagtgattccagctggtggttatggttacatcagcagtggtgctggcgacttatttacttatcaagaaaatgaacgggcattcaatcatcagctgattattcctcatgtattaagagatgtagaattacccgatacaactacacattttgacgaagaaacgctgactgcaccaatcatcatggcaccagttgctgctcatggcttagctcatgtgaaggcggaaaaagcttctgcaaaaggtgtagcagattttgggacgatttatacagcaagttcttacgcttcttgtacattagaagagataagagaagcaggcggggagaaagcaccgcaatggtttcaattttatatgagcaaagatgatgggatcaatttggatattcttgaagtggccaagcgtaatggagcaaaagcaatcgtattgacagcggatgcaacagttggcggaaaccgtgaaacagaccgcagaaatgggtttaccttcccactgccaatgccgatcgttcaggcttatcaatcaggagtaggccaaacgatggatgctgtgtacaaatcttccaaacagaagcttagtccaaaagatgtagaatttattgctgctcattctgatttgccagtctatgtgaaaggtgtccagtcagaagaagatgtctatcgttcattagaatctggtgctggcggaatctgggtatctaatcatggcggccgtcaactcgatggtggtccagcagcgtttgattcgttgcaatatgtggcagaagcagtagataaacgtgtaccaatcgtgtttgacagcggtgtacgacgcggacagcatgttttcaaagcaatcgcatcaggtgcagatcttgttgctattggcagacccgttatttatggattatctttaggaggaagcacaggagtccgtcaagtgtttgatttctttaaaacagaattggaaatggtcatgcaattagctggaacacaaacagtagaagatatcaaaaaaataaaattgcgtgagaatcgttttatttaagatacaaataacgaaaacaataggagtgcggcagttgatgccgtactcctatttgtatgggtcagagaagcattaatagaataagttgaaatgaaaaaaagaaaattgaaatgttttttcatacttagtaaaaaaataagaatattcatgtaaacgattttattgcttttttctcttttatacaaaaagggtcagaatttcaagtaagcggatgaattcatgaggattttttgcatgctgtctctactatacttaggtcactaagaaaaaggagtgatttattatgaaaaagaacatgattgggacattattactttcaacacttcttctaggcggcttggcaaccccagcttttgctgaaggtcaagcaacttcaaaaggagatattacctttactgagccaacaaatactgtcgtaccccttgatcctactgatccttctaaaccagtagagccggcagatcaggaaaatccaggaactggccagacaggtcctttaacgctggatgtagtgcccgagttgccgtttggtacacacgagattgaaagcggaacaaaaacatatcaaatagacgcttcaaaaaatgatacaccttatctccaagtatcagatcgtcgaggtgtaggtgcagacgggcaagcacaaggatggaacgtaacagtttcggtttcagattttgtaaacggttcacaagttttgcaaggggctgaattggattttgggacatccactgtgaaaagtacctcagataacgaagccactgcaccaactagtcaagctgtgactggattaagtaaagcaagtgcagcgacaccaatatttacagcagcaaaagaccaaggtctaggaacatggctttctgtttatgatccagcaaatatcacgctgaaagtacctaaagcagcagctggaacattcacggctgatttgacttggaacctcgtggctggaccagtagcatagaatatgaaataaattcaacaaactgcggtgaaaatactatggatgaagaatctttttaccgcagttgttgttgaaaggatgtggtggacaatgaatcaaagtaaacgactgtttgtttcgtttttttctattttaagtctatttttcatttttccgtcaatcagtcaagcagaggattcagcaggagactttgggatcaaaccggtatttccagagaatcaaatagataaagcaatcggttattttgatttattagtggcaccggaacaaaatcagacactggaagtaattatcagcaattctttagatcaagaacgaacatttgaggtctctgttaatccggcggtaacgagtgatggtggaacaatcgattatagtcaaaaaaatccaacgctagatgggaccttgccgtttgatgtccgtgacgttttgaccgttgccaaaaaggaagtcaatgtaccagcgcatgctgaaacaactgtacctgtagaagtaaaaatcccagctaaaagctttaagggacgtgtattagcgggtattcatgtttcacctaaagaagaagctgaaacagaaaatgctacagaaggtgcacaaataaaaaatcgtattgcttataatctcgcagtcgttttacaagaaagtcaagagacgatagaaccggatctgaaacttttatcaggagatttgaacgaggtcaatgcaaagcccactgtccagcttcgtttccaaaatcctcagcctacgattatcagcaatttgatatttacgagcaagatctattacgaaaatcagctttatattgaaaatacgtctaatgcatttttagttgcaccaaattcgaattttcacttgaatcttgatttagctggtgataaagcaaaagccggcgattaccgcgcagaaatcatagcaaaatcaggtgacagtaatgaatggcgatttacacaaaactttacgatcaaaaaagaaaaagcacagaaagtaaatgaaaattccgtttttgcagtacaagaacaatctttcccatggctttatgcaggattggttgctgcagttcttgtattactgttgattttgctgtttttgtggatccacaagaaaaagaaaaaaggagaaacaacacgatgaggtgatttcgttgaaagcatcaatcttattaggagggattattgcaagtttgctgttcttcagctggcaagagccagtccaagcagataccgaaagttcaggcacgattacattttatgatctaagtccagttccgcatccaagtggttcagtcaatggcacatcaaaacagcagacacagccatcgatttataaagaggctaatcaacatggcgtatttccggagacgaatgaacaaaggatccgttttctttatttgatcattggtatagaattatggcttcttgtgtggttgttgttatggagaagaaaggaaaaggaggatgaacatgttgctacaaaataaatttacattttttcgctccttcttttttacttcgctttttgttttaagtatatttatcttttcaccttcggcagaagctgttggagcaacgcctcctaccatttcttatgatccgtacacatacgaaaatatcgtacctccaaatggtggacgtagtgcagtgaatggcgggaagcttgttcaactaattggggctaaccagttgcctaaattgactgctacttatttaaacgatggttcaaatgatccttggaaaggtggcacggtccgttttcattgggaaagtcatggatcgtatgttcaattcgattttagctccagcagcaggtagattttatcctaaattaactggtggaaaattgaatccaggagcgtatgcattttctgcaagtgcagagataaatacgtggaatagttacatttcaccaagtgattcaacaggaaaatataatacatttgctgatactacagaatacgtggatgggaataaccagaaccttccaggctcaaccaataatcgaacactaacgatggggttgactgaaggacgttttgatcaactaccatctactcgctttgatcgagtagtcaattattttacaggaaaaaacgtcacacaaggagcaacactgactcatactccagcaagcacaagtggattgaatcagtcaaccaatattgtatatagcgggaaagatgcgcaaggtggattgctttctcccgttgctttaaaggtattggagcagtataagctagacggtacggttttaccaacaaatttaacagctgatagtcagtggggaaagctcctttctcctgcgccgtaccaagtcatggccaattggtcagcaactgaattaaaaacggggtcgatccattacaggctttattcgaaaggaacccaaaaattagcggcaggatggacagatcaacttttccaaacgatctcatcaaataatggcggcacaactacagctacttctacactacctgcattggcttcagggcaatattattttgattatcgtttggtggacgatgtacttactaacctgtatccttcttttgcgtacaaatggcagtctgaacaagcgggaatcaccactcttccccaaataacagtggctaattttccatcagtgagtgcagacagccagctaaaaaatcttagcagacaaccggatgaaggaaccccattatctgcactatcaggggatacgatacaagaaaatgtgacattcacgttgacaaaatctggggatgcgatcaccgacaaaaaaatcacgatctcacttccagaaaatactacttatatcaatggtaccttaaaattaaatggtacaactgtcgcagataccggcgttcaacaaggagtatctgtcccagcagatttattgagcaaagtcggcgatactattcatcttacttacaactatcaattaaatactgtagatacttctgtgcaatctgtcagcataccgacaaaggcagctgtactttctagcaatattacattagcagatggtgttaagcttcctaatccagttgtccaaacatcttccaaaacaattcttgtccccaaacaagaattgacattagttgatgtaccagatgattttacatttggcaacgatctccccaaaccgttgaagacaagttattatgaagcaaaaggcgatttttcttttgatgtacgggatactcggcttccaagcacgtctccttggcaactgacaggtacattgacttcttcatttaagaatgatcaaggtcaagaattaagcggaacaaaattgtactttaatcatgctggatcaaagcaattgatccaacaaggacaaaacacgatgatttatcaaagtgatggcacagctaaaggagaggttctcattgactttcccgataccgatggtttactcttagaggtaaatagcagtacgaacgctcaacctggcgtaaggtatcaaggcacgatcacatgggaactgtcagctgggccaatcagctaagtgatcagaatttgtatggatctgtgacaactgtcgcagatcctctttttcaaggatgagaaggaaacttctgctgttaaaatcagaaatgcttggaggagtggacttggaacttttcagtttgcttgaaaaaaatgaacaacggcaaatcaaactttttcaacttttattagaggaaaaaggagagatctctgttaataacgtactagcccgcttatcaatcgatcggtctaccttgaaagaagatttattttatttacaagctagtttagaaaacatcgaacaactggaaatcgttatccaagaaggatacattttattgatcagacatggcaatatagcagctatcgatgtttattatcattgctatttgcgctattctacaaaatatcaaatccttctttatctgttagaatatggctcatttgatcggcagaaacttgttatggaacttaatatcagttcggctactttgtcgcgtagagtgaaggaattaaatgattctttaaaagagtttcatttgaaaataaaaagcgggcgtttgactggcccagaaaatcaaatccgctatttctattttcaattattttggtttggtcgcccctatcttgaaaataaaaaagaatacagcgatttatcaggaaacacttttttagatctgctacaaaaagagttcagttttgccattacagaagaagggcgactgaaatttgaaatatggctttccattatgaagaaacggatgcgctgcacgaaaaaagccaaaccagattatagtaatcttcctgttggattgtttcaaacgacacaatttttattggagcttcatacatttttgacccgttatttctttcaatatgcctttccttggaatcaaaacgaaacgttggttttttatcttttcatgatcagtaactttacattagatacacataattcacatgttcaggaatttttgataagcgaaaaatacaaagatgacgtagtggctcaattgaatcgaacgtttaaacaatcgatagaagaatatttttctttctatgcttttccagaagagatttcgtaaaagattgcgttgacagtgatgcaaaatcacgctcattttgcctattttagaggatggatgaatatttttggtcaagaaggattgaaacaacggttaactgaagtagaagataaacaattccttgttttatgtgaaaggctggtcagacaaacatttgctattgtggattttactgaagcagacgaggaaaatgcccgttttgaattatttgctcgctatgcatctattttacgaacgctaatcaagcaattggaattgcgtttgcaaattgcttatgatcttccgtacgaaaggctaatggcggatatcgtgaaagagatcattcaagaacagttgttgaatacgatcaaatatgatttagtggaatacgagaaagacaagcaatatgatgtcattttgactagccaattgaaagaatacccgtcacagaagtccgccaaagtttttgtatttacgagtaatgaatttaactatgattttccctatttgaaccaatttttaaaagaatgctatttagaaaaattgaatttaaggatgaataaaacatgaaaatcgtgatcattggtgcttcccatgcaggcatcaccgctgccctaaatctacgcaaacttcaaccggaggcagaagttctgttgatcgatgaagatcacaaagatggattaggctatgtttcaaatgggatcaatctttatttaaaaggaaagatacatagtttagctgaagctgcaaacaacgagcggactcttcaagcaagtggtgcaaaactgatcaccgaatggagagtaactgaacttgatccagacaagcatcagctcatcctcacttctgaggaaggaaaaaaagaaaccctaacctatgataaactaatcgtggcaacaggttcatctcctgctactttatataaacaaattgaagctgaaaaacaagcaaatcaactttcatccaaatgaatttttgattgattggaaaaaatcaggagaagaagtagtatccgtacaacttttgtctcaaacactgaaggcagatatcgtcattttttctgctcaaacttgtccaaatacgtcattgttaaaagacaaagtggcattgtatgaggacgacactgtgatggtcaatgaatacctgcagacaagtgattcggatatctatgcgattggcgatatcgttccagtcagttttgacaaaaaagaacggcatctctttttgcccttagttactcgagctgtacatatggcgagagcggtagcgttgactttgtgcgagcagccgactgcttatgatctcaaacaaaagataacagcaacggtcattaccgaccactttttaggaactgttgggttgacagaagacgaagcaccatttttggaacaaagtgcctgttcttgttcaggagagtttgacctatttccacaatactatgaagaaaataaaacagtaaatgcaaagctgatctatcatccagatacattagaaatcattggcggacagctgataagcaaagaatttttattatcagatttgaacttgcttgctgatatcgtgaaacaaaaaaccacgattccacagttagcagttgaaaactttggatttttggctgaatataccccacgtttccactatctcaatgagttagcttttaaagtactagctaagagagccaatcgcaatagagtagaaaaaagaccgtgagagacatcacggtcttttattatgtgaaatgctatttttataataaaaaaactgaaaactactaactaaaaagcgtttagacatcataaggagagataataaaaaagcgaaaatgtattttgagcataatattcgccaaaaatttatcaagtgataaaattattgtataaaataattatttcaagaggaggaattaaatgtttttagcattaaatgaaattatgcattcaaagttacgttacgcattagttgcaggggtgatgtttttaatcgcctacttggtattttttttgaccgggttagcttatggcttagctcaagacaatcgaacggcggttgacaagtgggaggcagattcgatcgttctatcgaaagatgcaaattcaaatctagggatgtccatgattactaagaagaccgcagaagaagtcgaaggtggaaaagtggcctatcttgcccaaactccaggagtcgtgactagtaaagacagtacagatgaaggaaaaatcaatgttagcttctttggtatcgataaagatcagttcatcatgccgaatcttgttgaaggaaaagcttttaataacgatgatgaggcaataggcgatagtagcctgaaggaagaatatggtctagccgtaggagatacggttaagttatctggtagtgataagacgtttaaactaactggttttacggatcatgccaagtttaatgtttcaccggttctttatacgaccatcaatgcttaccaacaaatccgcttcgaaaaagaagacacaagtgagaatgcacggatcaatgcaatagttgtcagaggaaaaatcaacgatttacctgaagacttggaacagatcaaaatttctaaattcatcaatgaattacctggatacaatgcacaagtattgacttttgggtttatgattggctttttgattgttattgcggctatcgtgatcgggatttttatttatgtactgacgatgcaaaaaatcaatatctttggtgtaatgaaagcccaaggaatcacgggaggatttattgcacgctctgtagtggcacaaacattcattttatcctttgttggtattcttcttggtctagtgggaacagtgggaacatctcttgttctacctgatgcggttccattccaaagcaattggctattttttggcgtcattagcttgttgatgttggtagtggctgtgttaggcgcactattttctgttcggacgatcgtgaaaatcgatccgctgaaggccattggataagaaggaggaagaacatgaaagcaatagaatttaaagaagtagaaaaaagtttccaagatggcgaccaagtagtaaaagcattgaaagaaacaacaatgagtatcgataaaggggaatttgttgcaatcatcggtccttcgggttcaggaaaaagtacctttttgactttagcaggcggattgcagacacctagcagcggctctgtatttatcaatgatcaggaattcagtaatcaaaaagaaagcgaacgcgttaaactccgtttcaaggaaattggttttattttgcaagcatcaaatctggttccttttctgacagtaaaaaagcagttgttattagtagataaaatcaaacatgaacatcggcaaaaagaagcaaaagaattatttgagcagcttggcgtggataagctgatcaacaagtatccagaagaactatctggtggtgaaagacaaagggtggcaattgctcgtgcattgtacaatgatccgtctattattctagcagatgaaccaactgccagtttggattcagaaaaggcaagagaagtagtcgatattttggcaaaagaatcaaaagaaaaaaataaagcaacgatcatggtgacgcacgacacacggttgattgacaaatgcgatagaatatttatgatggaagatggtgtattgaaagaaaaagaataaccaaaaagtaggtggaaaaatggtccatcgatacaataaagacacgcaacaaaaaattttaaaagaagcggctgacttgttcatgtccaagggctatcttggtacttcaacaagagagatcgcacaaaaagttgggatcacccagcccaatctttatcactattttagtgataaagaaaagttatatacagcagtattagaaaagcacttagaagatgttgggaaagcgttgagagaaatcgtccaaacaagcgaaacgagatttcaagtgacgttgacaaaaatggctcaatttttgattgagacgcatcttgttgatttatttctgatgcttcacgaccttgaaagcaatctttccaatgaaacgagagatcatcttttctttctatggaagaaaaattatcgtgaaccgtttgaagaaattttttcaacaaaccaatccgtgttaagaagtgggatttccaaagaaatcgcagcaaggcattttttcttagtgttggcaccgtacatcactcgatcaaaaagacctgtagaagaaccgctaaatgtggcacaattgatcgatttatatttgaatggtgtattaggacaaacgtaaagctgttatatgtggagaaaaacagttaggtaaagaaacaagatatgacgaaaatcgttgtatcttgtttcttttttatacggctagtttttcatgcataaaattttgttattctctcataattatcaagggatattttatttattatttcattctaattgaatcgttatcaaaagggatttaaccaaaaagtagtttttgtttacttataaataacgaaaacaatataaaagaaaacgtttgcaaacagaattccagaatgttactatttagttgtaattataaaggcaatgtttctggtgtgtttgttctgtcggtgatctaggaggtgtttttatttaataacacaaataattaattatttgtagaatgaaagaaactatttatttggtggatgaatcataacgaatagacaaaaggaggtttcaaaatatgtcaaaaatgaaaaaaatcagtttagccgtaatgttattttcatcggtgatgtctgtcacatctccgttattaggacaaaaagattctgtctatgccgaagaaacagctcaagttgttcaagcaaaagaataccggaatgtcatgtattatggagattggtccatctgggatggtgaagggaaatttcttcctcaagatattccagcggatcagctaacacatttgaactttgcctttttagattttgatagcgaggggaatctgacatttacagatgcagatgctgctgtaggtgcatctttagaacaatctggcgtaggatggaacacaccaagttctgggattttgaatgcaatccaagatttacgcggcaaaaataaaaatctaaaaataggcgtatctttaggcggatggtcaaaatcaggagacttttcagaagtggcagctgatccagtaaaacgtaaaaatctagtagaaaatatcacgaaatttattaagtacaccaatatggattttgtcgatgtcgattgggaatatccagctgatgtccgtcagccagatctagtagataatgtaaacgatgaaggaacaccacatgccaaaccggaagacaaagagaattacatcacgcttttaaaagagattcgcgagtcaattgatcaacaaggaaaaaagttagggaaaacatatgaattatctgtagcgcttccttcttccagagaaaaattaaatgatgggattgacattcctaaattattctctgtggtcgattttgccaatatcatgacctatgatttgaatggggcatggagtccaaacagtgctcaccatacggcactatatggcaatccagctgatcctaattatgaagaaggtctttctgtcgatcagacagtcaaatttttacaaaaagaaggagctccttccgacaaaatcgtgattggtgcagctttttatacacgcggctggcatgaggtagaaagcggggataacaaagagctacctggtttgttccaatcagcaaaagcaagcaaccaagatgccgatcaaacaccttcttacggtgccaaaaacaaaaacgatctcgtttcaggaaatggtggtagagctggcggcgtctggccttatcggaatatcgctgatttgattgatcaaacagcagacttaaaagaatattgggatgatgtagcgaaagcaccttatatgtacagtaaaacaacaggagaattctttacttatgacaatgtcaaatctgtcagctacaaagcagaatatgtaaaagaaaatgaattaggtggagtaatctcctggatgcaatcacaagataaggaaaccaacagtagtaagagagacgagctgactaatgcgatcaaacaaggattattcggtgacgaaaaactgtcagaacaagaaatagtttcctccccgttagcgattgatgtggatatttctacttatagtgaatatggtgcgaatggttataacatcactatcaagaacaacgagcagcttaacgaaacttctagtgtattgagtgcagtggaattagtccaagaaacaatcaaattccctaaactatatattccaatccattcagctgaaagcctaagtgccggagattacaaagctggaacagtaacgatagaaaatgggtatgtcgtgattgatttagcttctgtatatgacggtaaacatatcgagccagatgcttcttatgaatttagattaagatcaagtgatgaaaatccaacagtcgatcgaattggccatattgcgttagtccaaagaatcggagatgaaggagcggaaatcaatcggcaagtcatctatggaaaagaactgataccggatccatccgatacgcaacccccatctgtacccgaaaatctagctgtttcagatattcaaggaacacgagttactttgagttgggaagaatcaacagacaataatcaggtggcaggttattacatctatcgtgatggtcagcgtgtagcacaaacagctcatactcgatatacagatacaggtttggagacaaatacaccgtacacttatacagtcagtgcatttgacgcttctggaaatgtatctgagaaaagcttgccgataacgatcacaacgaaaagcgaagaccctgctccaggatacgaagaatggaacccagaaaaagcttatgtcaagggagacatcgtcacttataaagggaaagtttatcaggcaaagtggtggaatcaaggggaagaaccaggttctaatgagtggggcgcatgggaactgattggttaaatttgctgtttatttgaaaacacggggctgtgacaaaacgtttgtcgcagctccttttttgcgtacttaagctgattttaagttttgacccttagtctggatctacgaggtgagagtcaagcatgaaaaaaataattggagcttttgtatgtgcaatcattatcattattatctgttttcaaatagatgtttttggtcaaaaaaagatagttgggcaaacagtcagcagtacgaacagtacggttacaaagacaaaggaatcatctgatgacacaaaacaagagacattagtcaaaatcggaaaaaatgaccgtacactatatacagatgactcgctaacgaccccattagcaactataaacggcggagaactgacggagtttctttccgaaacaaaaaatgcttatcagatcaagacaaatgatggctatactggatatttagccctcgaagatggaaccaaagtcacaaagaatatacaaacaaaaccgaaagagttatctgatgcagtgattgtattagatcctgggcatggcggaaatgatactggggcattaagcaatgatgaacaaacagaagaaaaggatataacattaagtacagccataaaagtaaaaaaggcgctagaggatgctggagcaacggtttatttgacccacactacagatgaattagtacagcttggagatatatgcgactacagtgaagaaaaaaaggcagatgtctttatcagcttacatgcagactctacggaatatgcgaatgaagcaactgggatcacgacatattattactatggacaagaggaaacattagctcaaacaatcgctgattccttcactgatctgcctctggattcaagaggaatctccactgggaactatcaagttcttcgagaaaatcttcaaccttctattttaatcgagatgggttacatgaataatgatggtgatttagaggaattagtaacagacagttatcagcagcagatcgctgcaagtttgacacaagcattgaccacctattttcagcaataaataaggaaagaggttgtgacagaagtggtcagcttcaagaaataagaaggaatttacgaaaattgcttctcaaatttttgtgaaatttcggcttatttttcgaagaagctacttctggaacaccgtttaagaaagaggtcgtgagcctgcccgttcagctccgagtcacaaggagcaatttcaaaaaacagcttctcatgtttgatgaatattgtgacttgtgaccgaggagttggcaggagaacaccgtttaaggaaagaggtcgtgaaatcagcgttttgacctgagtattagagaaacaaacggaaaaatagctcctcatattttgccgtttgttgagctaatatcgagggtcagctaattgaacaccgtttattcggaataagggactgtgacacgatttatgtcacagttttttttatttttttagtagcttcaacgctttttctgtattggcaaagtgaagtttggcatatttttcaagcataggcatgccgcctttttccaatagttttgccgctacttgatcagatttcgttccagctcctgagggaagggtgattccagcttcagctgatgctttgtctaactcttctaaaaagctggcacgactgatgatagaagcagcagcaacagctaaatgatattgttctcctttagtaacgaagtacagtttttcttgcaagtgatttttttctaaacgcgcatattttttaaaatttgcttctggcgtaaactgatcgatcaaaatcgcttctggtttttctggtgcgattttttttagcagcaaatggattgcttgattatgcaaagcgactttcatccgaacagcattgtattttggctggatctcattgtatttttctgggggcaagacaagtagtttgtaagggatagtttcttttaagatatcagcaagttggatgatttggctatcttttaactcttttgaatctcgaacaccaagtttacgtaattctgcaagctgatcacgtttcacataagcagcacatactgttagtggaccgaaatagctgccatttccgacttcatcgctacctaaaacggataattgactgatattttttggcaaagaagagaccgttcttgctggtttggcctgcttatcctgtgcctgcccccagcgctgagcttccgtttctgcgtttgccccttggaacatcacttttcctgatgtgtaagcagtgatggtcgtcccgtcttttttagcagcaaagatagtataaggaatctgtttatttaacaaataagagcgatagtatgctttcatttgactaagttggtcgttcgttgctttgataatgacgttgctcataaaattctcctcgtttttatacataaatctataccgcaactcctgacttttcgttttctaagaggttgcgagacatagcatttttttaaagtttatcatataatagttaagtatgtgaaaaatatttgtggagaacggtgaaagaaccaacttcatggtacactaaataaaactttcatcaaataggaggaaatgattcgtatggcgcacgaaaaaacacgctacaaagcagtgattgccaaccaaacatatactattatcggacgggaaaccaagcatcatatggatatcgtaacgaagctgatcaatgagcagttagcagaattgaaacaattatcaccacaaatggataatgaacaagcagcgatcttgatggctgtcaatgcgctttcggatcaattgaagaaacaagaaagaatcttggagctagaagaagaaacagcagaattaaagaaaaaaatgatcaaatttacagagcttgaaaatcgcgtaaaacgcatggaagcaatcgagaatgaagctcgagaagtactgaaagaaaatggtcaagcagattatactattaaaaatcatgtggaagcacaacagattttaaatgaaaaacgaaaaggacaaatcaaacaaaaatcttctaattaagatccttttatcaaaataagaaaaatttaaaaaagttagaagagaaaggaacgtagcatgctgagtttgctgattttatttttattgctaattgcgtttttttctggagcacgtcgcgggtttgctttacaagtcatattcgcaatcggatatgtgttgtcatttattgcttcccagcatttttacaaaccattagcaagtcatttggaattatacattccatacccagctgtcaccccgacatcaaagttagcattttttgatcaagtatttgcctttcacctagatgaagctttttatgcaggaacggcttttctgatcattttgctgattggctggctgatcacccgatttgtgggggtctttgtccatggattgacatatgtgccgatcttgagacaggtagactggattgcaggaggtatcctgtcactaatcatggcttacgttactatatttttgattttgcagttacttgcctttgttccattagatgtggtccaaaatcaattcggcgagcatagtttcgctcgttttatcgttgagagaacgccctttcttaccaacaagatgtatgagctttgggtaacgaatattttgaattaaggaaaatagggctagaaaatatttttttagaaaaacttttacaagaatgttttgttttttgtacacagtagtttatttaagaaggctgcgcaacgtatgtccggcacagcccttttttcatagtgaaagataaggtgataaaatgaataaccgaatccttgaaacattggaatttgaaaaagtcaaacagatggtcaaacaatttgtagtgactgcacaaggaaaagaagaactggcagaattggtgccagtgagcgagaaacaaacgatcacagaatggcttcaagaaactgaggatgggttgaaagtacaacgtctgcgaggcgggattcctataccaaaacttgaaaatatccgccctcatatgaaacggatcgaaatcggggcagacttgaatggagtggagcttgcacaagtttccagagtgttatctacgacaagtgaattgcatcggttcattgatgatctttctgacagtgaaattgaatttgcgcgtttgtatatgtgggcagatcagctagtcacgattcctgttttaagtcgccgtttaaaggaagcaatcgatgaagacggacgcgtgaccgacgatgcttctcctgagctaaaaatcataagacagaacattcgtcgcagtgaacaagctgttcgtgaacagttagacggaatcgtccgcgggaagaacgcaaaatatttgagcgatgcaatcatcaccatgcgaaatgaccgctacgttatcccagtcaaacaagaataccgcggtgtatttggcggtgtagtccacgatcaaagtgcttcaggacagactttatttattgaaccaaaacaagtggtggatttgaataatcgtttgcgtcaatatcaaatcgctgaacgaaatgagattcaacgtattttaagtgaactttctgcagaacttgttccacatcgtcaagaaatcatccacaatgcttatgtgattggtaaaatggatctgatgaatgcaaaagcacgatttggtaaagaactaaaagccatcgtgccgagaatcagtgaagacaatcatgtcgtcttgaaacaagcaagacatccgctgatcgatcaggaaaaagtagttcctaatgacatcgcaattggaaaagactatcaagccattgtcattacaggacctaatacaggtgggaaaacgatcacgttgaagactttaggtctgttacagctgatggggcaagcagggttgccgattcctgcaggagaagaaagccaaatcggtatttttgaagaagtatttgcggatataggagacgaacagtcgattgagcaaagtctatcgaccttttcttctcatatgacgaacactgtagatattttatcaaaagtcaatgaaaaaagtctggtactatttgacgagcttggtgcaggaacagatccgcaagaaggcgctgctctagccatcgcgatcttagatgatcttggtaaaaagtctgcttatgtgatggcaacaacacactatcctgaattgaaagtttatggatacaatcgggcaaatacgattaatgctagtatggagttcgatgtggatacactaagtccaacgtatcgtttactgatcggtgtgcctggtcggagcaatgcgtttgaaatctccagccgattaggtcttgatacagatgttattaatgaagcaaagcagttgatgaatgatgagagccaagatttaaatgaaatgatcacagatttagagaatcgccggaaaatggcagagaccgaatatctggaaatgcgtcattttgtttctgaggcacaagaacttcatcatgatttgaaagaagcttacagctatttctttgaagaacgtgaaaaagaaatagagaaagcaaagaaaaaagcaaatgaagtcgtgtcagaggcggaagaaaaagcagaaaaaatcattgctgatattcgtaaaatgcaacagcagatcgggcaaggaaatgtgaaagagaatcagttgatcgatgcaaagacccaattagcaaatctacatcaagaagaaacattgaagaaaaataaagtattgaagaaggcgaaagaacaaaaaacattaaaaccgggagacgaagtgttggttacgacttacggccaaagagggacgcttttacgtaaaaacgggaatcagtggcaagtagaaatcggtatactaaaaatgaatgtgtccgaagacgaactgacgcctgttgctcctcaaaaagagccgacacaacgagttgtccatgctgtacgctctgaatctagcagtcatgtgccgaatcaattggaccttcgaggaaaacgatatgaggaagcgctaagtgaagtagatcagtatttggattctgccatcctagcaggttatcctcaagtgactattgtccacggaaaggggacaggcgcacttcgcaagggaattactgattatcttaaaaaccatcggagcgtcaaaagctttgagtttgcaccggcaaatcaaggcggaaatggtgcaacaattgttaaatttaagtaaaacttactaaaggtaagcagatggttcgctatccaaggatagaaatgctatactggtcatagattttaaaaatggaggtctttgatatgtcacaagtaattacagataagacatttaacgaagaaacagacaaaggacttgtattaattgatttttgggcaacttggtgtggtccatgtcgtatgcaagcaccgattttggatcaattggaacaagaatatgatgaagaagaattcagaattgctaaaatggatgtggatgaaaatccagaaactcctcaacaattcggaatcatgagtattccaacattaatgttgaaaaaagatggtcaagtagtagaaaaagctgttggtgttcattcaaaagaacaactacgtcaaatgatcgatcaatatttataaaagcttaaagcaaaaataagctgaggatgggactgaattcagttccgtcctcggtttttttgcggttgagttaaggttattcaaattaaccttttttgagtataattacgttgtcaggctggattgtttttttgacagtcatgctataataactttaattgaatatgaaggggagtaccagatgaacgaacgaatcaaaaacaaactagctttacttcctgatcagcccggctgttacttgatgaaagataaaaatggaacgatcatttatgtcggaaaagccaaaatattgaaaaatcgcgtccgctcatattttactggcagccataatacgaaaacggaacggcttgttagtgaaattgaagactttgaatacatcgttacagaatcgaatatagaagccttgctcttagaaatcaatctgataaagaaaaatgatcctaaatacaatattatgttaaaggatgataaaacctatcctttccttaagataacgaatgaaaaatatccccgtttggtgattactcgcaaagtactaaaagacaaagcactgtattttggaccatatccagatgtcggtgcggcgaatgagacaaagaagatcctcgaccgattatttcctctgagaaaatgcaaacctagtcagacgaaggagccttgtctttactatcatttggggcaatgtctgtgtccttattatttcgacgtagatccgaaagtctatacgaaaatcgttgatgaagtgaaaaactttttaaacggaggacacgaaaaaatcgagtcagagatccatcagaaaatggaaaaagctgctgaaaacatggaatttgaaaaagctgcagaataccgagaccagatccgtgctatcgaaacaatcatgactcgccaaaaaatgacaaatactgatttactggatcgagatgtatttggttatgcgattgataaaggctggatgtgtgtccaagtgttttttgtaagacaaggaaagttaattgaacgagatgtttcaatgtttcctttctataacgaagcagaagaagattttttgacttatattggccagttttatcaggaaaatgaacatttcattcctaaagaagtcttgattcctgatacgatcgacaagccaagtgtagaagctttgttagatacgaaagttctacaaccgaaacgaggcgaaaagaaaaaattagtggaattggcgaataagaatgcctcagttgctttgaatgaacgatttgatctgattgctagaaagcaggaacggacgatcggagcagtggaacgtttaggaaacgcaatgaatatcccgaccccaatacgcattgaatcatttgataactccaatatcatggggacgaatcctgtggctgcgatggtcgtattcattgatggaaaaccagcaagaaaagaatatcggaaatataaaataaaaacagtcaacggaccggatgattatgcatcgatgagagaagtcatctatcgcagatattcacgagtgattcgtgaagggttgcctttacctgatttgatcttgatcgatggaggaaaaggacaagtcgatgtagcaaaagatgtcttagaaaatcaattaggaatcgatattcctattgctggtatggcaaaaaacgataaacatagaacaaatgagttgctattcggtacagatttggctgtagtaccacttgagcgaaattcacctgagtttttcttgctccagcgggtccaagatgaagtccatcgattcgcgatcactttccatcggcagctgcgtagtaaaaacagttttgcttcccgattagacgaaatcgaagggctaggaccgaaacgaaaaaaaatgttgcttaaagaattcaaatcattgaaaaatatcacagcagctacgatagaagaattacaagaaatcggactaccgaaaaatgtcgcacaaaacgtatttgataaattacatcaggaatgagaaaagggcactttacaaagaaagtaaagtgtcctatcattttatttacaacaacaagagaatacacgtttgttggtaaataataaatcgcttacatctagtgtcttaggatatatggatttattgaagaaggagtgaagaaatgttagaagtcaaggatcttgttaaaacttttgggaactacacagctgtcgatcatgtctctttccaaatcccagacggaaaaatcatggggctgattggtcaaaacggtgctggtaagacaacgacttttcgtttgatcttggattttttgacacaagaccagggagaagtgttatggaatggtcatcatcttggggagaaagattatgatatcatcggctatcttccagaagaacgaggactttatccaaaagtaacgattcaagaccaactgctttattttgcagaacttagagggaaatcaagaaaagaaattgaaccaaaaatcgatttttggatggaaaaatttcaggtaaaagggaaaaagacggataaagtaaaatctttgtctaaagggaatcagcaaaaagtccagctcatcgccacattgatccatgaacctaaattgatcattttggatgaaccatttagcgggttagatccggtaaacgcggaattactgaaagatggaatattggaattgaaaaaacacggttcgtgtgtcattttttctagccataatatggataatgtagaaaaaatctgtgatcatttgatcatgctgcgaaacggaaaaatggttttgaatggaaaagtccatgagatccgtgaatcatttggccgtacgaagttattcttggaatctgggttaagtcaacaggaagtagaagaaatcgaaggcgtgaaaaaagtgatccttcgtgaggataatacgttagagatcacattagaagatcctgaagctgggaaagaaatctttactcgtgcgacacaattcggctatatccctatgttcaaccagcagccgccaactttggaagagattttcaaattgaaagcaggtgaaatcgatgcgtaagttttggattattaccaaagatgtctatttaaaaaatgtcaagtcgatttctttcttgattatgatattagtccctttcatcatgctaggtattatttatgtagcaggaaactttgcccagcaaaatagtgatgtcaataaaatcggcgtattggctgataatgagcaaatcagtcagcaattgagccaagtcaaaacagatgattttgagttcaaagcagtggattctgaagaaaacgcacaaaaagacctttcgaaagaaaaaattgatgcttatttagtagtctcaactgataaagataaagtaaatgggacgctttatagcgaaaattcattgggacaaagtacacagctgctgatacaacaacaattgactggcttgcaatcgatgcttcgagcaagcgaattaggtatttctccagaagaagtggcaagtttgagccaacaggcaagtttgactcggcaaaaagtcaactttgattcaaaaggaaaaatgtcggtaggagaagataattcgacagtccaatatgtcgtcagctatgtggcgacgattgtcttgttcattatcattctgacttatgcacaaatcattgcacaagagattgcttctgaaaaaggcacgcggatcatggaagtgatcctgtccagtacgactgcacaaaagcatttttacgggaaactaactggtgttttgcttgttgcattaacgcaaatggcattatacggcattatttttggtgtaggatacaatcaattcaaagatatggaaatggtcaagaatatattggacggtatctcattagataatttgattggaccattcttgtggtattctcttctatttatgatctttggcattttgattttttctgttttggcagctttatgtggctctttggtcaacaaagcagaagatacagcaaaagcaatcttgccagtgacttatttatctttaggcggatacatgcttgggttgatattaggtgcgtcagatccaaataatatcgttattcggatcacttcgtatattccatttttatcttcctatattatgccggttcgcttggcaaatgagacagtcggtatgggtggagcattgatttccttgttggtacttgtagccgtgacattcttattgatgatcttgtctgcaaacatgtacaaatcgaatgtactcgtgtatagcgaaggcggattatggagttcattgaaacaatcgatttcaattatgagaaatgaacgaaaaaaagcataaaatatagaaaaatatagaaggaagctggacatttattgttcccagcttcttttttgtatagacctatttctatttttttattatattggatatatattcattgaaaatagcgcataacaactttataatgttgagtataccaatttttggaggcgttttaatggaccgctatttagatttactttcagagaagttccctacaacggaagatgtcatcacggaaatcatcaatctcgaagcaattttgcagcttccaaaaggaacagagttatttttgagcgatatacatggcgaatttcctgcttttgatcatattctgcgtatcggttcaggaaatcttaaagaaaagatcaaagaccttttctctgaacaaatgacggaaacggagatcagccaattcactatttttacggcttatccagaatatgcattgacgactgattggtacaaaaaacaagataaatcccagctaatccatcgtttgattgatcttttacggtttacgacagtcaaatacactcgatcaaaagttcgaaaaggattgccgaaagaatatagctatatcattgaggaactcttgtatatcgatgatcgtatcaacgggaaaaaagactatgtaaaaaaaatcattgaacaacttgtcttaatgaaggaagaagaaaaatttttaacaaaacttgcgcagacgatccaaaaatctgtcatcgatcatttgcatatcgtgggtgatatttttgatcggggaactcaagcagccaaagtaatggatcgaatcatggatttttcctctgtagatatccagtgggggaatcatgatattttgtggattggtgcgtattgcggctctgaggcatgtttattgacgcttttacggattgctgcacgctacaactatttatttgaattagagaaagaatatggaataaatttacgtccattattttcttttgcccatcaaacctaccagaagaatcctgtatttacccctaaaaacagggaaaatctatctgaaagagagcaagaagaattagaaaagatccatcaagcgctttctatcctccaattcaaatcagaacatcagttgttggatcgacgacctgaatttaaaatggacgatcgtaaattgttggaaaaaatcaactatgaagaatcaacaatcgatttagaaggtcagctctatgagttgaaagggacttgttttcaaacgatccagccagatgatcccaaaaaattcttggaagaggaacaaaaagtgatcgatagtttgatgtattcattccagcactcgttaagaatgcaaaaacacatgacgtttttgatagaaaaagggggaatgtatctcacgaacaatcagcatgtactgtttcatggctgtatacctgtagatgaaaaggggcagctcttagcatttgaattagaccaatcttatcgcggaaaagaactactgggattttttgaaaaacagataactgaaagcgcaaaagatttgactgcaaaagaagatttggcgaccgatttgatttggtatgcgtggagcgggccattttcgcctttattcggcaagagtaaaatggccacttttgagcgctattttctcacagagcctcatacgcacgtcgaaaaaagcaatccctattatcacttgcgagatgaagagtggttcagtgaaaaaattttggcagaattcgatgcaaaagaagaaggttcagcaatcatcaatgggcacacgccagtaaaagtaaaaaaaggggagtcaccgatcaaagcaaacggaaaagcatttgttattgacggaggtctatccaaagcttatcaaaaaacaaccgggattgctggctactcattactatgcaattcttacggtttccaaatcgtgacacattatccgttcttgcctattgaacaacaatttgcaaaaaaatctgatcaaacgaatgtaaaaaaagtgatcgagcagcagctcccacgcaaacttaatcgggatacgacaaaaggaatggaattacagcaacagattactcagc

SEQ ID NO: 42 - DNA, 2865278 bp, unidentified (residues 1,432,640-2,865,278 of 2,865,278)
  source 1..2865278: mol_type = genomic DNA; note = Enterococcus lactis
tccaaaggctgttggattatcgaaaggacgattgagaaaaatgctagccaacattgctcaatagactaaaaaaggactgcaacaaaaggcgtgtcgcagtctccttcggaattagctcaaaaaacggaaaaatatgaggagctatttttccgtttatttctctaatactcaggtcagggcgctgatttcacgacctctgggtaaacggtgttcaaaagccagtttctcggtattaagccaaatttatgtaaaaatgtggaaagccattttcacaaaatttttcttcatactcgaaactaagcgactttttcacgacctcttccttaaacggtgttcaaaagcttgcatctgcggtaataagtccaaccaatttaaaaacataaggagctgtttttacttggctattcttattacttgatgcaggacagctttttcacaacctcttccttaaacggcgttctcctgccaactcctcggtcacaagtcacaatatccaacaaacatgagaagctgttttttgaaattgctccttgtgactcagagttaaacggcaggctcacgacctcttggtataaacggtgttcaaaagccagtttctcggtattaagccaaatttatgtaaaaatgttgaaagccattttcacaaaatttttcttaatactcgaaactaaacagctttttcacaacttcctcagaaaaacgattaaaattcattcacaaagaaatcgaataaacgctgttcagatgaatttacacgatgagaaagttccggatgccattggacaccaaggattttgtgcatattatctttactttggactgcttcaatgagtccatcgttggaaaaggcgatggcttttaacaaaggagaaagatctttgactgcctgatgatgataggaattcacaaagtatgaatcagggagaaggtcacttaataaactgtccgaaacgattttgacttcgtgagttgcaaactgcggggcagtgggctgttgttcgtgttttacagaccattttggatataatgaaagatcttgataaagtgttccctccaacacgacattcaatagttgaagtcctcggcagactgcaaaaatcggttttctttgtttcaatgcttccaagatcaatgcctgttcgaattggtctcgttgaatatttgtttccgtcagtttgggatgagggtcttccatgtaaagttgcggactaacatcctgaccgcctgcaagaatgagtttgtcgattttctcaattagttgaggcgctgaatctggatacatgactggcagaataagaggtaatccttgagcatctaaaactgcatccacaaatccctgcggtgtatagcttacttgatttccttggaaagtatctgtcgctcgaatcagttgattcccggcaatgccgatgattggtttcatttttattccccctaaagtagactaattgtaacaaggatttaaaaaaatttaaactatgtaagacttgcccctatacttatctgttcttgctgtgttactatctgtaaagagaattttcgtgtgaaattcatgacgatagttgaaaatattgcttaatttgttataataaaaagtaagcagaaataaaaaggttgggcgtaagcttcaaggatctagttcttcaaggggtgagaaggacattttattgaaggggcctgcctatactaagttatctttagaggtacatactttcaatgaaaaaagaaagcatgtacctcttttttaaatcgaaaggaagtgaagcaagtgttagaagctttggaacaaatccgaaaagcagaagaagaaaatgagaagcgtgctcgaaccctacggcagcagttgaagacctatgcagaagaaaaagagcaagaattggagataatccaaacgaacagtcggcaacagctgaaacagttggtagaagaaaaagaacaattcgaaaagcaagaattagaaaaagaaaaaatgaaattgaaagcagaagcagacaaggtgcaagcaactttgaaagaccaatatcaaaagcatcagagtcaagcaatcggtgcaatcattgaaagggtgaaagaaacttatggccgtcactaagatggaaaaagtgaccctcatttcagataaaagaaatcaggagaggattttacaagcagtacaaggaatccaaaatgttgaaatccgggatctgtatcaaaatagaacaaacaaccagtgggtagaaaaatattttccagataccacgattattgataaagaagcaaaattaagcgctttaggcaatcggctgaaagacatccaagaagctatccaattcatacaacaccacggcgatagccgtcaaaagaaactccatttgaaacgtcaagaactttccttacaagacttggaagcaaattattccgaagaaaatttcatgaataaattagaagaagtccttgatttaaaagaaaagtgggaacagctaactgaaaaacgtgatcgtttagaagaagaggaagaatggcttcttcattggcaacagctggatattgctccaagtatgtatgcaagtaagacgaccatttttgagatggggactgtgagtgcagcaaattttgaaagtttcaaggaagaactaagtaagcttgatgacgtttatatggaagaaatagattatacgccaaaacaagtttatctttcgtatgttgctttaaaaaaatcagctgctgctatagaagaaattgctgggaaatacgggttcaataaagaaacgtatccttatgaacaaaatcctaaagaaaaactgcaagaaaccaaacagcaattgtccgttgttcacgagcaccaaaagaagataacgacagcgttaggtcagtgcagcggctatatccaagaatttgaatgggtagaagaagtcacacttgccgttgcagaacgggaaaaagtaaaagaacggtttatccatgcgacttatctgatcgttttgcaaggttgggtagatgcagaagaaaaacagaatttgatgcatgtgttaaccgaaactgtatcagaagaagatatatatattagtttcgaaacaccaaactcagaagagattcagcaggaagtccctactaaattgaaaaaccatccgcttatcgaaccttttgaattgctgactgaaatgtacagtctgccaaaatatgaagaagtagatccaacgccttggatgacaccattttatcttgtcttcttcgggatgatggtcgcagatgttggttacggattgctgatgctcattgggacaatactagctcaaaaactacttgttttaccacgtgggatgaaacgtttcgtaaaattctttgagattctctcggtaccatcgatcatctggggattgatctacagttcatttttcggacaggcattaccaaaagaactatttggcatccgcttgcctttcccaatcctatctacaacggatgacgtcaatacgattttgattttatccgtgattttcggtctgatacagatcttggttggattatttgtggcagcaaaggaaaatatcaggagaaaagattacttgagtgctgtcagtgatggatttgcctggcaagggatcctgattgggatcgttattgcattgattggtgccatgttgataaaaaatacagcatttgtttatcttggcgcggggctatcgatcattgctgctttatgtatcttaatcgtgccgattatccaatcgccgtctaaagtcaagggtgctgccaaaggagcgtataatttttacggattgacgggttatatcggtgatttagtcagttatacacgtttgatggcattaggtatttcaggcggaagtattggcgcggcattcaatatgctggttgctttcatgccgccagccgctcgattcagtgtagggatccttttgatcatcgctttacacgcactgaatatgtttttgacactgttgagtgcctatgtccatggtgcacgattgcagtatgtcgaattttttggaaaattttatacaggaggcggacgtgcctttgacccgctgaaaacggcggaaaaatacgtcaacatcaatcataagaaaaaaaacaataaataattggaggatttttatacaatgatggattacttaattagtcaaaatggtggaatggtatttgcagtattagcgatggcaacagcgacgattttttcagggatcggttcagctaaaggtgttggaatgacaggtgaggcagcagcagcgttaacaacaagtcaacccgaaaaattcggacaggctctgattctgcaattgcttccaggtacgcaagggttgtatggattcgttatcgcctttttgatttttatcaacttaggaaatgatatgtcagttgtacaaggtttgaactttttaggcgcttctctgccgattgcttttacaggcttgttttcaggtattgcccaagggaaagttgcagcagcaggtatccaaattttagcgaaaaaacctgaacatgctacaaaaggaatcatttttgctgcgatggttgaaacatatgcgattttaggtttcgttatttccttcctattagtattgaatgcctaagcataaaggaggaaaagcagatgaacgccattgaaaaaatcatctctcagatgaatgaagcagcagagcaagaaagagcggcgttagagcaagaagagcgaatgaagatcgatcaaaactttgaacaaaaacgtacgcaaatcgaaacagaacatcaaaaacaaaaagaaaaacaaatcgaattacttgaaaaaaaataccgtcagcttaggaatcgccaacaagtagaagtacgacaagaaaatttgaacgcgaagcaggaatttttacgacgattgtttgcagatgcaatagctgaaatggagaattgggatgaatctgaacaaatccagtttatcaaaaattcattgtattcattacctttgacaggcaaagtaacattcattgctggagaaaaatcagcagcttatctttctcagacattgctggatgaatggaacaatgaacttccctttacgatggttttaagcgatgaatctgttgctggtcaagctggttttctgataaacgatcaaggagttcagtataactttcttttcagcagccttgtacaagatatccaaggaacgatgagttttgagattgccaatcaattattcgaataaggagggatcagtgtatggaataccacgaactaaatcccttgattcgcggaagagagcttgaacttttgtccaatgagacatttgaacggatgattcaaaccaattctgtcgaagcacttggtgagatattgaaatccacaatttacagtccatatatctatgacgggtatgaatatgactttgaacagaatcttttaaaggagcagagccgtctatttcgctggttaaaggaatcagcaccggagcctgaaatcgtttggatctatacgatgcgttatactttccataatctgaaggttttgacaaaagccgagatgacaaatcaaaatctggaccatttgtatatcgacgatgggttttattcattagaaaccttgaaggatgccattcatacgcaagtttcaaatgaactccctgaaagtattatggatagtatacgagaagtccgcgattattttgaagagtctaccattcttcagggaatcgatgtgatctatgatcggcagtttttgacagagcagcgacggcttgccgataagctaggatatcaagaattgctgaaagaagtcattgcttttattgacttgaccaatatcacaacgatggctcgaggaatattgcagaaaagaacatatgggttcatgacgacggtgctttccagttcgggaagtatcgaaaaagaagtatttttgaactttgtagataaagatatggaagcttacacgaactttctattagagacagattatgctgagtttctgcgtcctgtcatccgtgagggaaatcttgatctcgtaaagcttgaacagttgaaagatgattatctaagttcattgtatcaagaagcacaaacccaggctttcggaccactgccactactagcctttttgaacgcaaaagaggtagaaagtaaaaaccttcgtttactggttatcggcaaaagaagccattttgaaccagaaacaatcagaaagcgggtgagacaagtctatgacgcataagatcggtgtagttggcgacaaagattctgttttgccattcaaattgtttggctttgatgttcgttatggtacaaccaagcagaccgttcgtcaggcaattgaagaaatggcaaagaatgagtatggcgtgatttatgtcacggagcaatgtgcagcactgagcccagaaacgatcgaacgttacaaagaacaaatgatacctgctatcgtattgattcccaaccatcaaggatcattagggattgggctggaagaaattcaaaaaaacgtagaaaaagcagtaggtcaaaatatcttatagtatgaaaaggagatagaaattttgcaaattggaaaaatcataaaagtctccggacctcttgtaatggctgagaacatgtctgatgccagtatccaggacatgtgtttagtgggagatctaggagttatcggagaaattatcgagatgcgtggcgatgtggcgtctattcaagtatatgaagagacctcaggaattggtccaggcgaaccggttcgttctactggtgaagctttatctgttgaattaggaccagggatcatttcacaaatgtttgacggaatccaacggccattagatacctttatggaaatcacacaaagtaatttcttaggacggggagtccaattgcctgcattggatcatgagaaaaaatggtggttcgaacccacattagaagccggagaaacggttagtgctggcgatgtgattggaatcgtagaagaaacaaaagttatcaaacacaaaatcatggtgccaaatgggataaaaggtacgatcaaaacaatcgaaaaaggatcgttcactattgatgaaaccgtatgtgtcgttgaaactgaaaatggtgacaaaaacttgacgatgctccaaaaatggccagtcagacgtagtcggccaatcaaagaaaaattaaaccctgatgcaccgatgatcaccggacagcgagtgatcgatacgttcttcccagtgacaaaggggggagcagcagctgttcctggtccatttggtgcaggaaaaacagtcgttcagcatcaaatcgcaaaatgggccgatgtggacatggtcgtttatgtgggatgcggtgaacgtggaaatgagatgacggatgttttaaatgaatttcctgaattgattgaccctaatacaggagaatcattgatggaacgtacggtattgattgccaatacatctaacatgccggtagcggctcgagaagcttctatctatacgggaatcacgattgcggaatatttccgtgacatgggttatgacgttgctatcatggctgactccacttcacgatgggcagaagcacttcgtgagatgagcggacgtttggaagaaatgcctggtgatgaaggttatccagcttatcttggttcccgtcttgcggaatactatgaacgatctggaagagtcattgctttaggatcagaaggtcgcgaaggaagtataaccgcaatcagtgctgtatcgccttctggaggggatatttcggaaccagtcacacaaaatacattgcgggtcgtaaaagtattctggggacttgattcgactttagcccaaaaaagacattttccttcaatcgattggatccaaagttattctctttattcaacagaagtagggaagtacatggatcatatccttcaagctgactgggcatccatggtcactgagggcatgcgtattttgcaggaagaacagcagctgaatgaaatcgtgcgtttggtagggattgattccctttcagataatgaccgtctgacattagaagtggcaaaatccattcgtgaagattatttgcagcaaaatgcttttgatgatgttgatacattcacttcaagagagaaacaattcaaaatgttgaagatgatcttgacctttggtgaagaaggacgccgtgcgttgtcgttaggtgcttatttaagtgagatcatggacggtaccgtgtcgattcgtgaaaggatcggacgaagcaaatatatcccggaaacagaattagaaaaactagatcaaattatcggtgaaatcaaacaaacgatgcaaacaatcgtttcagaaggaggcatgagcaatgattaaagaatatcgtacgatcggtgaagtcgtcggtccattgatggcggttgaaaaagttgctggtgtcaaatatgaagaattaatcgaagtccgtatgcaaaatggcgagattcgtcgtggacaagtattggaagtccaagaagataaagcaatggtccaaatatttgaaggaacaagtgggatcaatttacgtgactcttctgtacgatttttaggacatcctttagaactaggtgtatcggaagacatgatcggtcgagtattcgatggcttgggacgtccaaaagataatggaccagaaatcctgcctgaaaagtatttggatattaacggagaagtaatcaatccagtagctcgggattacccagatgagtttatccaaacaggtatctctgcaatcgatcatttgaacacattagttcgtggacaaaaattaccagtattttctggttctggtcttcctcacaaagaattagctgctcagattgcgcgacaagcaacggtacttgattcatcagatgatttcgccgtagtctttgctgctattggaatcacttttgaagaagcagaatttttcatggaagattttcgacaaactggtgcaatcgaccgttctgtcatgttcatgaatttagcaaacgaccctgcaatcgaacgtattgctactcctcgtatggctttgactgctgcagaatatcttgcttatgaaaaaggaatgcatgtattggttatcatgacagacatgaccaactatgcagaggcattgcgagagatttctgcagcacggcgagaagttccaggaagaagaggctatcctgggtatctttacacgaacttagctactttgttcgaacgagcaggaaggatccgcggactaaaaggatcagttactcaaattccgattttaacaatgccagaagacgataagacacatccgatccctgacttgaccggttatattacagaaggccagatcatcttgactagagagctttataagagtgggatacaaccaccaattgatgtacttccgtctctttcgcggttaaaagataaaggaactggacccggaaagacaagagaagaccatgcggctacgatgaatcagctttttgcagcctatgcacaaggaaaacaggcaaaagaattagccgtagttttaggagaatctgctttatctgatgtagacaagatctatgcgaagtttgctgagcggtttgaaaaagaatatgtcaatcaaggattctacacgaaccgttcgattactgaaacacttgatctagggtgggaactgctatcgatgttgccaagaaccgaattaaaacgaatcaaagacgacatgctggacaaatatctgccagaagggaagtgagttctgatggcacgattgaatgtgaatccgacccgcatggaattgacccgattgaaaaaacagttgacaactgccacaagagggcataaattattaaaagataagcaagatgaactgatgcgtcaattcattctgttgattcgaaagaacaaccaactgcgtcaagaaatggaagagtccatgacagaagcaatgtctgattttgtattggcaaatgcttcaatcacggaacctttcatcgaagaattgtttgctttgccggcggaaaacgttgatttatctatcgtagacaaaaatatcatgagtgtaaaagtacctgtgatgaattttgaatatgatgaacagctgacagacacccctttggaatacgggtatttgaattccagtgccgaactggatcggtcaatcgatcggtttactaccttgcttccaaaacttttggaactgacagaaatcgaaaaaacttgtcagctaatggcaagtgagatcgaaaagacacgtcggcgagtcaatgcattagaatatatgacgatccctcaattagaagaaacaatctattatattcgtatgaagctagaagaaaacgagcgcgcagaagtaacaaggttgatcaaagtaaaaaatatgggtaccactgactaagtggtatccttttttaaaagaggaaaacgatgattaaacaaaacaaacaaataaagaaacgcttgccggccgttcagcttctcgcattaggattttttctcctgattttagttggcggtggtctacttaccctgccattttttagtaatagtgggcatgggacaaattttatcgatgcgcttttcactgcaacttctgccgtctgcgtgacgggattgacgacattgaatacagcagaacattggaacagtgctggtcagtttttgatcatgcttttgattgagattggcggtcttggttttatgatggttccgattctatgctttgcattgataaagaaaaaagtcagtctcagcacacgtatcatattaaaagaagcgctaaatctagaagaagtatcaggtgtgatgaagctcatgctttacatcctgaaattggcctttgtgatccaattgattggtacgattgctttatcttttgtattcgtgcctgaatttggctggttgaaagggatctggtacagtttgttccacgcaatctctagtttttgtaatgcagggtttgatttgttaggagacagtttagccaatcaccagcaaaatgtttatttgatcatggtggtatctgctttgattatttctggcggattaggctttatcgtttggcgtgacttattagaatatcatcagaaaaagaagatgacgattcattcaaaaatcgcattaaccgttacaggtacccttttattaggcggtttcgttgtgttctttttcacagaacacaatggggcaacattagtggaagggaatatgtttcaacgattggcaaatactttttttatgagtgtaacacctagaacggctggatattattcagttgattatctccatatgagtcatgccggtctgatcttaacgatgtttttgatgtacattggcggaacatctgggtcgactgccggcggattgaaaacaactacgttaggtgtgttgctgatccagatgcgttcgatgttgaaaggacgtacgagagcggaagcatttggccgtacaatccgtcaaggcgcagtgttgcgagcactcacgttgttttttatcacgttgacactgtgtgtagtcgccatcatgattttatcagtgactgaaacgatacctaaaacttctggcatcgaatatattgcttttgaggtcttctctgcatttggaacagtaggacttacgatgggattgacgccagacttgactgcaatagggaaattgattattatagcgcttatgtacattggacgagttggggtattgactgtggtcttctctctgatgacaaaagcacaaagaactcaatcaaaatacaaatatccagaagaaagtgtcatgattggataatttcatcttctgacagaaatctagtgatctagcaaaataagaaaataaaatataagacaaatttttttgctgtttggttactttaagtgcaaaatgttcatttgctttttgaggcactatccgttgttgaacttcgggtagtgcctcttttttatcgaaaggaatcaatcagctatgattcctttatttatcaatagattataattcatatttttttattttttcttttacgatacttagtccagaagctaaaatctcaaggttgtttgaagatagggaaatacgaacgtatgcatccggttgtgctcgcgtagtaaagcgtcgggaatgatagagtcggatgccgttagacagaaagtcattctcaatcctcttaggatcaatctcaggatcaactggaagaattcgataataaggaacacgattcgttggtttttctactttgaaaagagaatcaaaaagctgattagctcttttcgtaagatttaatttagtttctaagattctatttgcttcatttgaatggaggatttgagtgatgacctccacatctaatccagaagttttcacatttatattaaaaattgcttgttctatcttgctttggacatgtactggagctacaagataagcaactcgcaatccagaacaaataaattttgtcattccagctaagtagattgtttggttaggtaacaatttttggaaaggaggaataatcttatgttgataataagttgttaaaaaagaatggatatcatcttcgataacccatagaccttctttttcaattacttcggctaattgctctcgtctttggtgagagatttgaaaccctataggattattgcaagaaggcataagaaagacaccatggatcttcttttttctacattcctgaatcaatatatcaggtcgcattccttgctcgtcaaaatcaattggaacgatctctaaatgatataattgagccaattcaatgaaattagcgtacgtatatcggtctgttgctattctatcacctggagagaaaagtgcagaaagtgtgatagccaatccattttgaacaccggaaacaatagacagagattctaaagacggaatgactccttgagtttttaaccaatttgctgcagtagtcaattgaaaatttgtgcctttgggatcttggtaattaagcaaaccaacaagatttgggttattaccagttgattgaataaacgggacaacgaatttattacattcttcaaaagaactaaccagaccaaaatcaatgatatgttcggttacttcattggtagagatggtaatggattcaaagacattgggagaaataaaagtgccacttccaatattcgtatacagcaaacctttctcaattccgtatttataagccttgccaacggtagtaaaatttaaatctaaataatcagctagctctctttgggagggtaactgagtgtttttctgtaatttattctttaaaatatcttgttctaattgttgaatcaacgatcgataataaggacgcttcaatttttgtttgtctggccgccaagttaacgggtagttgtcataagaattaataggcattttctccactccttaaaattgtataccatacaattttaccattgattgtattgattttagaagttaatcttttgtgaggagggaattgtctatgaaaattattaattttgaggaagtagtagtttcttttagttttgaagaagcgatccaagtaatgaaaaaatgtttctttgattatgaaagtggtaaaatcagccaaaatcctcgattggtggaaattttaccggacggaaaagacaaaaatgtgtttgcgatgatgcctgcctatttgggagagaatagatattttggaacaaaagtcattaccgctttctcggataatcatcagtatcatttaccttctcatttaggagagattttcttgtttgatgctcaaaacggactacccagagcattgataaacgcaaatgcagtcacttggattcgaacagctgctgtatctgcgctagcaacagattacttagcagatcagcatgcagaaacacttgctttaattggagctggtcaacaagcattgtcgcatttggctgcgatttctaccattcgtcgcatcactacagtgtttgtttacgatattttagaagaaagacgaaatgcttttatcgctaatgctaaaaatcagtatcctaaaatgacgtttataaatgcaatatcagtagaagatgcagtacgctcagcggaaatcatttgtacgttgacccctagtaaagaggcatttcttcaaaaagagtgggtaagggaagacgcacatatcaatgctatgggcacgtttactcctaatacaagagagataagtacaccattgatggaaacttctcaaatctatgtagatgattactcagctgccttaacagaaagcggagacctacttatagccatgtcagaaggagatttagaggaatcttgtattgttggtacattaggcgaattagtttctgggaaaaaaacattttacaaaggagaatcgagtccgacgattttcgacgcagttggtctagctgttgaagatctttgctgtgcagaatatatttataacaaattagagagaggatctttaaaatgaacttagattattacgtagttgatgcatttgcagatgaggtgttcaaaggaaatccagcagcagtgtatgttctagaagaatggctgccagaaggtacgatgcaaaaaattgccattgaaaacaatttatctgaaacagcatttacagtgaagaaaaatcaaggatttgagcttagatggtttacgccagatcgagaaatcgatctttgtggtcgcgcgacattagcaacagcatttgttttatttaactattacaaaatacttgatgaaacgattaaattttctactcaaagcggtaatctatttgtgacaagaattgaagattattattgcatggattttcctagtattatgccaaaaaaagtaccaatattgtctgaatatgaagaagcgataggggctaagattaaagaagcctacttagcacgtgatttatttttcgtattagaagatgaaaaagcggtggctaaattgtagccagatttcacaagtatcaaaaattttgatttaggaataggggtcatcgtgacagcagaaagtgtacaagaagactttgtttctagaaccttctttccaaaattaacaatcaatgaagatccagtatgtggatcagcacattctaatcttattccttattgggcaaaaagaatgagtaaaacaaaattgtcagcttaccaaatgtcatcaaggggcgggtatctagagtgtgaattaaaagaagatcgtgtgataataggaggaaaagcagttttgttttctaagggaacctcgtttatttgatttctttcaaatgaactaaaaataaataagtgtagagtggcagccttatagctacaatagttgttaaaaaaagacgcaaactttttcaatttaaagaaagtttgcgtctcattttaattattggcgtttgttttttgttcaatcaagagcaaaatgcccctactaactagcctcggatgacttcgattttataaccatcagggtcaatgacaaagtagtaagaaggcgcagtgccaggtaatccttttaagtcagtaatttcaagacctgcagctttatgctgttcatgtaatttttctaaatcatcagctgcaatagcgatatgaccataaccatttcctaaatcataggcaccatgatcgtagttataagtcaactccaattcatagtcatccccaggaagtgtcaaataaacaagtgtaaatttgttttctggaaaatcacggcggcggctttcttcaaaaccaaatgccttttgataaaattcgattgatgcttcaagatctttcactcgaacacatgtgtgagccattttcatagattcatctctccctttccttttatttaatcataacaaaaagaagtaaggaaatagttgatttgtgcttgttcatgagaaatttctcatgtaaaatggatagaaaataaaactgttaaggtggaaactattcatggataaaccaatttttggtgaaaaaaagcaatttgctgattatcaaacccgttatgcagcatatatcgtcatagaaagagatcagcagattgcagtaatcgaggctccaaatggtgctttttttcttcctggcggggaaattgaaggagatgagacgaaagaacaagcaatcgttcgtgagctagtagaagaaatggggattgcggcagaaattgctttctatctgggagaagcagatgagtacttttactcgaattatcgtgcaacttattactataatccaggatatttctttgctgctgattcttggaagcgtataggagaacccacagaaaagaccaataaaatctggtgggtcagcccccaagaagcacttgaaaaattgaaacgtggcagccatcgatgggcagtcgagagatgggtcgaaaaaaataaaaaataaaaactgaaagaaagcgagtagaccagctttctctcagttttttatttattacagaacgtattttttgattgcttcagctacgccgtgttcgtcgttcgatgaagtgatgacatttgctgcttctttgacaagagaaacggcatttcccatagctactcctagaccagcatattcaatcatggataagtcgttctcgttatctccgatagccatgatttcatcttgatcaataccaagatgctgtccgagattcgcaactgccgcacctttacttgcttctttatttagtacttcaaagtaatagggtgcacttttgaccgttgtgtatttatcacggaaagtttgtggtaaacgtgcaattgctgcgtctaaaatttctggttcgtcgatcatcatcattttgacgatgttcatgtctggtgtcatttcttcaggtgttcgatattttagcggcatcttgactaagcttgcttcgtggatcgtataagcgctgatatctcgattaggtgtgtagatcgctttgtcatcaatcgaatggagatgactgccaacacggcgtgccatcacttcgatctctagaaaatcttcatgagtcagaccgtgacgggcaatgattttacctgattttgtttgttgtacgagtgccccattataagtaataacgtaatcattatcttgaaaaaggtccagctcatttaactgttcttggacacctggtaaggggcgaccagtacataaaacgattgagaccccttttgcaacagcagcggcaatcgcttcttttacttcttttgttacttctcttttctcatttaataaagtaccatcgatgtcgatagcgactagtttgatagccataatttcctccaatatatttcagtttatttcaatcaatgcgccattacggatatggctggcaaattcttgataagtttcatcaaataaatcataatgatcacgcaaggatgggtcaaccatttcttttggaaagaaaaatcgctcatctccttgttcttgtcccgctaaagcggcaacaagctgactaacctgtgataattctatcaaagttccgtcatttcgcaaaatctcgatttgcgtacgatgtctgccttgttctgggcgataaaaatcataaggcagatcgtagctagagttgacagcagtgtaataaacagggttatagccaaccttttctactaacaaagtgagtttttgaatcaaatttgaatctcggttgccagaaaaagtggcggatttcagtggtttacgattcaaaaaacgtttagctaaatcatttaaaataggatcagcagattcagaccattgagtaaagtaagtacccaagaccccatcatcaagtttgagatattcttctaaagtaaagcttccgtcaagaaatggcaagagtagttgagagtgaagttcaaaactgctggcatcttcttgatacaactcgtgcgcgcgatgaagcagatgctccaagatcacttccataccacgggaaacaggatggaagtacacttgcacatacatttgatatcggctaacgatataatcttccactgcatgcatgccgctcatagaaaaggcgatcccaccttcatatggacgaatcacacgtaatattcgggtaaggtcaaatgttccatactccgttccagtgaaataagcatcccgaagcaaatagtccattcgatctgcatcgatctggctggaaatcatttggacaacttgcggattagggtaggttttttggatcacgctcgctactttttcaggaaaaccttcttctactcggttaaggatctgatacacctctgtttctggagaagtgataatctctacagtgatagcctcgtgattcgtatggaagatatgctcgaatgtatgagagtaaggaccgtgaccgacatcatgcaatagtgccgcacataaagttactagccgttcctgatcatcccagcctccgttgcctatcttttcttttggaaaatttcgagaaaagatatcgcaaattcgtcttgaaatctcataaacacctaatgaatgggtaaaacggctatgttctgctccgtgaaaagtgaaagaagcagtgcctaattgtttgattcgtcgcagacgttggacttctttcgagttgatcaaatctaagattacttgatgctggacatggatatagttatggactgggtcacgaaaaactttctccataggcagcatttgatatttataaggggttgtcatattgtagctcctttatgttattacgttgttccattctctggatttggttgttccattgctccaactggatttctttttttagccagtcggtagaatccagtaaatcacttgcagaatacagcttttcaaaagcttttgcaaatgcttctttgacttcttctacgagaaggggatggtcaagcagttcttcaagtgttgccattgtggcaggatcaactgcaggatagccatttgtaccaaagccttcttttaaagcagattgataaaatcgtttcatgacttgcccacgcttttcctgattaccgttgacacttaagtacatcataacagaaatcccatttttgatgcgacgctgagcgatgccggcaaattttttgccatggatgcttaaatcataagttccaggacaataagaatgggtgatttcgaatgcttgaatcggtgccttcggaaaggcgtatttagtcaatcgaagcatttgctcgtaagcttcatcgatggttattttttttttgtcattctgggggaaaatcaaagaaatattcaaaatcccttcgtctgatacgattcctaatccacctgagtttctgattaccggagcataacctgcatctttcagtgtttggatcccgtctctaagaaaaggtgtccgaacatctttcatacctaagatgacggtgcagtcatattgccagaaatgcaaaaagatctgctggtgttctttggaatattccgttaatatatctgttaatgcgaaaggggaaaagtcgtttttttgataaatgtgctgatctagtcgaatcgcagggttcattcaaccggctcctttttataaattcatattttctacaatattatactctaaattcaaggagttgttttgaaaaaaaggttttctgtaaaaatggacaagttggttgacaaaacaaaagaaactaggaacaatgtagctatgagaagtaaaggagaatgaagaatggaattatcacaaggaacaccgatttcgatcaaattgcgtacaaaagtgaaacaacaaggggaagtgcaagatttttattttgatttgaaagggcaaatggtgacgattggcgatacgctgtacatacggtataaagagattcaggaggaaacaggcgatgaaatccctgtaacgatcaaattagttccagatggtcatgtacagctgatccgtgcaggagaaatgcgaatgcgtttgaaatttggttacaaagaacgattagaaacagcctatcgaacaccatacggtatgatccagattgctacctttacgaaagaactgcatgtaagtttgaaagaccgtcccacagcaggaaaggttcggatcgattatgatttgttcatgggactagaaaaaatcggcgaatattatttgacattggattttacagcgtaaatataaaagaaaagtttgattttttgtgtctgattttgtatgataaggagtagactgtgaaaggacgtgtcctgattggaaattagtgtatttgaaggtgcaaacaaaagcgaattatcaatgatcgaagtagcacacgcgatcttagaacaacgtggcgatgtcatggatttttctgatttagccaaccaaatccaaaactatcttggcaaatcagacagtgaaattcgtgattcactcgcacaattttatactgacttgaatattgacggcagctttatctcattaggggataatcgttggggtttgcgttcatggtatgctatcgattcgatcgatgaagaagtaaaccatggaatggacgaagaggatgaagatactccgcgtcgccgtaaacgcaagaaagtcaacgcctttatcaatgatgatgaagacgcgatcgattacaatgacgatgacccagaagatacagatctgacagaagaagacgacgatgatctgtttgatgacgatgatgatgaagatgaagaaatcgctgcttataattctgacttgcaagaaattggagcagatgacccaacagatgatgaagaagacttgcctgggaatatcgaagaagatttaagtatcatagacgaagacgatgatgatgaagactatgaagaggaagaattttctgactctgaaaaagaataaacatcattactgtagaggctgtgacggaagtggtcaacttcaagaaatttccacttatttccgaagaagctacttctagaacaccgtgtatcagaggttacaacagagacgttgaagctatcagaataagaaggtgtgacatgatttttgtcacaccttcttttttgtatataaaaattcaaagtaaatacataaaaaataaaataattgaaacttttagcgtaccttgtacgtcatattaagtgaggcggaaaggagtggagaatgatttttactggatataagaaaaaacggcagattgaaaaataccgtcacctgctgaatggactcatcgaaactgattatcaaaaaatgttccgtatcacgatgaattacgtacatgataaagaagaggccttagatgtgatgcaagatagtttccataaagcactgaagtattttgaaaaagaaaaagaaatcgagcattttaatgcatggttttaccggatattgattcgcacggcattagatagttggcgcaaacaaaaaaggacacctgttgacttatttgaaattcaagatatcccgcagcaattacctttagaaacttccgttgcagaactccatatgattttagataaaatagacagtccggaaaaagagattctgatcctttacttttttgaaggatttcgtttgaaagaaattgcgactatcttagatatgaacgaaaacacagttaaaacaaaaatgtatcgttcactgaatgttttacgtcaaatcctagaatgaaggagagaagaccgctatgtattcccaaaaagaaaagttaaaaaaactaaagaaaacttataaagaacaagaaattccaaaagggcttcaagaggagatccgtcagcgttttcttatcgaagagcaatcattcataaaagcaagacggagaaagagacgcctccaagggtttggagtatctttggctatcgtgatgattacaacaagtagtctcctttttaatagtcaagttcgaagctttgcagaagacttgcccattttaggatcagtcattgaattgatcttaggcgaacgttttactgatcaatctgaaaaaatcgatattcaagtaccgaagatccatactcaaaatgagaaagaaaacaaaacgattcatggattaaaccaaaaatactttcacgaaggacaagcagatttcaaaaaagctgaaaaagaatatggaaatcttgaaacggatcattaccaagttctgggtgattatcagaaaatcgtagacgatgaccggtttcttgtgatcgaaagacagattacccaaacagcagcggatagccacgttgaaaaaagatacgacacgatcgacaagaaaaacagtgtccagctctcacttccgctgttattcaaagatgacacctatctatctgttttgacaaaagaagtcaagcggcaaatggccgaacaagtcaaggaagatccgtctaagtactattggactgaacaagatattcaagaaggaacgatagaaaaaccaacacttgttacaccaacacgaagtttttatttgaataaagagcatcaattagttctgactttttctcaatatgaaattgctcctggttacatgggaacaccagaatttgtcattcccaagtccgtgacaaaaacgattttggcatcggaagattatttggatcattaggcgagaagtagttgcaactagcagtttcaattttttacagttattttcaagtaagtaattaagaagagaaaaagagaaagaagagatatagtgaaaagaaattacttagttatcagcatcattgctttatccgtgcttttatttttcgaagtcacttcggtcgcatccttgatcagcgaagagaaaggacaagtaacttcatcggagcgttcgtcacaatctttcaatcaatcagaacaatcaacgaataaaaacaagtcgactgaaacagctagagttaacgcatccactcaagaatcagtggaaccggcacaaggtcaatcaactgaaccagaaccaacacaagaaagtacagaagctgtccaagatccaactgtcaaaagtattgccatcagttttgatgatggaccaggagcgaccacgacaccacagctgttgcaaatacttaaagaaaaaaacgtgcatgctactttttttgttttaggagaaaatacggcgcaacatcctgaaattgtgaagcagacagctgaagcaggacacgagattggcaatcacacgtatgatcatcaggatctggcgacgctttctgcccagtcgattacggaggaagtgacaaaaacagacactgagataaaaaaagtcactggtaaaacccccactttcgttcgtccgccctatggttcgatcacaagtgtaggagcaagtgttatccagcggccaatcatcgaatggtcggtcgattcagaagattggaagacaagaaatcctgatttgattttgcagaagatccaagcaacagtatacgatggtgcaattattttattccatgatatttatcctgaaacgattcgtgccgttcctcaagtgatcgattatctgcaagagcaagggtatcgcatcacgacagtgggcgatttattagggcatccaacgactgtcgagaactattatggcagaaacgatcatcggccagtccagtaagtgagacaagtatctttaataaataacacatttgaataagtagttgaacacataactaccttacttgcaaaggcttaacaatatctatacagatacaacaaaaaactgtccaccaattttctttggcggacagttttcacttaaaaataaagaagcaactattcgtaaattatgttaaaatagcagtagaacgcgtcctgagggaatcgaacccccgtctcaagaaccggaatcttacgtgatatccactacactaaggacgcaagcactgggataattgtaactaaacagataaaaaattacaaggggattggacaaaaaaatgaaatttgagcaaaatttttcacaaaaacagcagcagacacagaaactagccatgacgcaacagttgcagcagtccatccaagttttacaatataacagtgaagagctgttggcattcgttgagaaccaagcaatggaaaatccattggtggaagttgttgagccggaatggcagccagattacataaaagcttcttcatcttcttatgaaggagaagagacaaattacctaaatcagattcctgatacaaaagggtctttatttgattcattgatcgaacaagtccatttgaattatcgagatacttttttaaggaaaatcgttctttatcttgtagaatacatcgatttgaacggatttttgacgattagtttagaggaagctggaaaagagatcggagcgacgcctatccaaatgctcgatgcgttgacactgatccagcaattagaaccagctggagtaggtgcacgtagtttgcaagaatgtctcatgcttcaaacggaacgggatgattatgcgcctgaactagcttatatcgtgctagaagaatgttttgagcaattggtggagcgaaaatggaaagagattgcgcagcgtttttctgttgatttacatgctgttcagcaaatattcgactatttgcaaacattgagcccaagtcctggacgaattttcgaccgtagtagcgaattgtacattattcctgatgtccgggtattagtggacgatgaaaatgtacaagtcatctcaaaccgaaaaaaccagccgaatatccgattccaagagacctacttcaagcaaatgtcacaacaagcagataaagaaactgaaaattatttaaaagaacggaaacaggaattcgaatggttgaagaaaacgatcctccaacgcggggatacaattttgcgggttgctcaagtcattgtttctcgacaaaaagctttctttatcgacaaggggcggccaatcagacctcttacgttaaaggaagttgcggctgagatagatgtgcatgaatctacggtcagtcgagcagtcaacgggaaatatttggaaacagatttcggtgtatttgagttaaagaaatttttcactgcaagaatccctactaacggtgcagaacagacagaagacctttcggcagatactgcgaagaaaaagttgcaggaattagttgatcaagaagacaaaagcaagccgttgtcggaccagaaattggttgaattgctgaaaaaagatgagatagcgatctcaaggcgaacggtagcaaaataccgtgatttattaggaatcccaagttcatcaaaaagaaaacgttatgataactgatcatccaaaagatcagaaaaagtattttgctttttctgatctttttagttgaaaaacgaaagaaaaactgttagactaacagtcgtgaggttgagatttccctttattgatgtgaaatttgaaaagttaatttcttttttttatcgtatatgggtcgttttaagtctacattggacgtaaagtgtccaactaaggagatcgctatgctagatgaaataaaaatgattgaatctgttgcaccagatattatcgaagtgttgcaagaacgctataaaattttacgaaatatctattggatgcagccgattggacgtcgaagtttatcggaaagtatggggataacagaacgagtattgcgaacagaaacagaccttttgaaaaatctgaatttgatcgatacctcaaaaagcggtatgacgctgacaactaagggcgaagaagtttatcaaagtcttgaaaacttcatggatcagcttttaggtacgcatcaaaccgaacaacagttggcagaatattttggtaatcagcgctgtatcgttgtttcaggaaacagcgaagagcaaaccaaagtggctgatgcattcggcgaagcgctgagtgaagccttagaccgactgcttccggaaggcgagaatatcatcgctgtgatgggaggaaccaccatggcagttgtagcagaacaattgtctaatctggaaaataaaaaacggcataacttgtttgtccctgcaagaggcgggattggtgaagcgataactgtacaggcaaattctgtcagtgcaagaatggctgctaaagcaaatggaaaccaccgtgcactttatgttccggaacaattaagtctggcaacttacaattctttactcaatgagccatctatccaagaagtcttaaacttgattagtgaggcgaattgtgttattcatagtattgggcgtgcattacacatggcagcacgtcgaaagatgactgaaaaagaattagtcatgctgaaacaagcaaatgctgtagcggaatcctttggctactttttcaatgaaaaaggcgaagttgtttataaggtccctagaatcggcatagaattgcaagatttggcgaaagtcccgatcatcatggcgatagcgggcggaaaatcaaaagccaaagcaattcgagcttatatgaaaaatgcaccaaaacaaacgtggctcatcactgatgaagctgctgcaaacgagattttaaaaggggtaaccctttaaaataaatatttttttgattttcataaggaggaaatcttaaatgacagttaaagtaggtattaatggttttggacgtattggacgtctagcattccgtcgtatccaagatgtagatggaatcgaagtagtagcaatcaacgacttgacagatgctaaaatgttggcacacttgttaaaatacgacacaactcaaggacgtttcaacggaacagttgaagttcatgaaggttcattcaacgtaaacggaaaagaagttaaagtattagctaaccgcaacccagaagaattaccatggggcgaactaggcgtagatatcgttctagaatgtactggtttcttcacttctaaatcagcagctgaaaaacatttaacagctggtgctaaacgcgttgttatctctgctcctggcggaaacgatgttccaacaatcgtttataacacaaaccacgaaacattaactggtaaagaaacagttatctcaggtgcttcatgtacaactaactgtttagctcctatggctaaaacattgaacgacaaatttggtgttgttgaaggattaatgacaactatccatgcttacacaggtgaccaaatgactctagacggacctcatcctaaaggtgacttccgccgtgcacgcgctgctgctgcaaacatcgttcctaactcaacaggtgctgctaaagctatcggtttagtaatccctgaattgaatggtaaattagacggagctgctcaacgtgttcctgtaccaacaggttcattaacagaattagtaacagttcttgaaaaagaagtaactgttgacgaaatcaacgcagcaatgaaagaagcttcaaacgaatcttacggatacaacacagacgaaatcgtttcttcagatatcgttggtatgacttacggttcattatttgatgctacacaaactaaagtaatgacagttggcgacaaacaattagttaaaactgttgcttggtacgacaacgaaatgtcatacactgcacaattagtacgtactttagaatacttcgctaacttataagatagacaaacgtacaagtgtaaatgatagacatgtacatttaaaagcggggaagcaatcgcgcttcttccgctttttttgataataagtttattcaggaggaaataaaatggctaagaaaacagtgaaagatatcgatttaaaagacaaaaaagttcttgtccgtgttgacttcaatgttcctttgaaagacggcgtgatcactgacgacactcgtatcaaagcagcattgccaacaatcaactacgttttagaacaaggcggaaaagcaatccttttctctcaccttggacgtgtaaaaacagaagaagataaagaaggaaaatctttagctccagttgcaaaacgtctaggcgaattattaggtaaagaagtaacattcgtacctgaaactcgcggagaacaattagaagaagcaatccgcaacatgaaagatggcgacgttgtcgtatttgaaaacacacgttttgaagatgttgatggtaaaaaagaaagcaaaaacgatacagagctaggtaaatactgggcttcattaggtgatgtatttgttaacgatgctttcggtacagctcaccgtgcgcatgcttctaacgtaggtatcgcttcaactggtatcccaacagttgctggattcttgatggaaaaagaaatcaagttcatcggtgaagcagtagaagaaccaaaacgcccaatgatcgcaatccttggtggcgcaaaagtttctgataaaatcggcgtaatcgaaaacttgattcctaaagcagacaaaatcttgattggtggcggaatgacttacacattctacgaagcaaaaggaatcaagatcggtaactctctagtagaagctgacaaaatagaactagcaaaagaattgatcgaaaaagcaggcgacaaacttgtcttgccaatcgacaatgtctgtgcaccagaattttcaaatgatgtagaaacacaagtaatcgaaggagacattcctgacggtttgatggctttagacatcggcccagcatcagtaaaattatttgctgatacattacaaggtgcaaaaacagttgtttggaacggacctatgggtgtatttgaaatgagtaactttgctaaaggtacaatcggtgtttgtgaagcaatcgctaacttagaaggcgcaacaacaatcatcggtggcggagactcagctgcagcagcagaacaattaggttttgctgacaaattcacacacatctcaacaggtggcggcgcaagcttggaattgcttgaaggtaaagaattaccaggactagcagcaatcaacgataaataaacagccaagtttgctctattctgacgagtgatcgatcaaaaggtgaagggagttttcatgactccctagccatttttcaataaattaaggagtgtgttcctcaatgcgtaaacctattatcgcaggtaactggaaaatgaacaaaactgcatcagaagcaaaagaatttgctgaagcagtaaaaaacaaaatcccttcaaatgacaaggttgattcagtcatcggatctcctgcattattcttacaagaattaatgacatcagctgaaggtacagaactaaaaatctcagcacaaaactgctactgggaaaactcaggcgcgttcactggtgaaacttcaccagcagctcttgctgatctaggtgttcactatgtgatcatcggacattcagaacgtcgtgaatatttccatgaaacagacgaagacatcaataaaaaagcaaaagctatctttgcaaacggtatgacaccaatcttatgctgtggcgaatctttagaaacatatgaagcaggcaaaactgctgaatggatcgaaggacaaattacagctggtttagctgacctttcagctgaacaagtgtcaaacatggtgattgcttatgaaccaatctgggcaatcggtactggtaaatcagctgacgcacaaatcgctgacgaaatttgtggtgttgtacgtcaaacagttgaaaaactttatggaaaagaagtatcagaagctgttcgtatccaatacggcggttctgtaaaaccagaaaatattgctgaatacatggcaaaagaaaatgttgacggtgctttagtcggcggcgcaagcttgcaagcagattcattcttgtcattgttagacgctgtaaaataattggtgaaaatttgcgaaaaatgcaagaaatgtttgcactaatgagcaaaattaactaaaatcgtatatgagggaaatcccttaggaaaaaacaaactcaaaggagagacaaaacatgtcaattattactgatgtttacgctcgcgagatcttagactcacgtggtaacccaacaatcgaagtagaagtatacacagaaagcggagcttttggccgcggaatggttccttcaggtgcttcaactggtgaatacgaagcagttgaattacgtgacggagacaaagctcgttatggcggtaaaggtgtaactaaagctgtcgacaacgtaaacaacatcattgctgaagcaatcattggctacgatgttcgtgaccaaatggctatcgacaaagctatgatcgctttagacggaactcctaacaaaggtaaattaggtgcgaacgctattttaggtgtttctatcgctgttgcacgtgcagctgctgactacctagaagtacctttataccactacctaggcggattcaacacgaaagtattgccaacaccaatgatgaacatcattaacggcggatcacatgctgataactcaatcgacttccaagaattcatgatcatgcctgttggcgctccaacattcaaagaagctctacgtatgggtgctgaagtattccatgcattagcttcaatcttgaaagctcgcggattagcaacttctgttggtgacgaaggtggatttgctccaaaccttggttcaaacgaagaaggtttcgaagtaatcatcgaagcaatcgaaaaagctggctatgtacctggtaaagacgttgttcttgctatggatgctgcttcttcagaattctatgacaaagaaaaaggcgtttacgtactagctgactcaggcgaaggtgaaaaaacaactgacgaaatgatcaaattctacgaagaattagtttctaaatatccaatcatctcaatcgaagacggattagacgaaaacgactgggacggattcaagaaattaactgacgtattaggcgacaaagttcaattagttggtgacgacttgttcgtaacaaacactcaaaaattatctgaaggtatcgaaaaaggaattgctaactcaatccttatcaaagtgaaccaaatcggtacattaacagaaactttcgaagctatcgaaatggctaaagaagctggctacacagcagttgtatctcaccgttctggtgaaacagaagattcaacaatctctgatatcgctgttgcaacaaacgctggtcaaatcaaaacaggttctctatcacgtactgaccgtattgctaaatacaatcaattactacgtatcgaagaccaacttggtgaagttgcagaatacaaaggtttgaaatctttctacaacttgaaaaacaaataattcttttctaatgaagatacatgatcgatcgattgaaagatagacgagcatgatcacttagttaagtaatcagactctctacctgctgatttcagcaagtagagagtttttttgttgtgaaaatcatttgatgaataaatctcttttttaagaacagaaaaatcgggagagtacataaattattataataacaactgtttatttatatgtatcatataaaccctattatataaatatccatatttattaaaaataactcataattttatttttgtaactggcttctgtatataatatttacaaatatcgatacgagataatcgtatcgaaaaaaatcagttatcaagagataacatcgtataggaccttttaaggatagaacaataagagaggaggaagcagtcttcgtttcattcatatccttttacgctcggataggatgattctcttcaaaaaggggatggcaatcttcctctttcgataaaaatcatttgaacagggagacagaaaaatgaaaaaattttagataattacaatgataaaaattataaatatgggataactacaaatatttttgggatggatccgacttactgttctaaaatcgtctggcaagcttattggtatgcttcggctgctgtgcaggtaggaggaatgtatcagccgcttattgctttgccatacgatcttcctgattattttgatgaaagagcgatccatatcttaacatgggagaattgatgatgagaaggaggatttctaaaaaaagaaattactgttctaagatttttatttcgataggtttactgttagggggtacatggctctatcaatttccaatcaagaaacatatagctacacgagcactgtatcaattattagaggaggaataccaattaaccgattatgatatttttatttcaagagtggtgaaagatacgaaaagtggtagaggcggtgtcagtatttttttcatggtaaggaatagtttgtatgaatatgagtatgactactctcttgaagaaaataattggctacgtggttattacgtaaggaggggtaattatagatcatgtgatactcttattttcaatgatgaggaataaaatgatttgactacagaagaacagttcaacaaagtagcttctcttgtttttttacttgattggatttactagcgtagaggcaagattttgaacgccatttacttggaaaaggggaatgtgacgctgcttttgtcacgcccttttttttctgtggcctctcttatttgaaaatctaggcgtactccaatacaataaaaagaaacggcaaaggagaagattagatgaaaaaagaagaaaaaattgcgattttacaagagattatccgaataaaatcagtgaatggaaacgaaggcgaagtagcagcttatttgaataagcttttggaaaaacatggcataataggagaactcgtttcttacagtaatggtagagataatctgattgctcaattccaaaaagggcaatcaggaaaagtgttaggcctatctggtcatatggatgtcgtggcggcggggaatgaatcgtcttggacctatgcgccctttgcagcagaaatccatgggaatcgtttgtacggacgtggtgctacagatatgaagagtggcttggcggcaatggtgattgccatgatcgaactcaaagagtcaggaaaaccatttaacggaacagtcaaattattagccactgtcggagaagaagtgggtgaattaggtggggaacagctcacgaaagctggttatgtggatgacttagatgccttgatcatcggagagccaactaattacagtttgatgtatacacacatgggatcaatcaactatacggtcatctcgcacggaaaagaagcgcatagctctatgccagaccaaggctataatgcgatcaatcatctaaatgaatttattacgaaagcaaatgctgaaatgaatcacctcgctgaaacaatcgagaatcccgtcttaggaaaaacaatccataatgtcacgttgattagtggcggaaatcaagtaaacagcattccgagccacgcgcagcttcaagggaacatccgatcgattcctgaatatccaaatgataaaatcattgcattactgcaatcaatcgtcaagaaattgaatcaagagacagactaccatttggaattgacgatcgattacaacaaaatacctgtcaaagctgatccagattctcctttgattcattgcattcagcaacaattcagtcagccattacctttagttggagcggcagcaaccacagatgcagccgaatttacgaaagctgaccactcctttgactttgtcgtctttggacctggtgtcgttactttgcctcatcaaatagatgagtatgtcgagctcgataattatttagatatgatcgaaaaatatcaagctattattttatcctacttagcgtaagttttttaatagatgaaaaacagagccagatgagcaactttttgctcatttggctctgtttgttcatcctatttttctcttggaatatatcaagcgctgcggcaacatagtgatgactaatgaaacaacgacgacagatagcagacggtcaaggtagtctgtgcctgcctgtaccaagatcacactgatggtttgatcgaaacctaacccatgtaataattggacgatcatgctagaccctgaggaagtgattccgccaaataactgaacggtaatgatcgaagagacgatcgttccaggtacagacaaaatcaaagcgagtaataagagtttcaaacgttttttatctttgtcgagataccttggtaaaatcaatccagccaacaaacctgtgaggatttggatcggtgaataatacagtgaaaaaatatctgtagtcaccccacttaatacaccgctggatagtcctgtcaacattcctggtatgggaccaagtaacgcgccagcaaaaatcgttccaatagagtctagatagattggcaaacgaagccataaagcaatcgttcctccaacataattgatcccaatacacaaagccatcattgtaagtacgcgagttgccatcttgtttttattcattttgttaacccatctttaacctttccaaatctttcataatcgtttcttcttgtgcatttaaaagaacggttaaaaacttttggaaaaaaagacgagtatctacttttatcataattttactgttagcagatttctgccaaaattcataacgatcaaccaatgtttgtccgcgacttattccttgagtttctacagcagtgaagcttttaaagccttcacagatggactcatcgataaaataagcaacagctaacggatcattgatgacacatcctaagattctttcttgtttccagtgaaagtcaaaataaaaacgagtgatcgcttttagatactctccctcttcaggattcatttggcagcaatattcaaggatagtcggtgtcaagacgatttctcttgtcacatctaacccaaccatttctatcggttgtttgagcttttcgaatacataagaagctgcttcaggatcacaccagtaattgtattcagcaactggtgaacagttaccatggactttgtaagttccgcccattgagacaaaacgatccatatgtttcccaacagatgggttgtttttcaaagcagaagcgatattggtcaaaggccccaaagcaatgactgatgtatctgttttttctttgaaataatcagtcagaaaatcaactgcatggagcgattctgcctgtttggctaagaccatcgggaaatttgtgtcccctaatccatccaacccatgagtgtcttgcgcactaatgaaaggttgcttcaaaggtttttccattccttgataaacagggatatctaaacgatcacagcgttccaaacatttcagcacattctgcgtaccgatatctacagggacattcccacaaacgacggtaatagcaactacttcgatatcaggggatttgacagctagtgataaagctaaagtatcgtcgatccctggatcgcaatcaataattacttttcgcattatttccaatctcctttctttagagatacttagttttttattctgggaagtttccgaaccagtccaagacgagcgtcttgtttataatgcacgaaattagtatactggcttttattgtgaatgtaaatgctctcttacaagtaaatctattgagaagaactttaagtaaatgatacaatgaaaaggaaatggaatttacgtgtgccgaagaaaaagaatcctattgatcggtatattgtataataaatagattatagtttggcagaaagcggcgggtgtacgatggttattttttatttcattcttattctgataattataggaatcagttaccattttctttcttatttttatgcaaagaaattagtaagagcgggagtacagagaggctatgactggtatgaagacactgggcaccgcttgatggatcctgctgcagtcacgtcagtagaaaaaaagcggcaaaaattagaagaagaatgtgaaagcttctgggaacaaggaataccgaaaacgatcaaaagttatgacgggttgaaactagctggacagatgttcctccaaccaactcagcagaataaatgggtcatttgtgtacatgattatcgaagtacagggaaaagagatatgtctcatataggtaaaagatatgcagagaaaggattcaacgttcttatacccgatttacgtgcgcatggagaaagtgaaggagaaatcatcggaatgggatggctagaccggctagatttaattgcatggatccaactcatcttagatgaacaaccagatgcatccattattttgcacgggggttcaatgggcgcttctacaattatgatggcaagtggtgaaaagcttccatctgcagtcaaaggatttatcttagacagcggatatgtttctgtttatgcggaatttcggtacatgttaagtaaaatcacggtctttcctaaaaaaatgatcatgagatatgcgaatcactatgctcagaaatacgcaggttattctttaaagcaagcatcagctacaagacagcttggtagtaaccatttgcctttgttagtcatccatggtgaaagagatcattttgttcctacagaagcagcatacacgattcaaaacgctacggcaggggataaagcattactgcttgttccagaagcagaacatttggaagcatcgatgaaagatccgaaaacctattggacagtgattttttcatttattgaacaaagaataacgatggattgattttctcttcctttttgtaagcaatccgaggataaataattgtttatagaccatgagactgttaaaataaggtaggaataaaaaaatatcagttatttgaggagtgcggcatatggaaatcaaagaggaaaaaaatcgtcttgctttattcaatgatgagcaacaagaaatcggagaaatgacatggtcggatgcggggccagacatcatgatcattgaccatacatttgtcgatccagcatatcgtggtcaaaaattagctgaaaagctagtgtatactggagtagaactagcaagacgagaggggaaaaagatcatccctttatgcccttacgcaaaaaaagagtttgagaagaaaccagagtatcatgacgtcttacgccaatcataataataacagctgaaagatttgcactttcagctgtttttccatttatatagagttgtcacggagttttatctatgataaagttaaagagacgatatcttttgggaaggaggctgctatatgtataatttaattttgggaatcgtgatcgttttatcgattgttatggtcattgcgattatgatgcagccaagcaagcaaaatagtgcagcgagtgcatttaccggcggtgcggatcaactattcggcaaacaaaaagctcgcggctttgaagctgtcatgcagcgatcaactgcagtcatgggagctgtctggatgatcttattatttgtcctagcatttttatcttcgaagtagtcgaataagcctctcgcacaacggcgggcggctttttttattgcaaagagaacgcttaagaagaagttatgaaagaaactatggtaaaatgaggcgaaagaggtgaaacgagtgaaacaattaccaaaacccctttatgcaaaacatggaaaacgagcagttttgctgcttcatgcgtactcaggaagtccaaatgatgtccggatgctcgcacggtttttagaaaaagcagattatacagtctatgcgccgctatttaaaggacatggaacgatggagccatatgatatcttgcaagaaaaagcagaaagctggtgggcagatactaaaaaagctatccattttttacagtctgaacagttttctgatattgccgtattgggattatcgatgggtggcatctttgctgtacgggcactagaagaagaatcagtaattggcggcggttttttctgttcgcccatgtctcctgtagaaacaaacgtgcctgaaaattttgaaaaatatgtacgtcaagtgctgaagatagcaggcaaatcagaaaaagaaatcaatgaaaaagctgtgtcttaccgctcgttagctgaacatcaattaatggatatacaagaccaagcagcaatcgcagaaagtagactatcagatatccaacagccaatatttttagctcaagctgggaaagatgaaatgatcgacccaaatggtatatttgaaacggcacgcaaattgagccgccaacgggtgacacttcaatggtatcctgaaagcggtcatgtgattacagttggcacagcaagacgcgaattagaaaaagacgtgttggaatttttagaaaaattaccttggaatgaggaataaatatgacaaaagaaacaataaaagagaaaattctctttttcatggaaagcagtcgcaaacgtagtttttctatggaagaaatcgctgaaggtctaggctttcaaaaaagcgatgattttaaattactagtacaaacgattgctcaaatggaaagagaacagagtatcgttttcaataaaaaaggaaaagtcaaacttcctttaaaaccgatcttggtcgaagggacatttcgggcaaatgaacgaggatttggatttgtaacgattgatcccgaagaagatgatatctatatcccgaaagaagcgactggctttgcaatggatggggataccgtagcaattgatatcatgaagcgagcaaatacagatatggatcgcggagcagagggaaaagtagtggagattcgagaccgagcgactactcagttagccggagaatttgttgcttattcagacgaagagatacaggaaacggatctttatggtgtggtcatcccgaaagatagaaagcttaaccaattcaaagtgtatgcagcggcagagggagttcgtccagttgacggaagtattgtattgatcgaactgacccattaccctgaaaaagggtatgcgactagtttagaagggataatcaagcaagtgattggtcataagaatgaccctggcatggatatcctctcgattgtcgtggctaacggtatccctacaaaatttcctgatgatgtgttgtctgaggcagatgaagttccagaccagatcagcgaaaaggatattgttggacgcagagatttaagagatcagctcatcgttacgattgatggagaagatgcaaaagatctagatgatgcagtgacggtcaaaaaattagaaaatggtaattattttcttggagtacacattgcagatgtatcttactatgtgacgcaaggcagtcaactggacagagaagcatacgaaagaggaacaagtgtctatttgaccgatcgagtgattccgatgatcccacaacgtttatccaatggtatctgttcattgaatccccatgttccacgactcaccatgagttgtgaaatggagatcgatccaaatggacaagttgtctctcatgagatttttccaagtgtgatccaaacaacagaacggatgacctacacagctgtcaatcaaatcttagaagatcaagatgaagaaacgatgcaacgttatgctcagctcgtgcctatgttccaagaaatgggtgaattgcatcgaatccttgaaacgatgcgaatcaaacgtggagcgatttcttttgaggatcgtgaagcgaagatccttgttgatgctgaaggacacccaaatgatatccagctaagaagcagagggataggtgaacgcttgatcgaatcctttatgcttgccgccaacgaaacggtagctgaacattataataaattaaatcttccgtttatttatcgaatccatgaacagccaaaagaagaaaaaatgcagcgcttctttgattttgcttcagctttgggcattctggtacgaggaacgaaaggaacgatcacaccgaaagatttacagcatgtgatcgaaggagtagaagataaaccagaagcggcagttatcaatactatgttgctaagaagtatgcaacaagcacgctattcagaagacaattttgggcattatggcttagcagcagattactacacacattttacatctcctattcgacgctatcccgatctgatcgtccatcggctgatccgttcttatagccaagataaaagtgaaagcaatcaaagtttatgggctgaggaacttcctgaaatcgcggatcatagttctaagatggagcgtcgcgcagtagaaacagaacgtgaagtagatgcgatgaagaaagcagaattcatgatggacaaagtgggagaagaattcgacgggatcatcagctctgttgtgaaattcggactgtttatcgaactaccgaatacagtagaaggattgatccatatcaatgaattgaaacaagactacttccattttattgaaaatcatttagcgcttgtaggtgaaagaactggtctgacttttaaaatcggacaaaaagtgcgcgtaaaagtagtcaaagctgatccagatgaacgagcagtggattttgaactcgtttccgcagaagaggtcactgcgttggaacgtccaaaagcacgcaatggaaaatctggaaaacgagaaggaaaacaagcaggcaaacgctcagaaaaaaatggcaagaagaacaaacgatatagtgatagtaagcaaacgttcggtaagaaaaaagggaaaaagccattttacaaaggtgtcaaaaagaagaaaaagaaaaaataaaatgagttggaggaaacagctatgccaaaaggcgagggaaaactaattgcacaaaacaagaaagctcgccatgattattcgatcatcgacacgatggaagcagggatggtcttgcaaggaacggagatcaagtcgatacgaaacagccggatcaatctgaaagatggatttattcgcgtccgcaacggggaagctttcttgcataatgttcatatcagtccttatgaacaaggaaatatttttaatcatgatccgttgcgcacgagaaaactattattgcacaagaaacaaatcgttcgtcttgaaaacgaattgaaaaacacgggaatcactattgttcctttaaaagtctatattcgtaacggctatgccaaggtattgattggtctggcaaaagggaaaaaatcgtatgataaacgggaagatttgaaacgaaaagatatcgatcgacaaattgatcgaacattaaaaaatttctctagataatttcattatcctttttcgcatattcggtgcttttgcttttacttaatgataaaatttgttagcatttaatctgataaaacatgattatcacaggttttttcttagatcaggagcaccgtgcatggggaaaaattcgcttcgtttttgactgaaataaaaaagtgtctaattttcatgaaaatgttttgaattttctgtttcatggtggtatgataccgtgtggttagaaaccgattggaaaaaaaccagatacgcacatgaattgattttatgtgaatttcggggaaaagaggtgaaatggattggatgaacgctcgctaacgttccacattggaccaatttggtttgatggtacagtttgtataatggtgttactgacctgtttgattgttttcttcttagcttacttttttacaagaaatcttaagttgaaaccaacaggcaaacaaaatgcgatagaatgggtcattgattttagtcgaggaatcgtaacagataatctgcctagaaaagaattgagcaatttccatttgttggcatttacattgtttttatttgtttttgttgcaaacaacatcggtttagtaacaaaaatcgtcttacctaacgaaacaacactttggaaaagcccgacagcagacccgtttgttactttaactttggcatttataatgatcttacttactcacttattcggggtgaaaaagttaggcttcaaaggatatttcgtaaattcgttcttgaaaccctatagttttatgtttccgatgaaactgattgaagaatttacaaacttattaacacttgctttacgtctttatgggaatatttatgcgggggaagttttgctaaccttgattgcaaaaatgatgacaagcttaggctggttctcattaccattagcaattccattagagatggtctggatcgcgttctccttgtttattgggagcatccaagcatttgtctttgtcactttgtcaatggtttatatgagccataagattgaagtagaagaataatactcggttaaaaaacaaactactatttatctattttaggaggaaaacaattatgaattatatcgcagcagcaatcgcaatcatgggagcagcaatcggagccggttatggtaacggtcaagttatctctaaaacaatcgaatcaatggctcgccaacctgaaatgtctggtcaattccgtacaacaatgtttatcggggtagctctagttgaagctgttcctatcttaggggtagttatcgccttgattctagtttttgccgtttaattgaatcagtattaaggcagaaacaacatcgtttgttactgcttttttacatggaaactagaaatactccaaagaaaggaaggctcgcctatgctgaatcaattggcaattgcagaagttggcaatgcgatgttaggtaatatcatcgttgtcagcggctcatttttgatactactggctctcttgaagcactttgcttggggaccaatcagcgatattttgaaaaaacgtgaagacaagatcgccaatgatttagattctgcagaacaatctcgcatcaactcagcgaaaatggaacaagaacgcgaacaacaattgttagcctctcgttctgatgcagctgatatcatcaaaaatgcgaaagaaagtggagaattaagccgccaaaatattttgaaggatgctcaagaagaagcagctcgtctaaaaagcaaagcccaagctgatatcactgtagaacgtgattcagcgctgaactctgtaaaagacgacgttgcagaactctctcttcaaatcgcggaaaaaatcttgaacaaagaattatctccagaaatgcatgaatcattaatcaatcaatacattgaaggtctaggttcttcaaatgaaactagataaatatacagtaggaagacgttacgggaaagctttatttgaactggcgatcgattcaaatcaagcagaagaaatctatcaagatctcgtaagtttacgtcaaatctatgaacaagtacctggattaggaaatatgttaagtgatgttcgtctagaacctcatgaaaaacgagaaatcatggacaagcttgtcagcggttatgatgggatcgttaaaaactttttagaagttgtttatgagtataaccgaatggatgaccttttgttcatgatcgaagaatatgaacgtcgatatgatgaacatcaagggttactattgggaagtgtcacaacagcagtcccactttcagacgaacaacgaatacaattagaaaagaatgttgcaaaaacaatggactatcaatcagttgaattaaaacaaatcgttgattcttctattattggtggcgcgattgttgaagccaaccatcgagtaatcgacggaagcattcgcacgcaattagaaaaaatgcgtaatcaattaaacagatagtacaaagaggtaggtgaatcgaatggccatcaaagcagaagaaattagtgccttgattaaagaacaaattgaaaattatcaaaacgtgctttcagtcgaagaaatcggtaccgtaacttatgtaggtgacgggatcgctcgtgcacatggtttagaaaacgcgatgagtggtgagttgcttgaattttcaaacggctcatacggaatggcgcaaaacttagagtcaaatgatgtaggtatcattatccttggcgatttcgagtccattcgtgaaggagataaagtaaaacgaacaggtaagatcatggaagttccagttggagaggccttgatcggtcgggtagtcaatccgctaggtcaaccaatcgacggactaggtgaaatcgttactgacaaagctcgtccagtagaagcgatggcaccaggtgttatgcaacgtaaatctgttaacgaaccaatgcaaacagggctaaaagcgatcgacgcccttgtgccaatcggacgcggacaacgtgaattagtcatcggtgaccgtaaaacggggaaaacttctattgcgatcgatacgatcatcaaccaaaaaggtcaagatatgatctgtatctatgtagcaatcggacaaaaagattctacagttcgtacacaagttgaaacattgaaaaaatatggcgcaatggattacacaatcgttgtgaatgccggtgcgtctcaaccagcaccattactttatatcgcaccatatgctggtactgcaatgggtgaagaattcatgtacaacggtaaacatgtattgatcatttttgatgatctttcaaaacaagctgttgcttatcgtgaactttccttgctacttcgccgtccaccaggtcgtgaagcttatcctggggatgttttctacttgcactcacgtttactagaacgtgcagcaaaattaagtgatgatctaggcggcggttcaatgactgctttgccatttgttgaaacacaagctggagatatctctgcttatatcccaacaaacgttatctcaatcactgacggacaaatcttcttagaaagcgacttgttctacgcgggtactcgtccagcggttgatgccggactatctgtctctcgtgtagggggttctgcgcaaatcaaagcaatgaaaaaagttgctgggactttacgtctagacttagcaagttatcgtgaattagaagcatttacacaattcggttctgatttggatgcggcaacacaagcaaaactaaatcgtggacgccgtacagtagaaatcttgaaacaaaaactgcatgcaccgctagctgttgaaaaacaagtagtgattttgtatgccttgacacatggattcttggacagtatccctgtagacagtattttagacttcgaacatgaattattcgaatatctggataccaatcattcagatatttttgaaacaatccgtacaacaaaagatcttccagaagaagaaacgttgaacagtgcgattcaggaatataaagatatgttcttagctacaaaaggaaataattcctctacagaagataaattgaaatccattcaaaatgcatagtgaggtgagatgaatgggtgcttcattaaatgaaatcaagacacgtatcgcttcaacgaaaaaaacgagccaaatcacgcgggcaatgcagatggtgtctgcttctaagttgacaaaatctgaagcttcttcacagaagtttcaggtttatgcaacaaaagtaagagaaatcgttacgcatttgactgctactcagttaaatgatattgcttcagaaaatcctagaggggatatcaattacaacagcatgctgctcagccgtcctgtgaagaaaaccggttatatcgtcatcactgcagatggcggtctggtcggtggatataacagttcgatattgaaacaaacgatgtctattttagaagaagaccaccaatcacccgatgattacgtgatgatcgcaattggcggaactggtgcagacttctttaaagcacgcggtatcaacctagcatatgagctgcgcaatttatctgatcagccaagctttgatgaagtccgcaaaatcgtaaatatggcaacaactatgtaccaaaacgaagtattcgatgaattatacgtatgttataaccatcatatcaattcgctaactagtcagtttcgtgtagaaaaaatgctgccaatctcagacttagatccagaagaagcaacgactttcgaacaagaatatatttttgaaccttcaaaagaagaaatcttgtctcagttattgcctcagtatgctgaaagtttgatctacggtgcgatcgttgacgccaaaacagcagaacatgctgctggtatgacagcaatgaaaacagcaactgataatgctgctaatatcattgatgagctgacggtttcttacaaccgtgcaagacaaggggctattacccaagaaattaccgaaattgttgccggagcttcggcactagaatagtattgagattggaggaaaaaagatgagttcaggcaagattgttcaagtaatcggtcccgttgtcgacgtggaattttctttagaccaatccttaccagatatcaacaacgcattagttgtttataaaaatgacgaaaataaatcaaaagttgttcttgaagcagcattagaattaggggacggagtgatccgaaccattgcaatggaatcaacagatggtttacaaagaggaatggaagtcattgatacaggcaaagcaatctctgttcctgtaggtaaagaaacattaggtcgcgtattcaacgtactaggagatacgatcgatttagaaacacctttcccagaagatgcggaaagaagcgaaattcataaaaaagcaccagcctttgacgaattaagtacaagtacagaaattttggaaacagggatcaaagttatcgacttgcttgccccatatttaaaaggtgggaaagttggactatttggtggtgccggtgttggtaaaaccgtactgatccaagaactaatccataatatcgcccaagaacacggtggtatttctgtatttaccggtgttggtgaacgtactcgtgaaggtaatgacttgtattatgaaatgaaagattcaggagttatcgaaaagacagccatggtgttcggtcaaatgaacgaaccaccaggtgcacgtatgcgtgttgcgttaactggtttgacgattgcagaatatttccgtgatgtagaaggccaagatgtactgttgttcatcgacaatattttccgtttcactcaagctggatctgaagtatcagccttgttaggacggatgccttctgcggttggttatcaaccaacattggcaacagaaatgggtcaattgcaagaacgtatcacatctacgaaaaaaggttcgattacatcgatccaagccatctatgtgccagccgatgactacactgacccggcgccggcaacagcattcgcccatttggatgcgacaaccaacttggaacgtaaattaacagaacaagggatttatccagcggtagatccattggcttcttcttcaagtgctttagcacctgaaatcgtgggagaagaacactataaagtagcaacagaagtccaacacgtattgcaacgatatcgcgaattacaagatattattgctatcttaggtatggatgaattatccgatcaggaaaaagtgttagtttctcgtgcccgcagagtccaattcttcttgtcacaaaactttaacgtggctgaacaatttactggtcttccaggttcttatgttcctgtagaagaaacagtgaaaggattccgcgaaatcttggaaggcaaatacgatgatcttcctgaagaagctttccgaagtgttggccgaatcgaagacgtcgtagaaaaagcgaaaacactaggctactagaaaggggtgccccatggatcaatatttaacagtaaatgtggtaactcctgccggtttggtctatgatcaccatgcagctatcgtcgtcgcacgtacgacagctggtgagcttgggattttgcctaaacatgcaccgatcatcgttcctttgacgattgatgaagttcgtgtaaaacggacagattcagatacccatgtcgattggattgctgtgaatggcggaatcatggaagtgcgtgataatgttgtttcaatcgttgctgatagtgcggaacgtgaacgggatatcgatgtatctcgtgcggaacgtgcaaaacaacgtgcagaacgccagatcgaagaagcaaaagcaaaacaagatacgaacgaattgaagcgggcaactgttgcgttgcatcgagcaatcaatcgtattaaagtatctaagcactcataaaatgagaagcggatgtttatccgtgtatcagaggtcgtgagcctgccattcagctccgagtcacaaggaacaaattaaaaaacaggttctcatgtttgatgaatattgtggcttgtgaccgaggagttggcaggagaacaccgtttatttggaataaaggactgagacaagacttttgtctcagtctctttttttgcatatttttccccttatttcctaaaaatgtaagggtattcctctatttttatgtatacttgtttttccttttatacattttatggtattatcattttattagttattataaaaacaactgttagaaaggacgtcattatgcaagtatacggaattgatgcgatacttcgaatcgtgagtcatttggcgtttatctacttagccttctggtctttacgttcgttacgcattgagactttttttagaccaatgcataatacgcaaattagaatggcaatcgtacttttttcaatctttttagggtacactgcaagtaattttttcttagaagttatcgctttatgccgaaatcttttcgttagcctgtaaattttaaaaaaaggtactattttaaaagcaagggtgttataatagaaaagattttgagtaagtgtatgctcattggaattttttggagggaacaacaacatggaagagatcatcgtaagaggtggcaatcaattaaatggaacagtaagaattgaaggagctaaaaatgctgtattgcctattttagctgccagtttgttagcagaagaaggtattacgacattagacaacgttccgattctttctgatgtcttcactatgaatcaagtgattcgtcacttaaatgtagatgtagattttgatgaacaaaagaatcaagtaacaatcgacgcttcaagacaattagagatcgaagcgccttatgaatatgttagtcaaatgcgtgcttcaatcgttgtgatgggaccgctacttgctagaaatggacatgcaaaagtggctatgcctggtggatgtgcgattggtaaacgcccaatcgatttacatttaaaaggatttcaagctttaggagcaaaaattattcaaaaaaacggctatattgaagcaattgcagatgaattgatcggtaacacgatttatttagattttcctagtgtaggtgctactcaaaatatcatgatggctgccgtaaaagcaaaaggaacaaccatcattgaaaacgtagctcgcgaaccagaaatcgttgatttagcaaatattttaaataaaatgggtgctcatgtctatggagcgggtactgaaacaatgcgtatcgaaggcgttgatcatttacatgcagtcaaccattcaatcgtacaagatcgtatcgaagctggtacctttatggtcgctgctgcaatgacagaaggcaatgtactgattgctgatgctatctctgaacataaccgcccattgatttctaaattgatcgaaatgggtgcagaaatcattgaagaagaaggcggaatccgtgtcatcggaccaaaacatatcttacctacagatgtaaaaacgatgcctcatcctggtttccctacagatatgcaagctcaaatgacagccatccaattagtggcagaaggtacaagcgtagtaactgaaacagtttttgaaaatcggttccaacatttagaagaaatgcgccgtatgaacgcccacgtcaaaatcgatggaaatgtagcaatcatggatggaaaccatgaattgcaaggtgcggaagtgtatgcaacagacttgcgtgcagcagcagcattagttttagctggcttgaaagcaaatggaatcacacgtgtccgtaacttgaattatctagatcgtggctattataacttccatatcaaactacaaaaattaggtgcagatgttgaacgtgtagacatggatcaaactcctgctgaaaaaacagcacaaacgattgcataaggaagtggctgaatgagtaaccaacgatatatcttattaactctgataaagattttagtggtgatcttattacttatccttctttttgtagccggaacgatgattggatatggcgtcatcggtggtggcaatccatttaaagtatttcaaccaagcttgtggattcatattcgagacttttttcattgataattaattacggtggttctagtcgataggaaatgagctatgaagcagcataggataaaagaaaacagaagggaacgttgactttagtcgcgatccctttttttagtaaaagaaaagaaggaatctagttgatgaagaagatattgatttatttagttagaggatatcagcgctttatttcgcctgcatttcctcctagttgccgctattatccaacctgttctaattatatgataaaagcaattcaaactcatggtgcgctaaaagggacggtaatgggaacggctcggatcttacgctgtcatccctttgtcaaaggcggtattgactatgtacctttgacctttcaattaacgagaaataagaaagataaaaaagaaccagattatgaaaaggttgtgaaaaatacgggtagcactgagcaataaagaaataatttggaaaatagcttcccatattttgcaaaattgtgagttattgccgaagtgctggattttgaacaccgtcaaaaaaggttgtgaaaaatacgggtagtactgggcaataaagaaaagagagagtgactatcaaagcaacgacttcatgactacatatatggaggtcaaaaatgatcgaagaactcaataagatagatttaccatggtccttgttattagatgcagatcctgataaagaaaaagttcaggtatatgtttcaaaggggaacggctggatatggaaagaaaaagaaaaaacaataggtatactgatctatatagtaagggaaaaagaattcgaaatcgttaacgtagctgtagaaccttcgcatcaaggaaaagggattggtgggaaactccttgagacagcttttcaggagctttcacagctcgcttccagtcaaactcagatcatcatacgaaccggcagtactagcagtgctgcgttacatctctatcaaaaaatgggctatgtggagattggtcgagtcaaagactattttatccatcattattctaaaccgatttttgagaacggagaacaattgcgagatcaagtgattttagcaattcacttacacaaaaccagctttaacgaatagacttgtgatccgagaaaatgctttcaaatactaaacatatacattacaatagctttagcaagcaaaaaggagaatatgtttatggggatattagtttttgattttggcgggtcggctgtcaaatatggttgttgggatagtaaagatgtcaaaggcaagggccaatttgcaacgcccgaatcttgggaagaaatgaaagcgcaattattacaagtctataaagacatgtgtctttcttttgagattgaaggaattgggatcagctcacctggagtagtgaataatgagaaacaggtaattgagggaatcagtgcgatcccttatattcatggctttaatatttttagagatttggaaactttgtttcaacttccggtaacgattgaaaatgacgccaactgtgccggaatggctgagttttatgaaggagctgctcgtgattatcaagatgttgcttttgtcgtggtaggaactgggattggtggggcgatgttcacgaaaggccaaatcaataaaggtgcacatctttatggtggagagttcggtttgatgttcttagagggcgatcagacatttagtaaacttggtacagccgtacagatggcttggcggtattgtgaacgcaaaggagtcgataagaatacttataccggaaaagacgtctttgaattagcagaaactggggatgaaatagcaaaagaagaagttgagagtttttatacgtaccttgcaaaaggtttattcagtatccaattttcattcgatccggaagttatcgtattaggcggtggcgtttctgcaaaggatgggctcatcgatgagatccaaagtagaatgaagaagttgacagatcaattcgacctgcatgatttcgagccacagatcctattgtgtgaatacagaaacgatgctaaccttgtaggcgcagcggccaactatatcgctataggtcaaggggagaattaaaagctttagagaagtcacttcttgcataaaagaagatgaaatggacaagagatttttgcctaaggaatgttttattggctgcaatatgataaaatgtctgagaggtgaaaatgatgtcaaaaaaaaataaagatattgaagtacgtatcgaagaagtaaaaaaagatatcaaaggtaagaattatgaagtcactcagttatttataggaaaaaaaataattggtgaaattttagcctatggaccaaaagaatatgaaattttctttggtgaagaagattttggaaaagaaaaaagtcttgaaaacgcgatagaaacagtgattcgtcactggaatctgcacgaataaaaaaatatcaaaaaaactttcaataaagggttgcaaaaatctggaaaattaggtattataactaagtcaggttgatacaaacctttcggaggagtagcgaagtggctaaacgcgacggactgtaaatccgttccttagggttcagtggttcgaatccactctcctccatttcattggggtatagccaagcggtaaggcaagggactttgactccctcatgcgttggttcgaatccagctaccccagtatagcacaaccgtaggctctcgtaagttcgagagctctttttttgctttgctaccttgttccttgaagattctggcaaattaagatagagttaagttaacaaaaaaaattggaggggtcaaaatgaagtggaaagaaaaagtagacgaaacagctgaaaagttatatgacttggtcaaatcagaaaaatacgatatcgaagtgaacattcctaaaaaaggtgaaaaagcagtccatgtaaaatcaaaacgcccaacgaatcataccaaaaaatggatggctaaaaaccgctaataataacaaaagatccataaatcggcattttcagcgattatagggtcttttgttattttctcaataggacatatctagaaaatgaattctattaataggaatgggaagaaggatttgtacctacatcatctgtttatggatagaatcctttatctttttcagttgtgaattaggtatataccagttataatagaagaaacgaaaggacgggtgtacgttatgtcgaatcaattacctgtatatatacagattcatgaccaattaaaaaatgaaatcgaacaaggtatatggaaagtcggagaccgtcttccttcagaaagagaattagcagtgaaattcaatgtcagccgtatgacgttgagacaagcaattcaaaacttggcagatgaaggaatcttagaaagaaagatcggttcgggtacatatgttgcgcgagaaaaagtacaagaaaagatgtctggcgcgacaagttttacagaaatcatggaatcgcaaaatagagtaccttctagtcgaacaatctcttactttttgacttcgccaagctcaagtgaaatggaaaaactaaacttgagtaaagatgacacgatcttgcgaatggagcgtattcgttttgcagatgatgtccctatttgttttgaagtagccagtgttccgcaaaagctgatcgatggctacagcaaagcagagattactgaatcgctgtatcgcacattagaagaaaaaggcgggaaaaaaatcggtccagcgaatcaaacgattactgctgtattggcttctgagaaaatcgcagactatttagaggtgaaacgaggagatgcagttcttcgtttgcgtcagatttcctattttgatgatggtacgccatttgagtatgtgcgtacgcaatatgtaggaaatcgttttgagttttatttggaaaaataaaaaacaggtgatccctgattccttattcgaaaaaaagagaatcagaatcacctgtttttatctatgatcagttatcagttgctcgtgataagaaacaggaccttcttcaaattggacttgtccgttcagcagctcaatgatggattctttaaagctgtcagcatttttttcatccactgcacagatgacgatgacttgatcagtgtattggatttcttttatgaaaaaatgctgtagttcaagataattttgtaattttcctagttgcggatacgtgatcactacggagatctcctgttgcaaggtaccttctacgattccaatgtcggacaatgcttgagagaccgcatgagtgtatgcacgtatcaatccgcccgtgccgagtttcgttcctccaaaatatcgagtgactactgcagctacattgatcagttgattttttttgaggacttccaacatcggtacgcccgccgttccacttggttcgccatcatcgctgctacgttggatctcatttttttcgccaatgacgaaggcgctgcagttatggtttgctttccaatgttcttttttgatttcttggatgaagtttttcgcttcttcttctgattctattcgtttaagagaacagataaagcgtgatttcttgatttcaatctcactttgtccattttctttgattgtacgataacgttcgatcatcttgtcacctcttttttttcggttgctttattcagtataaagaaagttctaggttgtttcaacactataacggttgcgcaattactgtagtatgcgataataaagacaaaggcaggtggatccggggatgaaggaacgaatgaaaaagtatgatgcaattatgcattatttgaagaacaacggcggctcccaagtaacattaacctttactcaatttgatgaactgttgtttcccagtaacggacttcccaaaacagccagggaaatcacagattggtgggcaaatgactatagacatccagaaaagggtgcctacggctggttaaatgcaggctatgaagtagtggtcatcaatttggataaagaatatgtcgtattcaataaattagtgaaatctagctggctatttgattaaataaaccgtgtttagaaaacgttgacaaatttctttctttttatataatagagtaacaaacgctaagaaaacgtttgcgtagtctgttttaaaaaggagagaaaagtatggctaaaaaaacaatcatgcttgtatgttcggctggtatgagcacaagtttgctagtaacaaaaatgcaaaaagctgcggaagcaaaaggaatcgattctgatattttcgctgtgtcagcttctgatgcagataataatcttgcaaataaagatgtagatgtactgttattaggacctcaagttcgctttatgaaagctgattttgaaaaacgtctggaaccaaaaggcattcctttagacgtcatcaatatggctgattatggaatgatgaatggcgaaaaagtattagaccaagcaattacattgattggtgaataaatagattatatagaactatcaaacaagcaatcaaaaaaaagattgcttgttttttcgtatatttttttagggcgaatgatatgaatcatttttggggcagaaggcttcttacgagagagattgaagcaatggattgtgaggagggaaacttaccaaattataagaagatcgcagctgtagaacgtttaggtaacaggattctttgtcatcgttgtggagtgaaaacgcctttctttgagggatagcttgcagactatggctatttttgcatacattgcctgtctttagggcgatgcgacagtcaacaagagttatatttatttgatcagccaaaagcagaatctcgagaagtcgtcttttcttggacaggacagcttactgaaaaacaaacggaaatcgcagataggatactttatcattcagaaaaaagacaccatcttatttgggcagtaacaggtgcaggaaaaacagaaatgctttatccgattttagtgaaaacgttaaaagctggaggaagagtagccatttgtacaccgcgaatcgacgtttgtaatgaattgtttttacgttatcgtcctgtttttccagaagaaacaatcatgttactccatgggaatacaacaacagcttatacctttagttcttttgttatctgtacgattcatcaactatatcgtttttatcgatcctttgacttattagtaattgatgagattgatgcttttccttatagcggggatgctgggctagctcacgctgtgcaaacagcaatcaaatcagacggtcgattcatctacttaagcgccacgcctgatgaaaagttactaaaggaaatcaagcagacatttgagatccacaaacttgccttgcgctttcatcggcgcttgcttcctgaacccgtacttgttttcatgaataattggcgacaaaaatgtgggaacaaaaagaaaatcaactctttggtgcggatcattcagcaactaatcaaagaaaaccatatccttttattttgtccaagtattacgatgatgcatcgtttaaaagtcacactgcaagaagcttttccagaatatgagataacagatgtttcttcacaagacgatcaacgggcaaagaaagttcagaaaatgcgagaagcaacatacgagatactgttaaccacgatgatcctagaacgaggagtcacatttgaaagaatctctgtcatcgttttaggagcagatcatccagtttttactaaatcctctttggtgcaaatcgcaggaagagccgatcgtaaaggtccttatacgaacagtcgagtctattttttctatgaagaaaaaacttcagctattcgaaaagcctgtcagaaaatcaaagaaatgaacgaagaagggaagaagatgctgtgagatgtagttgctgcagtaaagacatcatccaaaatttaacattcagcgagatcatcggtgtgtcgaaatatagacttcctcagacctgttcagtttgccgcgcacaattccatttattggaagcaaaaggttgtgcaggttgtcaaaaaccaatccatttgacatacgaggagacgaaaaagaaagcaaagactagtttcgttttctgcaacgactgtcaagaatggaagaagaaatatcctgcatatgattttcaacaccgcgccttttttacgtacgatgaaaaaatgcaggcttggatcaatcggtacaagtttatgggagacatccgattagcagggacttttgcatataaatggactcagataaaaaaagattacccggcatatatttattgtccaatacctttatctgaaaaaaggtggctagaaagaggattcaatcaagtaagcgagatgttgaaagcagcaaaaattccttttcagatgctgctcaaaagagagcaacatctgcttgctcaagcaaaaaacacgcgaaaggaaagattggagatgcctcagccttttgagcttgctgtacctctttctaagatacaacataaaaaaatattgattattgacgatgtctatacaacaggtcagacactttttcatgcagcagattgcttgcagaccgcacagccaaaaatcatccgaaccatttctttggcaagatgaatcagatgtggaaatttgatagcgatttaatttgcaaataacttagagttcgatataatagaattaagaagagggaaagagtggtccttctccttcttgattgtggtagacgaaaggggtaatttttatgtttagatataatgtacgcggcgaaaatatcgaagtaactgaagcgattcgcgactacgttgagaaaaaagtaggcaaactagaacgctatttcagtgacgcacccgatgctacggcgcatgtgaacttaaaagtttatacagaaaaaacagcaaaagtggaagtaacgatcccattaccttatcttgtattacgtgccgaagaaacttctccagatctatacgcaagtatcgatttggttgttgacaaattggaacgccaaatccgcaaattcaaaacaaaaatcaatcgtaaatcccgtgaaacgggcatgaatactgcagatgctgctgttttattcaatggagaggaagaaaacgaaaacgattctgaattagatatcgtacgtacaaaacgcctttcattgaaaccaatggacagtgaagaagcagtcttacaaatgaacatgctgggacataacttctttatttttgaagatgcagaaacaaatggtacaagtatcgtttaccgccgaaaagatggaaaatacggattgatcgaaacagactgatcatccatacttaaataacatcaaaaacttgcagcagctgtcaatagctgccgcaagtttttttgagttcgtctcttttttagttaaaatatgaataaattatgaagttcttactttaatacgattaagatatttcaattatctataactaatgataaaataaaaagtagagtctacatagtctggataatacacagaaggaaaaggagattacacaacgcatggccaatttgattcgttcacttatcgaaaatgataagaaagaactaaaacgtttagatagcattgcaaaaaaagttgaatcatacgctgaccaaatggcagcattaactgatgaacaattacaagcaaaaactgctgaattcaagagcagataccaaaaaggagaaacattagatcaattacttccggaagcttttgcagtcgttcgggaagcagcaaaacgtgtattggggttatatccataccacgtacaattaatgggtgggatcgtgcttcacgatgggaatatccctgaaatgcgtactggtgaaggtaaaaccttgactgcaacgatgccggtgtatctgaatgcgttgactggcgaaggggtccacgtagttaccgtcaatgaatatttagcaacccgtgactcgacggaaatgggcgagctttataatttcttaggattgacagttgggttgaatatcaactcaaaatcttcggatgaaaaacgcgaggcttataattgcgatatcacttatagcacgaataatgaattaggatttgactatttgagagacaacatggtcgtttaccgtcatcaaatggtacaacgtccgctgaattatgccattgtcgatgaagttgactcgatcttgattgatgaagcgagaacgccgctgatcatttcagggcaagcagaaaaatcaacagctttatatacaagagcagacaacttcgtgaaacgtttgaaagaagaagaagattataaaatcgatatacaatcaaaaacaatcagtttaactgaagcagggatcgaaaaagctgaagaaacattcggtttggacaacttatatgacattgaaaatactgcattgacccatcacttggatcaagcattgagagccaactacatcatgcttttagacatcgattatgttgttcaagatggaaaagtattgattgttgaccaatttacgggtcggatcatggatggacgccgttattcagatggtcttcatcaagcgatcgaagctaaagaaggcgtagagatcgaagacgaaacgaaaacgatggcgacgatcactttccagaactatttccgtatgtacaagaaacttgcggggatgactggtacagctaagacagaagaagaagagttcagagagatttataatattcaagtataccagattccgacaaaccgtccggtcatccgtgacgatcgaccagatttgctttacccaacattacaaagcaagttccatgctgtcgtacaagatatcaaagatcgctaccgcaaaggacagcctgtcttagtcggaactgttgcagttgaaacatctgagttattatcagatatgctgaatcaagaacgtattcctcatgaagtactgaatgcgaaaaatcactttaaagaagcagaaatcatcatgaatgcgggtcaaaaaggtgcagtgacgattgctaccaacatggctggtcggggaacagatatcaagctagggcttggcgtaagagaacttggtggcctagcagttatcgggacagaacgacatgaatctcgtcgtatcgataaccagcttcgaggacgtgcaggacgtcaaggagaccctggtatgtcacaattctacttgtctttagaagatgatttgatgaaacgattcggttcagaacgaatcaaagctttcttagatcgaatgaagatcggtgacgaagatgctgtgatccaaagcaagatgctgacgaaacaagtagaagctgcacaaaaacgcgtagaaggaaacaactacgacacacgtaagaacgtcttgcaatacgatgacgtgatgcgtgagcaacgtgaagtaatctataaacagcgtcaagaagtgatcatggaagaaaaaagcttatctaaaccactgatgaatatggtcaaacggacaatcagtcgtgtggtagatgcgcatacgcaattagaaaaagaaaattggaatttggaaagtatcgtcgattttgctggcagcacgcttgtccatgaagacagtatttcccttacagatatcgaaggaaaaacctctcaagaaatcaaagaatatctaaacgaacgagcacaagaagtattcaataccaaagcagctcaattgaacggaccagagcaactgcttgaatttgaaaaagtcgtgatcttacgtgtcgtggactctaaatggacagatcatattgatgcaatggaccaattacgtcagtcaatcggcttgcgtgcctatggtcaaaacaatccattagtcgaataccaaacagaaggttataagatgttcgaagatatggtaggtgccattgaatatgaagtcactcgtatcttcatgaaagctgagatccgtcaaaacgtacaacgtgagcaagtttctcaaggaacagcttctcactcagaagatggagatgccaaagaaaacagtaatactagcgcgaaaaaacaaccaatccatgtgaacaaggttggtagaaatgatccttgtccttgtggaagcgggaaaaaatataagaactgtcacggaaaagatgcaaactaatttctgacagcaggattggtgagacaaattcttttttaaagaatttgtctcaccttctttctgttatttgacgattctgttagactagatataataaaaaaagtatagtgaaagaaggaaaaaaacatggaaatatccgaaattcgaaatctcctgacagaaatgcaggaaaaggtcacaagcttcaggaggtctctttgacttagaccagctggaagaagacattgcggaagcagaagcaaaaatggctgaacctggtttttgggatgatagcgaagctgctcaaaaagtgatcagtgaaaacaatgcaaataaagaaacttatgatcaattccattctcttgctgaagaactggaagaaatcgaattgatggtggagatgttgcaggaagaacctgatgcagcaatgcaagaagaagcagaaacacgtatcaatgcgctagatgaaaaaatgaagacgtatgaattatctatgttgttagatggtccttatgatcgaaacaacgccatcgtcgaattgcatccaggggctggcggaacggagtcccaagactggggcagcatgcttttacgcatgtatacacgctgggcagagcagcatgggtatcaagtagagacactagattatcaagcaggcgatgaagcaggaatcaagagtgtgaccctactgatcaaaggacacaacgcatttggctatctgaaatcagaaaaaggtgttcatcgccttgtacgtatctcgccttttgactcagcaaaacgtcgtcatacttctttttgttcggtagatgtgatgccagagcttgatgaaacgatcgatatagaaatcaatccagatgatttgaagatcgacacatatcgggcaagtggtgcaggtggtcagcacatcaataagacagaatccgctgtacgaatcactcacttgcctacaggaacagtagtagcgagtcaggcacaacgttcacaattgaaaaaccgggaacaagcgatggggatgctgaaagctaagctttaccaattagaagtggaaaagaaagaacaagaagcagctgcactgagaggagaacaaaaagaaatcggctggggatcacagatccgttcttatgttttccatccatattctatggtaaaagaccatcggacaaacgtagagacaggaaatgtccaagctgttatggacggagatcttgatttatttattgacggctatttgaaaatgcatctgcaataagagccctttgttaaattgaaataaaattgtaagattttgcaagcaagttgaaacattgccatgctataatagctaaagactgaaaaagatatggagagaacgccatgattgaaatgaaggatgtaatgaagaagtactcaaacggtaccactgctatccgcaatctctcgattgtcatcgaacaaggagagtttgtgtatgttgttggtccgtctggagctggtaaatctacattcatcaaattgatgtatcgagaagaaaaagcttcaaaaggaactttgaacgtcgcaggtcatgatctaatagccatcaaaaaccgcgaagttccttatctacgcagagaaatcggcgtggtgttccaagactataaattattaccaagaaaaacagtatatgaaaatgttgcgtacgccatgcaagttatcggcagaaaacctcgggatatcaaaaaacgagtaatggaagtgctggatcttgttggtttgaaacacaaagtccgagtctttcctagcgaattatctggtggggaacaacaacgtgtttctattgcccgagcaatcgtaaatacacctaaagtacttatcgcggatgaaccgacagggaatctagatccggaaaactcatgggaaatcatgaaactattagatcggatcaatgcacaaggaacaactgtcgtgatggctacacataacagtacgatcgtaaatacgattcgacaccgagtaattgctatcgaaaacggccgcattattcgagaccaagcggaaggggaatatggatacgatgattagaacctttttccgccatttattagaaagtatcaagagtttgaaacgtaacggctggatgacagtagcttcggtcagtgcggtaacgatcacgttgactttagttggtgtgttcatggcggtcatcatgaacgcaaccaaactagcacaagatatagaaggaaacgtggatgtatctgtgttcgtagacattggtacaaaagacgaagagatgaaaaaactagaaaaagaattaaatgacttagatcatgtcaaaaaagtcgaattttcaagcaaagaacaggaattgaagaaaatccaaaacgaaatgggcgattcttggaaattgtttgaaggggataataacccgttatatgatgtatacgtagtaagtgctaccgatccttcttatacaaaacaagtagcagaaaaagcggcagatttgaagaatgtttctcgttctgattacggtggggcttcctcagatcggattttccaaattgctggtgcagttcgaacatggggattagttgcggcggcattgctgttgtttgtagcaatgtttctcatttctaacacgattcggatcacgattttatctagacagcgtgaaattcaaatcatgcgtttagtaggagcaaaaaatggatatatccgctggccatttttccttgaaggtggttggatcggcttaatcggtgccattcttccgatactgatcattacatttggttacgcatggttttaccaattgatcaatccgtcattattacgatctcattattcattgatccatccagaaaatatcgtttggaaaatcaatcttttgatggtcggtattggtgtgatcattggttcactcggctcgattatctctatgagacgtttcttgaaattctagtgtcacaagataaatataatcagaaagttggacgatttcgttccagctttctttttttatcagctaggtggagtaaatggggcggcttttttctctttactttaaaaaacaacttgggtattcttaagttggtagaaaaagaggtgaagccgtgaagattatcgttgacaatttttttacgatccttttgattatgaatattttgctttcctttattatcgtttttcgagaaagaaaggaaactgcgcaaacatgggcatggctgctcgttttgatgttcattccagttgtaggatttattttatatatttttttaggaagagggatttccaaagagaaaatctttgatttgaagatccaagggaaaatcggtaagaatctagaaatcgaagaagataaacaagcattgatgcgaggactttatcctcatccgcctactggacaagtagatgtgaaacaattgatctatatgcttactgtatttgaaagtacgctttatacgactaaaaatgaaatcactttatttacagatggtcgtgaaaaattcgatgcgctgatcgaggatatcaaacaggcagaagaccatatccatttccaatattatatttaccgcagtgatacattaggtgaagaagttcgagaggcattgacagaggcagcaagacgcggagtaaaagtcagagtccttcttgatgcatggggttccacacaagtttcttctagtttttttcagaatttgaaaaaagcaggtggagaagtcgcatttttctttcctctattcgttccgtatatcaatcctcgaatcaattatcgcaatcatcgtaaaatcgtagtgattgatgggaaaatcggatatacaggtgggttcaatgttggaaacgaatatctaggattggtaaagaaatttggttattggcgagacaatcatctgcgtatctatggagaagcggtttacaccttgcaaaaccgttttttgatggactggaattctcagcatacaaaagaagtaggatattcaccggaatttttcccgaccattcattctacaggtgatatggctgttcaaatcgtgacaagcggaccagataccgaacatgagcaaatcaaaatgacatatttgaaaatgatttcgttagccaaacgggagatattgatccaaacgccgtattacataccggatggatcgattcatgaggcattgaagttggctcttctctcaggcgtaaaagtccatatccaaatacctaacaaaccagatcatcttctcgtttactgggcaacgtattctttcgctgcagagctgatcgattatggggcaagaatcgaaacatatgaaaatggatttatccatgcaaagacgatgattatcgatggcggcatcgtttccgttggttcagctaatatcgacgttcgctcatttagattggattttgaagtcaatacactgatctatgatgaacgaatggcttctcgcgtaagaaaagcattctttgaagattcaaagatttcgacgcatctcacaaaagaagtgtatgaaaaccgagggatgatgatcaagatgaaagaaggattagcaagactgatttcgccgctcctttaaaatacaaaaaggacaggagagccatcaatagatggaaatctcgtgtccttttttctcggggccatttctgagagtacgtcagaaatggagaaagcgtctcgcatgagcgaaattaactttggggtatctcttgttttttggggaaagcaagaaataagctaatatatgctattaaaagagacacatttcaaagccagtatagcatagaaacttttaatgagatagctttttttgcaattatgagaattcattttgttatttaatggttttgattcgttttcatcaagtaatgaaaatgatagaatagacatactttaggattaaaggagatttctaatgaaaaaactaaaattattcttaccaataataggattagctattcttttatcaggctgttcaaagtggattgatcgaggagaatccattactgcagttggctcttctgccttacagcctttagtagaaacggttgctgaaacctaccagacagaaaatcctggaaaattcatcaatgtacaagggggcggaagcggaactggtttgtctcaagtacagtcaggagcagtcgatatcggaaattctgatttgttcgcggaagaaaaatcagggattgatgcttcggcattagtcgatcatcgagtagcagttgttggaatcactcctattgtgaacaaggatattggcgtaaaagatatcagtatggagaacctgaaaaaattatttacaggtgagatcaaaaactggagtgaagtcggtgggaaagatcagccagtagttatactgaaccgtgcatcaggaagcgggacccgtagtacgtttgagaaatgggtgttggacggagaaacagctgttcaggcacaggaacaagattcaagcggaatggtgcgccaaatcgttgcagacacacccggagcaatcagctatgttgctttttcttacgtttccgatgatgtggatacgttgaatgttaacggtgtggaaccgacagatgaaaatgtgacaacgaacaaatggacgatttgggcatatgagcatatgtacacaagagatcatccaaaaaaactgacaaaagaatttttagactatatcttatcggatgaagtacaagataatattgtcggagagctaggctacatccctgtttcacatatgaaagttgaacgtgattggcaaggaaacattgttaaagagtaatctttacacaaaatttacaaacttagctaaacttttacatgttattaaaaccaaattgatgttcaatttgtacactgagtgagtatgttaaacctgattaagggggagtcatctgtggaagatgtgaaaaaagtattattaacaaaatcaaaacgttccaaaatggaacagcgtggaaaattcattagttttttgtgtatcgcgctgatcgtgttggttgtattatctattttttattttgtcgctagtaaaggattggccaccttttttactgataagatcaatgtatttgattttctgtttggtacagattggaatccaagccaaataggagcaaatgggaaacccatggtaggggcattgcctatgatcacaggttcatttattgtgacctttttatctgctattgttgccacaccatttgctattggagcagcagtgttcatgacggagatttctcctaaaaacggaacgaagatcttgcaaccggtcatcgagctacttgtaggtattccgtctgtcgtttacggatttatcggtttatctgttatcgtgccttttgtcagaagtatctttggcgggacagggttcggtatcttagctggtacatttgtgttattcgttatgatcttaccgactgtcacaacgatgactgtggatgcattaaaggcagtgccgcgacactatcgggaagcttcattagcgctaggtgccacaagatggcaaacaatctacaaagtggtgctgcgagcagcagtgcccgggattttaacagcagtcgtttttggtatggctcgtgcgtttggcgaagccttagctatccaaatggttattggtaatgcggcattaatgccaacaggacttactactcctgcttctacattgacgtccatcttgacaatgggaatcggaaatacaatcatgggaacagttgaaaataatgtgttatggtcattagcgctgatcttgctattgatgtcattattctttaatatcgtgatccgtatgattgggaagaaaggagagctgaaataatgaacgcaaaacgctcagataaaattgctacaggtgttctatatgtggtttcagggatcatcgtattgatcttagcagctttattactttatatcttagttcgaggaataccgcacatttcatggtcattcttgactgaaccttccaaagcctaccaagaaggcggtgggatcgggattcaattatttaactcgatttatttgcttttgattaccatgatcatcagttttcctatctctttaggtgcgggtatctacctttcggaatatgccggaaaaaactggctgacagacgtgatccgtacgtctatcgaaatcttgagctctttgccttctgttgttgtcggtttattcggtttcttggttttcgttattcaattccagtatggtttctcaatcatttctggtgcattagctttgaccgtattcaacttgcctcttttgactcgaacggtcgaggaatctttacaagcggtccattacacacaacgagaagctggattggcgttaggtttgtcacgctgggaaacagtgataaaagtggttgttccagaagcgacaccaggaattttgactggtgtgatcctaagttcaggaagaatttttggtgaagctgccgcattgatttatacagctggtcaaagcgcgccagcattagattttacgaactggaatccattaagtgtttctagtccgatcagcattttccgccaagctgaaacactggctgtccatatttggaaaatcaacacagaaggtacgatgcctgatggtgtttctgtttcggctggcgcttctgccgtgttgatcattgctgttttactgttcaacttcggcgctcgtgcgattggcaaacgattataccgaaaaatgacttcagcctaaggagaagaagtaaaatgaaaaaatataattggaatgaaacaaatgtcattaccatgccaaaagataaggaagttgcattatatacgaatgatctgcatgtttggtatggcgacaatgaagcaatcaagggagtggatctagaattcgaaaaaaataagatcactgcattgattggtccctctggctgcggaaaatccacgtatcttcgttctttgaatcgtatgaatgatgggattgctaatacgaaaattactggaaagattatgtataaagacgtggatatcaatgcgcctcaagtggatgtttatgaaatgcgtaaacggatcggcatggtgttccaacgccccaacccttttagcaaatcgatttatgacaatataacttttgctttgaaacagcatggtgaaaaaaacaaaaagaaattagatgaaatcgttgaaacaagcttgaaacaagcagctttgtgggatcaagtaaaagatagcttggataaaagtgccttggctttatctggcggacaacagcaacgtttgtgtatcgctcgtgcaatcgcgatgaaacccgatatcttgctgttagacgagccggcaagtgccttggatcctatttcgacaggaacggttgaagaaacacttgtaaacttgaaagaagactacacgatcattatcgtgacgcataatatgcaacaagcagctcgtatcagcgactatactgcctttttctatctaggaaaagtaatggaatatgacaaaacaaacaagatatttaccagaccaaaaattcaggcaaccgaagattatgtgtccggtcattttggttaagacggaggcctcaacatgacaaaagaaattatctcatccaaagatcttcatctgtattatggaaagaaagaagcactaaagggaattgatctaagtttcaatcaaggtgaaatcacagcgatgatcggtccttctggttgcgggaaatctacctatctacgttcgttgaatcgaatgaacgatctgattccaaatgtaacgatcaccggaagtgttttatataaagacaaagacatctatggtccgaaaacagatgttgttgaactaagaaaagaaatcggcatggtgttccaacagccaaatccatttcctttttctatttatgaaaatgtcatctatggattgaagttaaaaggtgaaaaagataaaaaagtccttgatcaagtagtggaagaaagtctgaaggcagcgtccgtttgggaggatgtgaaagataaactgcataaaagtgccttgtctttatccggtgggcagcagcagcgtgtatgtatcgcacgtgttttggcagtgaatcccgaaatcatcttattggacgaaccaacaagtgcacttgaccctgtttctactgggaaaatcgaaagtatgctgttagaattaagagagcggtatacgatgatcatcgtgacccataatatgtctcaagcttcacgtatttcagataagacggcattctttttagatggtcacttgatcgaatacaacgatacgaagaagatattcatgaatccagaaaaacaagagacagaagattatatttcaggtcgatttggataaggaggaaacggaatgctacgtacacaatttgaagaagaattgctgaatctccataatcagttctacgaaatggggatgatggtgagcagcgctgtgcacaagtcagttcgtgcatacatcaaacacgataaaatcttagcccaagaagttatcgaaaacgatataaatatcaataatatggaaacgcgtttggagaagaaaagttttgaaatgattgcattacaacagccagttacaactgacttgcgtatgattatcacggtcatgaaagctagctctgatttagaacgtatggccgatcatgcggtgtccgttgctaaatccacaatccgcgtaaaaggacagacgagaataccggaaatcgaaaaagagatctccgatatgtccgattacgtgaaaaaaatggtggacaacgtcctagttgcgtatgtcaaaacagacgaaaaagatgcgcgtacaatcgccaatatggatcaaagagtcaatgactatttcaatcgaatctataatgcaaccatcaaaaacatgcaagaaaatcctgaaacagtcatcagtggcacagactatttgaatgttgccagctatctagaacgaatcggagactatgtgacaaacatctgtgaatggatcgtctacttggctacagggaaaatcactgaattaaatacgaaccacaatgagattttctaaactgaagttgtgattctgctgtttatttaggaaaagaggttgtgaaatcagcgttttgtcctgagtattagagaaacaaacggtaaaatagttcctcatattttgccgttttttgagctaataccgaaggtcagctgattgaacaccgtttattctggaaaagggtttgtgacaaaacatgtcacaaacccttttcattattccaatagaaaggataaagaatgcaaaaaaagattagcatcatcatcactctattttttatttgtatacttgcttcatggtttattcagcgtcaagctgctctatatgacgtacctgtcatcgagatcgaaagagtgagaatagaagaggatcaacaattgattacaggaagattgatgaacacggaccaaaaaggagaagtgatttctttatcggctccttatcaaaaaaatcaaatcgaaacagcaaatataacaacaagacaaatctatcttgtccaaatgcatggagatgaatggcaactagtagcaaaaaaaaatgatggctggctttttttctttacaagtgtcttcattggcaccatgttgcttattggtggaaaacagggcgtatttgctttaggaagtctcatcatcaacatcgttttacttttacttttgttgctcctctttaccaaaacagaaggtatctctctcttaaatatagcaatcttatttgtcgttatagggataatcgttagtatattggcgttagacggatggaatagaagcagtataatcaaaattttggctgcagttataagtgcttttttagcattttttatttgtcttttgacaatgaatcattggaaagatcaaggacttcgctatgaagaactgaattatctgacacgaccgtatcgatctgtttttctttccagcgtgctgatcgggacagctggagggacactcgataccgtgatcacagttattgcgacattagaagaattgaccaagcaacaaccgaaaatatcagcgaaacagctatggctttcaggaaggcaagtgggccgagatgtgattggttcgatggctaatatccttttattcgtctatatcagcggagcgattccatcgcttctgttatatttaggaaatcaatggtctttcaaagaaacggtagaacgacatttatcattagaacttttacgcgtcattgctggcagcttaggaatagtattatcaatccccatcgcggtcctcttttttctcgctgtaaggaggttaaaaaaatgaatgtacttattatacttgttgggatttttgcaatcagtgtgctatttgtcggtggtacgcaaggtatgtatattcttttaggattattcattaatttaggaatctttttcctattattattcggctatcatcagaagtggccgatattggtattgtcgattatagggttcctattgatcgctgtggttatcttattttttatcaacggttataatctgaaaatgcgagccgcttttgccagtatactgatctttttgttttgtttcctactattgattcctatcactgattttttagcgatccaaggctttacttcgatagaactagaagaactatctggcttagataagacgttagcaattgattttagactacttacgaggtcgttgcttctgatcagtcttagcggagttgttttagatgcgagtgtagcgatttctagtggaacattcgaagtatatcaggcaaatccgcaaatgtcttttaaccaattgcgccatgctagctttgccattgctaaaaaaatattggcatcaacagtgatgacgcttctttttgcgtttatggggagttctttagcgttgattctttggtttattgacttagacatttcttttcagcaaataatcaatgaaaaatcatttgtcttggaatatacgatggctattcttaccacactggccgcactacttgtcctgcccttaacttgcgtgactacagcatatctctttacaaaaaagaaagaacatctcaagatggagtaaaagttacaacttaagtcctatgacatttttactgaatcagtgcataatatggatgtaaggaaaagcttgcaaacaattttgcttaaggaggcaatttccatgaaagaaagagaacgtattttagacttagtgaaaaaaggaatcctttcgactgaagaaggcttagatttattagaaagcatggcaactgaaaaagacgaaaaacaaatcaaaaaagaagcagacaaggtaactgctagtcataaagaaaaagatcaggcaagtcaattgatcgatgaacttgaaaacggtgaagaaaaaatttctgagccagttgatccaaaagaaaaagaaagacaagatcaagaaaacttagaaaagatcttagatgaactagcaactgaagcgaataaaacttcggcgcgtctagacgaagtaaatgctcaattcgctgacaataaggcagcacgtaatgagaaacaggaagcattgatgcagctgaatacaaaagaagaattaggcgagttgacagaagaagaattagcacagcgtcaaacgttagaagcagaaatcaaagagttagaagcaaccggcgatacactattagaagaacaattgaagctggaagcagaattaaaagatatccgcaagaaccaatggtctgagaaaaaagaaacatttacggataagtttgaattgccagatgattggaaagatcaagcgacagatacgctgaatcaagtaggcgaaaaaatgtcagaagctggatcacagttaggcaaattcttgaagaaaacattccaaactgtttcagaaacagtaaatgataacatggaatggaaagatgtcagcttacgcgtccctggaattgcgacaacgaaatttgaacatgaattttactatgaagctcctgcagcaagtatccttgatatcaaggcagcaaacggaaacgtgacgttaaaaacgtgggacagtgatgatgtgaaagtggaagccaagatcaaactttacggaaaaatgggtgctgaaccatttgaagcattctctgaacggagccagatcgaggtcaatgaagatcatatctcctttcaaattccaaataagcgtgtgcgtgcagaccttgttttctacttacctaaacgagtatacgaccatgcagctatcaaacttctaaatggcaacatcatgattgagacattggaagctaaagatatttatacaaaatctacgaatgggaacatcatcgtgaaccaattaactgcaacgatgctggaagtagaaggtgtaaacggcaatatcgatattcgaaacgggaacatcttagattctattatcgaaacagtaaacggtacagtgacatttggtgccacaccagaaaacctttctgtgtctttagtaaatggtgatgtacgtcttacaattaaagaagataatttgaaaaaagtagaagcaagttcagtgaacgggaatgtcaaagttgctttaccagatagcatcggtttggaaggacacgctaaaacaagtcttggaagcattaacagccgtctgtccaattacgaagtagttcgtgagaaaaaagaacggacaaaccaaatgttgcaattccgtcgtgtttcagatgatgagatcgcacaagtgcagctttcaacgacaacaggaagtatctatttaaaagatacagataaataaagaggttgtgaaagagatgttcagccttgagcaataagaagcgattttttaaaatagcttcccctattttacaaaattgtgccttattgccgataggctatctcttgaacaccgattaagaagaaggttgtcacaacgattttcttcatttaaaatagtagaacagaggtgagacatgatgaaaaaaaagttgacaaaatccaataaaaatgttgttttgacaggtactttagcagggattggggaatatatcgggattgatcccactgttatccgtgtgctttatgtattcttaagcttagttgcttttggaagtccaatcattttatacattttattagctttgattatcccatctgcgcgttctgcacgaacaaactatggacataacaatgcatattatgaaaaaaacaattatcgtgaacaaacaaaaaaacgcaaagaagcggaaaaaatcgatgatgacgaatggagtgacttttaatgtcgtactttcagcgtattttggttaatacgttaacattcatatcgttggctgttctttttcctgcgatggtccatgtgagcagtatttggacggccgttcttgccagcttcgtattatctgtgttgaacatgtttgtcaaaccgattttgacgatcctgtccttgccctttacattagtcacattgggattgtttacgtttgttatcaatgcagcgattcttaaaatgacttccttttttgtaggagcagaacattttagtttttcttcatttggtgcagcgttattcgtagctatcttgatgtcacttgtcaatgtaattgttagtgaacataacagcagaaaataaaaaaagctgtgccgagatctcggcgcagcttttttgtttagaataaagaatgcgttttctattacattggtaattaaataaaaacgttttttttaattggtagtacttttggctagacaatgataaaatgatagagaacactctaatagaaatgaggtagcatgaatgtcagaagttgtaaaagttagccaattagtaaaaaaattatctttggaaatcgtcacaggcgacgagaaaagtttagaccgcgtcatcgtgactggggacatctcacgcccaggactagagttgaccggttattttaattattattcccataatcgtttacagctatttggcagtaaagaaatcagttttgcggaacggatgatcccagaagagcgtttgatcattatgagaagattatgtagtgaagatatgcccgcatttattatttcaagaggattgccggctccggaagaaatgatccaagcagccaatgaaaatgggatagctgtgctgcgttcgcctatctcaacgtcccggctgctaggtgaattatctagttatttagatgggcgcttagcccctcgaacaagtgtccacggtgtgttagtcgatgtctacggattaggtgtactaattcaaggggacagtgggatagggaaaagtgaaacggcgttggaactgattaagcgcggacatcgattgatcgcagacgatcgagtagatgtctatcagcaagatgaactgacggtaatcggagaacctcctaaaatcctggaacatctgattgagattcgagggatcggtatcatagatgtaatgaatcttttcggtgcgagtgcggtacgaggctctatgcaagtccagttagctgtttatctagaagcatgggcgaaagataagaaatacgaccgtctgggctctgaagacacgaccgttgaaatcgcggaagtgggcattccacaaataaaaatccctgtcaaaacaggacgaaacgttgcaatcatcattgaagtagccgcaatgaatttccgcgcacgtacaatgggctttgacgcaacgaaaacatttgaagaaagattaagtcgcttgattgaagaaaactcaggcaatgactagcaaggagtgacaatatgttagcacaaatcaatcgagttgcttttgagcttgtaggaattcctatctactggtatgcattgattatcgtatcaggaatcattattgccatgtggctcagcagcagagaagctgttcgggtaggattaaaagcagatgacgtgacagattttatgttgtggggattgccgatttccattattggtgcccgcttgtattatgttttattcgatcttccccaatatatagctgatccaatccagatattcaatatccgttcaggaggattagcgatttacgggggattgattgcaggtgcaatcacactgtacttttttaccaaatatcattttatttctttgtggacctttttagatatcgctgcaccaagcgtattattggcgcaggcaatcggacgatggggaaatttcatgaaccacgaagcgtatggtccagacacgacacgaagtttcttagaaagtctgcatttaccgcaattcatcattgataacatgtatatcgaaggaatctatcgacaaccaacctttctttatgaatcactttggagtttgattggatttattctgcttttggttttgcggaagaaaccacatcttttgaaaaaaggagaagtccttttatgttatctaatgtggtatagtttcggacgtttctttatcgaagggttacgcacagacagcctttactttttaggtgtgatccgcatttctcaattattgtctgctgttttatttgtcggcacattgattctgtttatttggcgtagaaaaaaaggaaatttaccggattatgaccgctcattaggaaaaaatcaacaaattatttgatttttagagcgttaaaaatgaaaaaaatttcaggagtggtaaaatgaattatagagtagcggttttaggaccaggctcttgggggactgctttagcacaagtcctcgctgaaaacggacatgacgttcggatttggggacatcgtgcttcacaagtagaagaaatcaacacccaacacaccaatcaacgttatttaccagatcatcatctacccgattccatccgagcattcaccgatatggaagatgcagtaaaagatgcagatgcggtactattcgttatcccaacgaaagcgatacgttctgttgcaaaagaactagttgccaaattgaatacgaagccagtgatcatccacgcaagtaagggattagaacagggaacgcataaaagaatctctgaaatcttgttagaggaaatcccgacagaaaaaagaaaagctgttgctgttctttctgggccaagccatgcggaagaagtagcaaagcatgacattacgacgatcacagcggcaagcacagatgtaaaagcagcaaaatatgtacaagagctgttcatgaaccattattttcgaatctataccaaccctgatgtgattggtgtagagatgggagcagctttgaaaaatattattgccattggagctggtgctattcacggcttagggtttggcgataatgcaaaagcggcaatcatgacgcgcggattagctgagatcagccgtttaggtgtagcaatgggtgccaacccactgacctttattggcttaagcggagtaggtgatctagtcgttacttgcacaagtgttcattccagaaactggcgcgcaggcaacttgttaggacaaggtcagcctctagaagaggtgctagccaatatgggaatggttgttgaaggtgtgaatactactcaagcagcgatggaactagcccaaatgatggaaatcgaaatgcccatcactcaaacaatctatgaagtgctgtatgaacaaaaagaaatcaaaacagccgcaaaagaaatcatgttacgtgatgggaaaaaagaaaatgaattctcattaacaattttttgaaggagcgaatgtatatgaaagtaaaaaaagcagttattccagcagcaggattaggaacaagatttttaccagcaacaaaggcgatggcaaaggaaatgttgccaatcgtggacaaaccaacgatccaattcatcgttgaagaagcgttgaaatcaggaatcgaagacatcttgatcgttacaggaaaagctaaacgaccaatcgaagatcactttgattcaaatatcgaattagaaacaaacctaagtgaaaaaggaaaaaccgaattattgaaattagtagaagaaacgacagatgtcaatttgcatttcatccgtcaatctcatccaaaggggttaggacacgccgttcttcaagcaagagcctttattggaaatgaaccgtttgtcgttatgctaggcgatgatatcatggaagacgaagtaccattgacacagcaattgatcgatgactatgagcgtacacacgcttctacgattgccgttatgcaagttcctcacgatgaaacttcaaaatacggaatcatcaacccaggggaagtactggaagatgggttatacaatgtcaaaaactttgttgaaaaaccagatccaagcaaagcaccaagtgatttagctattattgggcgttacttattgactccagaaatctttgatgtattatcagaacaacaaccaggtgctggaaatgagatccaactaactgacgcaatcgatacgttgaataaaacacaacgcgtatttgcccgtaaattcacaggtaaacgttatgacgttggtgacaaatttggttttatgaaaacaagtattgaatatggtctgacacatccagaagtaggggcacctttgcgtgaatacatcatgtctttaggtaaaacattagaagcagaaggaagcaagatcaatcataatccaaaaggaataacagaaatcaaagaagaaaagaaaaaataatctttttttctaacgagcttcagctgctaattgaataaaaagtagttgaagctcgtttttatttgtttaaaaaacacgaaaatgctatccttatagaaaagagagacaagaagggagtttgatcatgtcaggaggagaaattgcaggattgatcgcagcaatcgcctttgcgatacttgtcgttttcatcgttcgcgtattgttgcaagtttccaaaactttagaaaaagtagaccagactgtcgcagaagcaaatacgacaattgagatcgtcacacaagacgtagatcttttatctagacaagtagaaggcttgctagtcaaaagtaatgagctgctcttggatatcaatggaaaagtcgcaacgatcgatccattgttcacagcagttgctgatttaagtgaaagtgtatcggaacttaatcattctagtaaaaacatcgtgacgaaagtcggcggaatcggaaaaacgacagctaaagcgactgttgccggaaaagtcggtggaacagcgatgaaattttttaaaaacaaaaaacatactgaaacgacaggaggaaaataagaatggctaaaaaaggtggatttttattaggtgcagtagttggaggtacagccgcagcaatcgccgcattattgttagcacccaaatctggtaaagaacttcggaatgaattggctgctcaagcagatgatttgatggacatggcttcagattacacagatatggcaaaagaaaaatcatctgagttaacaggtattgcaaaagaaaaagcgcaagatctttctcaacaagcaggggatctagcaggcaatgttaagcagaaggtaagtgaatcagcagaggaagcaggaagtgaatcagatgatatcttgttaaacctcaaagaacaatcagctgatttatctaatcgtttcaaaaaaacagcagaagatctgaaaaagccagcagacgaattaggtagtattgctaaagatacttcagaagatatcatgatcgatgtaaaagatgctgcagataaagcaggagagacggtcaatgaaggaatgtcagaagcaaaaccagttgcagatgacacaaaagaaatgttgaaaatggcaaaagaagatgcaaaagaagctaaaaaagaaatgaaagatacaatgacagattcgactaccaatcactaagattactcatttctagaataaaaaaggtgagagcggaccagctctcaccttttttattttcattactctaaaacaagtaattcttttggtgtagtcgtgaatggcacacaaccatcacttgtcacatacacacaatcttcgatacgtacccctactttttcaggaatatagattcctggttcaagagagaagcacatcccttcttcaatcactaagtcgtttccttctacaagagaagggaattcgtggacggttgttccgattccgtgacctaaacggtgattgaaatattcgccgtagccatagctgttgatcacgtttcgtgcgatttgatcaagttcacctgctgtcacacctgggcgaactgcctcttgtgcggcaagctgtgcttcaagagtgatgttatagattttttcttggaattcagttggtttttgataagcaactgtacgagtagcatcactgcaatagccattccaaataacgccaagatcgaataacactagttcatttggtgaaaccttcgtgcttcctggtgtaccatgagggcttgcagcatttgctcctgcaaggactaatgtgtcgaaagacatttgtgaaacaccttgtttttttaattggtattcgatttctgcgataattgcttgttcagttacgccttcttttactgttttgaagccaatttcaaaggcaacatcggcccatttaccagcttcgatcagtttgtctttttcttctaccgttttgatcagttgcagacgctggataatagaagttagatcggtgtaagaatctgtacctgtcaagatatcagagatagcatcgaagcgatcgacagtcagagcattcttttcaatacctacattaccaggttgcccatagcgtgcgcgaagctcttttccgatgatctcccaaggattttcgctgtctaagtagccacgtacatcgtacgcccagctgctgttttgagcatcttcaacttccagagcaggagtgaaaaggaaaggatcttgttccagagggataaaaagagctagtacacgctcgtgaggatcactttcatatccggaaaagtaagcgatgtggccagggtcgctgatataagccaattctacttggtgttgtgccatccattgacgtagttcattgatttttacgttattcatttggcaacctactttctaaattaattttgtattcaataattgtaccactgattgattaaaagaccaacgttcttaaaactgaaaaaagtaaaaattttcatgaaaacagagataaaacggttgcaattgttgagattatttgatatcctattttagaaatgtaagacgtattttcagaaaacatataaaatatgaataggagaacacaaatggaaaagcaaacaatcactatctatgatgtagcgagagaggcaaatgtttcgatggctactgtttcacgtgtcgtaaatggcaatccaaacgtcaaaccagcaacaagaaaaaaagtcttggaagttatcgatcgcttggattatcgtccaaatgcagtcgcacgtggcttggcaagtaagaaaacaacaacagttggggtaatcattcctgatgtcagcaatatgttctttgcctctttagcacgtggtatcgacgatgtggcaacaatgtacaaatacaatatcatcttagcaaactcagatggcaacgatcaaaaagaagtcaatgtattgaataatttattggctaagcaagtggacggcgtgatctttatgggtcaccatatcacagacgaaatccgtggagaattttcacgttcaaaaacgcctgttgtactagctggttccattgatccagatgaacaagtaggtagcgtaaacattgattatgtatcagcaacaaaagatgcagtaaataaattagcaaaaagcggcaataaaaaaatcgcttttgtcagcggtgcgctgattgatcctatcaatggtcaaaaccgtctaaaaggctataaagaagcattaagcgaaaacaatctaccatatagcgaaggattgatttttgaggcacagtacaactttaaagatggtctgtctctagttgaccggatccataatagcggtgcaacagctgtctatgtttcagacgatgaattagccattggtatcttggatggtttattagaccgcggcgtaaaagtaccagaagaattcgaaatcatcacaagcaacaattctttactgacagaagtagctcgtcctcgtttgacaagtatcacacaaccattatacgatttaggagcggtatccatgcgcctattgacgaaaatgatgaataaagaagaagtcgaagaaaaaacgattatcttgccttatggaatcgaagaaaaaggatcaactaaataataaaagatcaatcatttaaaggttgttccaaaagtggtcaacttctggaacaacgtttatacgagaaagggggttatgacaaaattttgtcataaccccttttttttttgtgactttaaaaaaagagaaaatggcggaaacaaaccttacgtccatcgtatacgacacaatctgtgcgtagatgctacattttgttcactactatcaaaattactttaaaatgaaaacgtgataaaaaagaaagtagaaaagtaactctaaaaaatccaaaaaaatccaggctcgattgcgtacttatcttaaaggagaaacaatccatcatacataacccgaaaggagacttctatttgcctaagaaaagacgaaagaccatagtcatcattttgaccattcttactataggaatcggagggaaagtctacatggacaaaagagaagtgcaaagacagaaagatttactcgcagtagaaaaacagtccgtcaaagttctgaaaaatacctttgcggatatcaaggaagtgaagattgaacgtactggatacaataatataaccggtttttatcacatcattgtgatattaactaatattgaaggtaaatctgtaacttttgattatggtttcatcaaaaatgataccgaattaagtggttttgcagttgtaaatgaaaaaatacaaaaagaaggaaaaactaaaaataaaattaaagtgatatattcgaatgaggaggaggaaataatttgactataacagaaaaaaattacaataagcttagtaatatagtttatttattagacccgaagcataaaaattatgcatcttatttaaaagaagctggaatttataatttcggcaatacaaagttccaaattctaaaaatcaaaaactccttcgacggcatgcaggcgatggctgtagcgccaatcaagaacggtaaagtggatatttctcaagtagtgattgcctttgcaggaacgaacttaagtgattggaaagatttggaaacggatgcaagaagtatcatgaatctctatgggaatagaccaggagcaagtttttctgaaaaagcaacaacaaacaagattttatccgttagtggattgaaaacagcggggcaaatcaattcagcgattgcatttgctaatgaagtaaaaaaggaatatggagaagctgctatttctactaccggccattcattaggtggattcttagcattatatgtagcagcagagaaacaatggaaaaatgtcggcttcaacgggccggacccgtatgatctcttatcaccagaagcaaaaaaatgggtggaagaaaatcccggtatgctcaccaattaccgaaatcacgccgattttatcggtaattttggtggtaatggcacaggtgctgaagttcggatcagtatggaaacagcattcttgaatctgcttgcttcccacagtttaacctcttggaagtttgatgaaaatggaaagctgattattcctgaaaatgaaaacaatgtcaaagctcgaaaacaacagaaagaaaaccaagcgacccagttgttttcctatcagttgcaagaactgaacaacatacgtaaaaaactacgattaagtggcggccggctgacagttaatgaacaaatttacttagatgacacacaagctaggttagtggtggaaaagttatcggcaaaaatgaaaagcgctatggaagaagttatccgcatcaatcaaagaggaatttttgagctagagaaaaaatggcaagaaggcttgcggcaagcacgtgttgtcgccccttcgttgactgaacaggaaatcatagaagcattagctagtgtgggcgccacaaaagagaacttagtcgattctgcgaaagaagtctatctgctacgaatcaataaggcaagacgtatgggggaggcctttgatacattggcgaaggagatccaagacaaaatcaatgaaatcgtggcacgagatcgagaattagcacagcaattcaattaaaggagaagtagatgaaactagaagaattggaaagagattatcgaagtgaacgaagacaattagaagctcaagaagatgaattgacccactttaagaatcaaggattacgattgatggagcaagaggagcagcgactgcatcatgtattaaagaacttagctttagataatgagcctctgtttcaagcaagacgaagttattcgaattatcaggagcattatcaacaagccctacaagtagaacgacgaaaactctatcagcagcaagatgaactagaacgttcctatcgtcaaaaaatcagacaaataactatggagaaatcatcttatgaatgaatttttaatgcaattactaaaagaattagagaaaaatctacatcgatcaaatgtacgttcagttggtatggggatatctcagcaaatttgggcagaaaaacgattgacagatcaaaaccaccaaatgactgcagaagaagctgctcaagaattttctaaccgacatgtacacttgaaagaatcagtaaaagggcaatttgcagaaaaactaactgaattattccaaagacaagaaaagaaattaaaacagtttcgttagtaaagttatatagaaaaattttgtgaaaatggtttttcacatttttacataaatttgtcttaatatcgtagatgtaagcttttgaacaccatttattcggaaaaagggagctgtgacaagatttttgtcgcagctccctttaattctgattaatctattagatcaatcatctttatcgtctgattctttggtctctggattcgctctagcataagctgaagcggtgttccagtaatctgtatagttttcatcagtaccgccaacgccgaatttaaaggcgcttttcttcggaccattttttgcccaaagtgactccactgtttttcctggcgtttggatggattttttattgacagtaacttttccagctgtttgtcctgtgaacccagatacttttttcttcatcacatcggatgataagtcaaatttctcatcagtgccgaaaatctcagggtttgcttggtaagcttgattgattagattggcaagataattagccgaacgtattcttgcttggctgtccattccagtattgtcatcgtgtcctgcccaactactgatagtgatagatggagttgagacgatcagccatgaatctcggtattcattggtagaaccagtttttccgacccaatctgcatttcctagatttccgtttaagcttgagatgacatctttgaatggtgtagtgattttttcattgatcacactacgcatcatgtcattcatgatcgatgccgttgcttcggaataaatacggacagaattactttcatgtttataaatcacattacctgcattatctgtgatggaatcaatgatatagccttcttcgtagactccaccatttgctaaggcctggaatccatttgtctgttgaagcgtcgttacatctactgtccctaaaggagccgattcaacgccccaattatcatttgctgggtagttcatcttcgccaagtagtgctcgtaagcgtattgtttcgatccaccggaattcaacacatcttgatataagtgataagctgggatattgttggaccattccagtgactcacggacggtttggaaggtgttcgacccttcattggtcgcattgacgattttctcaccagcattttttccttcttgccaagtcgttgcataatctgatacacgggattctgatccgacaagtcccatatcgattgcaggaccgtaaacaagaaccggtttgatggatgaaccagcttgacgttctgtatcaaaggcgtggttattttgattctggctgtaattccgaccacccacgaagccatagatacgtccggttctgttatccatcaatacatttccagtctccacttggctaccagcaccatcatctaacatgtagccataattttctacgccggtttgcaatgcagcatagatatctttatcgatcgtcgaatggatcgtatatcctttgttttggatcgtttgctgtgctttttgataataagcttcactgaccgatgaatctgacatatcagcattatctttttctgccaattgttgtgcaataatccttgttgcttcgttcatcacggtataatacaagaattctctgtcagtctgttccgcgatttgttgtgggagaaagtcttttgtaagatcataggctttcgcttcttcgtattgttctttcgtaatttgtccttcacggtacatactgaataaaacaaaatcttttctggcaagaccggcagaaagatcttcttttagcgcgcctgtattcgtgtatggactatacgtgatagggctttgaggcaaaccagcgatataagcagcttgcggcagagtcacatcctttgcatctacaccaaagattcctctagcagcttcctggactccagcaatattttgccccttattattccgaccaaatggtgagacattcaaatacgtagcaatgatctcatcttttgaaaagtgtttttctacttgtgcagaaagaacgatctcgtttgctttacgtttgaatgttgtttcatcggttaggatctgttgtttgactaattgctgtgtcaaagtggatcctccagacgagccgatgccagtcgcttctgaaactagtgctcgtaaaacagctttagggacataaccttggtgtttatcgaagtattcatcttctgtactgataatcgcggttttcaataaaggcgaaatcttatcagatgaaatagtcgtccgcatcagatctgtctggatttttgatatctctgtattatctgcataaacaatctttgacgtttccgtaatgtttcctagttctgtctgcagttcttttttagtcggcaattgtgtgtcttcgacaagataggcaaagtagccagcacctattccgatacctagagctgcgaacaacaaaagaagaacagtaataaaaacagtcaatgattgaaacactctaaaaataatcttaggaacaaaccatttttctttttttcttctattctgtttttttcgagtatttttgcgtggcaaaagggtcacctcaactaatggttttatttcgctaattatagcaaataataggacaaaaaaacagacaaggctgtttttgacaggaatttctttttcgaatgagataaaacgtgaggaaatgatcttttttatgaaagagttcttaagcttttctttagggaaagtttcagttactatggagaacagggcaaagaaaaacaaactattttctttgtacatcatcttatcaatatataggaattgttcgaaacaattgcctttcaaggaggaatccatccatgttattaggctcacacgtcagcatgagcggaaagaaaatgctgttaggcgcggcagaagaagcagccagttacggatcttcgacctttatgatctatacaggcgctcctcaaaatactagaagaaaagctatcgaagagatgaatattgatgccggaaaagcatttatggcagaaaacggactaacaaatatcgtcgttcatgcgccttatatcattaatttgggaaatacgatcaaaccagaaatgtttccatttgctgtacaatttctgagagaagagattgtccgtgcggaagctttaggtgctactcaaatcacccttcacccaggcgctcatgtaggagcaggggcagaagctgggattgctagaattattgaggggttgaatgaagttttgacaaaagaacagacggcacagatcgctttggagacgatggcagggaaaggtacggaaatcggtcgaacatttgaggaattagcgcaaatcatcgatggagtaaaattgaatgaaaaattatccgttacttttgatacatgtcatacgaatgatgccggatataatataaaagaagatttttcaggtgtaatggaagagtttgataaggtcatcggattagatcggcttaaagtactgcatatcaatgattctaaaaatccacaaggttctcataaagatcggcatgccaatatcggttttggaacaattggatttgacacattgaacaaaatcgtccatgatccaatgtttgacaacatttcgaaaatattagaaaccccatatgtcggtaaagataaaaagaaagcttacgcaccatatggaaaagaaatttccatgttcaaagcgcaagcattcgatcccgaagtgttccctgagttattagcagaagaagtcacactttaagttttctatctgacagcaacaaaaaaggattgggcagtctgccttgtccttttttgtttaagaaacaaaggagtgctttttgcattcgttttcgacatgctcctttcgccccctctttttaaattcagacaaacagggtatactgatagaaaagtaaaaaacgaaaagtttcacaaacaagtagcaaaacgtgattgaaaggacgaaaagatgctgaacattttaaaccccttgatcgaccaactaaaaaagaaacatacatactttattcttggcatagccgtattatttacaattattcggttgtatttatatagtaaagcaatctatggaacagatatgtcggcgacctatgatgatcagctgctgattcactatgctcaaaatattttggatggtaaatggctaggggagtacacgactacgacactttcaaaagggatctcctacagcttgtttttagtacttgcacataaactgcatctttcttatgcagttttattcggcatgttcagtattcttgccagtatattggttgcactagcgtttaaaccaatcgtgaagaacaagtatcttcttttaagtatctatttttattttttgttttctccgattagttttacacatgaatattccactcgaacatatcgtaatgctctcgtgatcccgactgttgagatcattatcgcttgtttactagctatttattaccgcaaatataattccagcaaaaaattgctgccgtggtttttagggctagctgtttcttttcctttcttttggttcattcgcgaagattccatctggcttcttccttttactgtagtcgcgttaggcatcagtttcgttcagatcttgctaggacaagacttttctttcaaagaagcaaagaagttaaaagaacgaccatttctcctttcgaaacaagaatggctgaaactttcattgtttttactccctctagtcggtttctccatcgtctatcagtggatcgaatataaaaacgagacaacatatggtattgccgccatcaatgaccgttcgagtggcgaatttggacgtttgatgaaacagctgatccgaatagatgacgaaacaaacttaaataaagaaaacagtgagatatgggtctcgcatgctgcattaaataaagctttagacgcatctcctacatttcatactgtttctactcgtattgacgaattgtatacgactcatgcgtggacccaaggcggaaaagtaaaagaattaccaggagatatcattttttgggcattgcgagatgtggtaagcgaatctggttattaccaaaacaatgcaaaagaaaccaatgatttttggaaaaaagtcaatcaagaattagaagaagcctatcaaaagggaactatcaaaaagaaaaaagaattttatctgatgggatcaggggatggaaagacgatgaatgatctgccaattgtatttgcttttctgaaatcaggatatgcctatgcatggcgatacaaagatttccatcaaggggggaattatagtttcgggacgcaagaacaagtcgaacaggcacaagaactattgaatcttccactaatggataattggatcgatagcagtgatccgagaacacctgatttccagttgacaaaaacagcaaaagtcgcgaatgtcatgataaaaatttaccaagttctggccattcccgtgctgattgcttcaatagcagggatattacttatgatactaggaaccgtatttgcaaaagctgatcgtgcctattatagttcctctttgattgtagtcatcggattaatactgacacaattggtttttcttttcggtgtctcgtggttttgttcttatgcgccagaaaaaaaggattattttttaagtgtctacactggcgcaggcgtgccattaacgcaattcatcgcagtaacaagcatgctagtttttagtaaattgaatctgaaaaaagctttatcttccaaataaaaagggaactgtgacaaaagtcttgtcgcagttcctttttccgaataaacggtgctcaaaagcttgcatctgcggtaataagctcaaccaaacgtaaaatatgaggaactatttttgtttggctgttcttattacttgatgcaggacagctttttcacaacctctgatacacggtgttccagaagtaacttcttcggaaataagccgaaatttcacaaaaatttgaaaagcaattttcttaaattccttcttatttcttgaagctgcccacttctgtcacaacctcctttgtgtaaaagaatcagtttctattcgatttcttctatcgtttcttgcaaacgctgttcatattttttgtttcctttatataaatcaccaatcgtccatgccaacaggagaaggacaagaacaatgattacataggcgatttgatcagccaatgctagttgagctgaggtggcttgctcgccgaagaaactttcgatttgacctggtaatcctcgtaagttcaagtaagtcagactaatcacagagaaccagccaagaagttttacaacaaatgaatttttgaatcggctccccatctccgcttggctattggtcatcatcagtaaaggaatcatcgagaatggcaatgcaaaagccagaaaaacttgggattcattcatcaagttattcaaagcggtatgttcttctatcgttccttttgtacttgtaaacaaaacacaaatcaatacaggaatcacagaaagcaatcgtgtgactagtcttcttagccaaatcgggatacgcatatggatgaagccttccatgatgacttgaccggtcaacgtaccagtaatagtagagttctggccagaagcaagaagtgctacagcaaataaagtagacaagataccagattttgctacagcaatcaagataccattgctcatagctgatggatcagataaagcttcatacagaccaaaaaaggaaggatcttggacagaaccggttttgaatacagcgacacccatgatcaatagcagtgcattgactaaaaaagccattgacaactggatattagagtcccaagtagaaaagcgtaccgcttgtgctacatcttcttcgtcttggtgatcaatcttccgagtttgagaaactgctgaatgaagatataagttatgcggcatgactgttgcaccaataatccctaacgctccagtcagcggagtttcaccacctatgacaggtgagtctgagaatgtatgactgttagggataaagccagcaaataaactgtgccaatcagggttagacaagccaacttgatagacgaaaacgaataaaatgacgaaaatcaagcagacaaccaaagcttcgattttacgaaacccgacttttgtcagcaataaaaggacgaaaacatctaacacagtgataaatacggcaattaccaatggaatatcaaaaagtaagtagagggcgattgctgcaccaatgacttctgcgatgtctgttgccataatggctaattcagtcaagatccataaaatgacacccaatgtcttacttgtccgtgctcggattgcttgggccaaatccatttgggtcacgattcctaattttgctgccatatactgtaaaagcatagcaattagactagacatcaaaataactgacatcaataaatattggaaattttgtccaccagtgatcgaagtggaccagttacctggatccatataaccaactgctactaatgcacctggtccagagtaagcaagaagtgttttaaaaaaactttttccctttggtacatccactgttccatttacttcagctaaagataaaccatttgtatgttcaataagtcgatgcttatgaaattgtttgttggattgattattcaagaaaaaaccacctttcctatttatctacgattacattctacacctcagaaagaaaaaattaaagaaaaagattcggtatgcctaattttttttcgtggcgtgtcttgctggttaataaaagaaattttgttcttctctaaaaaaaccactattttttgcatgaaactaaagaatacgcctttcttttttcaataaactttagtaaaataaatcattgagagcaattcggaaatagaaaggagagatttatatggtatcaacaggtattgtcgtacttattgctattattgctttgctaatcggcgcagtaggtggctttttcctagcgcgtaaatatatgaaagactatttagaaaaaaatcctcccgttaatgaggacatgttgcgatcaatgatgatgtcaatggggcaaaaaccatctgagaagaaaattcgccagatgatgcagcaaatgaagaaccaagggaaaaaataggttctgacccaaagactttttgcgggctgattttttcagtccgttttttatttcgtaatttgttagactattcagactattcagcaaaaaagacaagcacagacaatcctatgctcttgataaagacaaaggaggagtaaaatgtcgatttttagaaaattaggttggttttttcgtcaggaaaagaaacattatttaattgggattttctccctattcgcagtggccttggtacagttagttcctccaaaagtgattgggatcatcattgatgagatcgccgataagaatttatcaataaagatcatttcttggtggatcttactattgatccttgcagctttcttacaatatctttttcgttatatctggcggacgaatatttggggaagtgcagctcggttggagaaagaacttcggcagcagctattcaaacattttacagaaatggacaatctcttttaccaaaaatatcggactggagatttgatggctcatgcaacgaatgatttgaatgcaatccagaatgtagcaggagctggaatcttgacctttgcagattcagtgattacgggcggaacaacgatcattgcgatgattttgtttattgattggcgcttaacactgattgcgctgattcctctgcctttgctagccgttacttcacgagtgctggggtcaaaactccacgatgcttttcgtgattcgcaagaagctttttctagtatcaatgataagacacaagaaagtatcactgggatcaaagtcattaaaacatttggacaagaaaaagaagatctcgcggattttgaagaaaagattgaagatgcaattattaaaaacaaacgagtcaattttttagactccttatttgatccattcattaccttgattatcggtctgtcttatgttgcaacaattattttaggtggaaagtatgtcttggaaggcacgatctcgatcgggcagatggtctcatttattagctatatcggtatgcttgtttggccgatgtttgcgattggtcgattgttcaacgtattggaaagaggaaatgcttcttatgatcgcgtcaatgaacttttgcatgaaaagacgcatatcgtggaacaactgggtgcagtgcagaccccggcaaaaggcgagctgaatgtagctatttcctcttttaactatccgaaagaagaatcaccagcattagaacaaatcaaatttgcgatccaagaaggagaaacattaggtattgttgggaaaactggtgcgggaaaaacgacaatcatcaaattactgatgcgtgaatacgatgattatcaagggaaaatccaatttggcggacgttcgatcaaagaatattcattgaatgctttattaggatcaatcggttatgtgcctcaggatcacttcctgttttcgatgaccattcgagataatatccgtttttctaatccaaaactttcagaagaagaagtagagcatgcggcttctttagcatttatcaacaatgaaatcaaggaattgccaaaaggttatgataccttagttggagaacgtggagtctctttatctggcggacagaaacagaggatttcgattgctcgagcattgatcaaaaatcctgaattgctgatcttagatgatgcactttctgcagtagatgccaaaacagaagaagctatcttgcataatttaaaagaaataagaaaagagaaaacaaccatcattgcagctcaccgtttaagcagcgtgatgcatgcaaaagaaatcattgttgtcgatcaagggaaaatcattgaacgaggaacccaccacgagctgcttgcattaggtggctggtatgaacgaatgtgggaaaaacagcaattagaagcgaagatagaaggaggcgaggcctgatggatgaaaattatcaatcggaatggacaaaatcgattccacttaaagaacagaagaagatcatcaaacgactgatgaagttcgccaaaccttttagaagaacgttcatcgttgctatcttatttgcgtttgccctgtctgtgatcaatgtcctattgccaaggatcatccaaacttttatggatgatcatctggctaaacagtcagctacgacacaagttattttgttttttgctggtgtgtacttgtttggagtcatagtcaaaagtatcatttggtttttccaatggtatttgtattccatggcttcattgaagacctatcagtatgttcgggtaagattatttgaaaagctgcatacactaggtatgcgttattttgaccagacaccggcaggatcgaccgtttctcgagtgacgaatgacacagaaacgctatttgaattttggtatgtctttttgatggtattgactgggatctttgcagtcgtttcttcattcattgccatgtttcaaatcaatggagaaattgccttgtggactttggtgttcttgccgattttaggaatcgtcatctggtattaccagaaattcagttctcgtatttaccgaaatatgcgggaaaaattaagtcagctgaacacgaaattgaatgaatcgatttccggcatgcgtattatccagcagtttcgccaagaagctcgtttagctaaagaatttgaacaagtgaacaacgagtatttagacacgcgctatgcgatgatcaaaacgaattcgattctgttaagtccgatcatcaattttctctatgcattggcgattgcgttggcgttgactttgtttgggatcgatgcgttgcattctcccgtagaagttggactgatctatgcatttacgacctatgtccagggattttttaatccaatgtctcaaatgatggactttttgagcacctttacagatgggatggttgccggtagtcgtattttgaaaatcatggatacagaagaatatgcaccgcaacaaaatcctggagcagatcaagcgattacttcaggtaagatcgagtttcgcaatgtaagcttttcttatgatggagagcacaatgtattgaacaatatctcttttgtcgctaatccgggtgagaccgttgcattagtggggcacaccggaagcggaaaaagctcgatcatcaacgtattgatgcggttttacgaattttatgaaggccaaatcttgattgatgatcatgacattcgagaatatccaatggaagagttacgtaagaaaatgggattggtcttgcaagatgccttcttgttttatggagatattgcaggaaatatccggatgatgaatccagctatcacagacgaacagattcgccatgcagctgagtttgttcaagcaaacaagttcatcgatgaattaccaaaaggatatcactcaaaagtgatcgaacacggtgccagctattctagtggacaacgacagctgatcacttttgcgcgaacaatcgtgacagatcctaaaatactagtattggatgaagcaacagcaaatatcgatactgaaaccgaaggattgatccaagaaggattggcaaaaatgcgacaaggacggacaacgatagcgattgcccatcggctgtccacgattcgggatgcagaattgattttagttttagacaaaggtcatatagtagagcgtgggaatcatgaaacacttctagcgcaaaatggtttgtatgcagatatgtacaaactgcaaagcagtggtgtgtaaaaagaggttgtgacagtagcatagtagcattttgccctaagcgctagagtgaaaataaaacagagcttcccagattcttcatctgtgagcgttagtggcgtagtcacccgatttaaaaaagacgacgacagctagtcaaaagcggctaataaccactaagaaagcgttgacaaaagcgtttgctttcgataatataaagaaaacgatacaacttggatagtgattgcctgatgcaagctaaacctgatgagtctcccatggttccatggacggctttttgggtttttctttttgttttggatacagccctatatatcatggaaaggagcaaaacatgctgattgagaaagtactgaataacaacgtcgtaataaccagggacgaaagaaatcaggaaatgatcgtgatgggaaaaggtttggcattcaaaaagaaagtgggtgacccgatttttgactcatgcatcgacaaaaaatttcagttgacaaatgacgggctttcacaacagttccaagaattggcacaagcgattcctcttgagtacttagaaatttcttgtgaaatcattgaatatacagaagaggctctacaagtccagttgaatgattctgtgtatattgcattgacggatcatttgtatacggctatcgaacgtcacaaaatgggaatatttgtaccaaatgtattgctgtatgatatcaaacaactatttcctaaagagtatgccatcgggaaaaaaacagtgaagaaaatctcggataaataccacatcaagttatcagaagatgaagccggatttatcgcattgcatttagtcaatgcacaaggcattcaaagccaacaagacaatacctacctgtttactataacaatacaggatattctaaatatcgtccgctattactataagattacatttgatgaagattcagtccatttttttcgattcgtcacaaacttacgtttttttctgacacgcgtcctagatggagaaaaatcagaagtgggagaagtttctgaggaattgtttcaggttattcaaaaaaaatataaggatacgtttggttgcgttgagaaaatagcagactttttagccgagacgttcaactaccagatgtccacggacgaaaaaatgtatttaacgatccatactgcgcgtttagtgcatgagaatcgttgtaaataaataaaaaaaggaggataaattaacaagaacgtatgaaataagggtagtgacattcagttggctaaactttccactaatatattggagggaatagaaatgggaaaataccaagaattagcgagaaaaatcgtagaaaatgtcggtgggaaggaaaatatcaatggtttgacacattgtatcacaaggcttcgtttcaaattaaaaaacgaagaaaaagcaaatgatgagatcttgaaaaatatggacggtattgtaacggtaatgcgagcgggagggcagtatcaagttgtcatcgggaatcatgtgccagtcgtgtttgaagaggttataaaagcaggaaaccttacttttaatgaggctgtttcaacagaaaaaatgagaccgtttgatatgcttattgatggaatatcgggctgtttccaaccattccttgctatcttagctgctggcgggatgattcgtggactgacagcattccttgtcttcttaggcgcgtttgaccgcggttctggcacatttgttatgtttgataatatcggtgattctgtattccaatttatgcctgttattatcggtttaacagctgcccgtaaatttaaagtaaatgaattcgtagggatgttgcttggcgcagcattaatgaatcctagcttgtcgctggaagctttgagtggtgcagcagaagcaccactaacgaccatattttctggcactatttttgaagcacctatttatcaaacagtattcggcattccctggattgcgcgtaactacgcttcttctgtcattcccattatctttattgtgttgttagctagccaaattcagaaaccaattaaaaagttagtacctgagatgatcgcgaatttcttcgttccattcttcaccgttcttattacaatgcctttaggttttttactcgttggaccagtattcacattcgcaactgatattttaatggctggatttgaaacacttttagcactttcgccagttatttatggagcaatcgtaggcttcttctggcaaattctggtgatgtttggtctccattgggcaatcgtaccaatgggattgatgcaattttctgtgaatggttggcaaaatattatgacacctgttgcagtagtgtcttttggacaaactgcagcacttaccgcactctactttaagcttagaaatccaaaagacaaagcaattgcaataccagccattgtttctggtattgtggggattacagagccagctatttatgggtttacattaccacgtaaaaaaatatttatttttacctgtgtcggtggtgcgttagggggcgcgtatagtgggttaatgaatttaacttcttggaatcaaggtggactaggcatctttacaattcccaactatattagaccagatggtgatttaacagatgtgattaatgtattgattgggatcgccattgcgatggtggtatcctttgcgctgacttttttcttttggaaggaggaagcaggtgaaacagatgacagacagaaaagatcaggtaaagaaattgtaaaaacaccgatacaaggacaaatcgctccactgaaagcagcaaaggatgcagcttttgcacaaggaacactaggtcgaggaatcttgatctaccctgaaaaaggagaagtacgtgccccttttgacggaacagtcatgaccctgttccccacgaaacatgcaatcggaatggtttctgaaacaggtctggaattgctgattcatgtcggattggatactgttcagttggaagggaaatattttgaaagcttggtgcagcaaggagaaagagtgaaacaaggcgatctgttgctccgcttcgacaaaaagaaaatcgaaaaggaaggatacagtttagaaacacctgtaatcgtcaccaattacatggattatttggatattttggaaaatcaaggggagacggtcgggccagacgatgcacttatcaccgcactgacctgaacggttaggtgaaagaatggaatagacttaactattctttttagtccacttctttattttcaaaattgaaaggctctttcatgatggctgagctgatagggcgtttatcaaatttttgtcctacagaaattagatggactaaattctgttgataattttctgcaaaaacacaactatataacacgtctagaagataacaaatcgatgtattgatcgtaaaattaccaatttttgaatacagtcgttcgcgtgtcgtaagtcgcaaagcggctgtactcattgaggatagcgttgaatcaccgatactggtcaaagctaaaattggaacatgattttgtttcaatatttctgcggtacgaaggatcacattgttttcacccgtataagaaatcagaatcccgcacatatcactcgtgcaattgtacgcttcatagaacgattcaccaaaagtggtgacaatcgtgacatccattttgatgcgcttcattttcagcatgaaatcttgagaaatcaaagtattcgagttactggcgaaaatcacgattttttttgcttgaagcattagttgtttggctttttgcagttggtcatgatgaatgagagaaagtgtatcttgaatcgtcatctgttctaaagaagccattttatttgcgatcgccataataccgtctgtggtggaaaaaggaagattcgcatctacgtcttgaaaattcccttcaagataggctgtttcagctaaaaaagcattacgaaaactgacccagccatcaaaacccattttttttgctacacggatgagtgtggacgggtggacataacatcgctcagcaatctcttggatggtcatttcgccaagtgctggagaatcgcttaagagaaactgaatcacttcattttctgaaggagaaaaggagatttctttgattttttcacgtaataacatgtagataccttcttctagtttttttacgtaaattataacttttttgaaaatgatttgtaaacggatttatgttatatagcttaataaagtcattttttgacaagatatttacaaaaatccagtagaaaacactaacttttgtaaatgttactggaaagaaacgaatttctattgtttgttttgtttacaaaaaagataataaaagtgtaaaaagcaaaggagtgagaacatggcaaaaggaatcaaaatcgctacgattggtggaggcagcagttacacccccgagttgatggaaggatttatcaaaagatatgaggaattaccgatacgagaaatctggctcgtagatgtagaagaaggaaaagaaaagcttgagatcgtcagtcagatgtctcagcgtatgtgggatgcttctccgtatgaagtcaagatctatgcaactttggatcgggaagaagcattgaaagatgcggattttgttacgactcagtttcgtgtcggtcaattagatgcacgaatcaaagacgagcggatccctagttattatgggatgattgggcaagaaacaaatggtgctggcgggatattcaaagcttttcgtaccgttccagtggttttggcaatcgttgaagacatgaagcgtttatgtccaaatgcttggctgatcaatttcgcgaacccaagcgggatggtgacagaagcagttatcagatatggcaaatgggataaagtgatcggattatgcaatgtgccagtaatggcgacgatgacagaaccagcaatgcttggcaagaaaaaagaagagctgatctacaagtttgccggtctaaatcacttccattggcacaaagtagcagataataaaggaaatgaccgcacagcagatttgattgatcgtttatacgatgaagacaatggattgccgaaaaatatctttgacatcccgtttttcaaagaacaattaaaacaaatgaacatgatcccttgtggctaccaccgctattactaccgtgaagaagaaatgttggaacatgctttagaagaatatcaaacgattggtacaagagcgcaacaagtgaaagaaacagaagcagagctgtttgaattatacaaagatccagaattggatcataaacctgaacaattgcaaaaacgaggtggtgcttattattcagatgctgcctgtgaaacgattgcttcgatctatggaaataaagaaacacagatcgtggtgtctacaaagaatgatggagctgttcctgatctgccggcagattgtgtagtagaagtcactgcctatgttggcgcacaaggcgcacgaaatgtagcgtttggttcccttcctgctgctgaaagaggctggttgcaagtaatgaagaatatggaattgctgacgatcgaagcagccgtgactggtgattatggaacagctttacaagcgtttacgatcaatccgcttatacgatcaggaaagacagcaaaacggatcatggatgagttgtttattgcacatcagcagtatttaccgcaattcaaggaaacaatcagccggttaaaagcagaaggaatcgaagtccaagatgaactggcaagagaattgtcaagcaatacacatgtaatggaggaagtatgatgggattcagaaaagattttttatggggcggtgctacagcagccaatcaatgcgagggtggttatgatgaaggcggacgtgggttagcgaacgtagatgttgtgccaatcggagaagaccgttttcctgtcattactggaaaaaagaaaatgtttgaatttgataaagatcatttttatccagcaaaaattgcgatcgatatgtatcatcattataaggaagatattgctttgtttgcagaaatggggttcaagacttatcggatgtccattgcttggagtcgtatttttccaatgggcgatgaaaatgagccaaatgaatctggtttgaaattttatgaggatgtctttaaagaatgtcaaaagtacgggatcgagccgcttgtgacgattacacattttgattgtccgatgcatttgatcaaagaatatggtgcgtggcgttctagagaactcgttggtttttatgaaaatctgtgccgagtcatcttcaatcgctataaaggacttgtcaaatattggttgacattcaatgagatcaatatgatccttcatgcaccattcatgggcgcagggctgtattttgaagaaggagaaaatgaagaacaaatcaaatatcaagcggcacatcatgagttggttgcaagtgccatcgcaacgaagatcgctcatgaagtagatccggagaacaaagtaggctgtatgctggcagcaggagcatattatccatacacttgcaatcctgaagatgtttgggcttctagaaagtcagatcgagaaaattatttcttcattgatgtccagtcacgaggagaatatcccgcttatgcattgaaagaaatggaacgaaatggcattcagatcaaaatagaacctggggatgccgcattgctgaaagaacatactgttgattttatctccttttcttattattcttctcgagtttcgactactgacaacgaactcttggaacagactgcaggaaatatctttgcttctgtcaaaaatccatatctggaagcaagtgaatggggttggcaaattgatccattaggcttgagaataacgatgaatgatatttatgatcgttatcaaaaaccactatttattgtagaaaacggcttaggtgcagtcgatacgcccgatgagaatggttatgtggaagatgattatcgaatcgactatctggcagcacatatccaggcaatgaaagatgcagtagaattagatggagtcgatctattaggctatacgacttggggatgtattgatttagtatcagctggtacaggtgagatgaagaaaaggtacggattcatttatgtcgatcgtgacaacgaaggaaatggcacattagcccgttcgaagaagaaatcattcaactggtataaaaaagtaattgattcaaatggagaaaatctttcgaacgattgatcaatgatttataaaagtctattgtttttcagcggatttttcgagtataataaagctattcgagaaacgcaagcagaacaatagactttttttcgcattggctgtaaagtatgcttacttgattaagtaaaggagaatctacatatgtatgatgtaatcgttattggcgcagggcctgctgggatgactgctgctttatatgcttcacgttcaaacttatccgtattgatgatcgaacaaggcgctcctggcggccaaatgaacaatacggcagaaatcgaaaactatcctggtttcgattcaatcatgggtcctgatctagcttataagatgtatgaaggtgtttcaagatttgggacagaaaatgcttatggaatcgtgcaagatatcaaggatcacggcagccacaaagaagttatttgtgaagataaaacttacgaaggaaaaacagtcattatcgcaacaggctgtatccaccgtaaattaggcgtacctggcgaggaagaatttgctggacgtggcgtttcttactgtgcagtttgtgatggtgcatttttccgtaacaaacgtctagtagtgatcggaggaggagactcagcagtagaagaagccatctatttgacacaatttgcttctgaagtagtcatcgtccaccgtagagatgaattacgtgcacaaaagatcatccaagaccgtgcatttgcgaatgaaaaaatttcctttatgtgggatacagtcgttgacgaaatcgttggaaatgaaatggtagtgacaggtgtgaaagcacgtaatgtcaaaactggcaatgagtttgatttggcagcagacggagtattcatctatgtaggattggatccattaactgcaccatttagagaagcagggttgacgaacgaagctggctggattccaacagacaacgaaatgaagacgaatataccaggcgtttttgccatcggagatgttcgtgaaaaagatttgcgacaaatcactactgctgttggtgatggtgggatcgctggacaacaagtgtataaatacttggaatctttagaagaaacaactgcataagtttaaaaagagtggaagaacggtttcaattgttcttttactcttttttttcgcgtgaaatctactgaatccgatttatgcgaatacttgcaaccgtgcttgataaaagaatcctttcttgatttaagcgttttttggtcctcatactttcatatctaataagtgaatgctatacttattaagaaccatatttcagaaagaggtgttattttcatgtcttgggaacaagtgtatgaacaatgggtacatgaagaaaatttagaagaaaacttaaaaaaacaattaaatgatctgggtgaagatcctgaaaaacttgaagatgctttttatgcaccgttggaattcggtactgcaggcatgcggggaatcttagggcctgggatcaatcgaatgaacatctatacggtaagacaagcaacagaaggacttgcacgtttcatggatacacaaggcgaagaaacaaaacgccgaggtgtcgctatcgcttatgactcacgccatcaatcaccagaatttgccatggaagcagccaaaacattagcacatcacaatatcccatcttatgtattcgaaagtctacgtccaacaccagagctttcttttgcagtccgtcatttgaagacgtttgcgggaatcatggtaaccgcatcccacaatccagcagcttacaacggatataaagtctacggagaagatgggggacaaatgcctcctgcagacgcagatgcattgacgaaatatgtccgtgaagtcagcaatccgttaaaagttgaagtattatctgacgaagaagctgaacatagcggattgatcacgatcatcggagaagaagtggatgccgcttatctagaagaaatcaaagcagtaacgattgatcatgaattggtggaaacaatggggaaagatttgaaacttgtgtacacaccacttcacggaacaggaaaaatgttgggcgaacgtgcgttgaaacaagctggattcgaacaattcgtactagttccagaacaagctgtcgcagacccagatttcactacagtcaaatcaccaaatccagaagaacactctgcttttgagtatgcgatacgacttggcgagaaagaaggcgctgatttgctgattgcaacagatcctgatgcagaccgtttaggtgcagccgttcgtttgccaaatggctcctatgaagtattgaccggaaaccaaatcggagccctgtttgctcaatatattttggaagcacaccaatcgcgaggcactttacctgaaaacgcagcggtattgaaatcgatcgtttctagcgaattacctacagcaattgcggaacactatggggctaccatgttcaatgtattgacaggattcaaattcattgctgaaaaaattcaacaatttgaagaagatcattcccatacttttatgttcggattcgaagaaagttacggttatttagttaaacctttcgttcgcgataaagacgcgatccaagcattgctcttattagcagaagtagcagcttactataaaaaacaaggcaaaacgttgtatgatggcttgcaaacgatttttgaaacatatggctactacgcagaaaaaacgatttctgtgacaatgagcggacaagaaggctctgcgaaaatctctgctttgatggaaaaattccgtgaagaagcaccaacagaatttgccggagcaaaagtcatccaaacagaagacttcaaagagttgacgagaacagaccgtgaaggaaacgtagaaaaactaacgacaccgccatctgatgtattgaagtatacgctggaagaaaatggctggatcgctatccgtccttcaggaactgagccgaaaatcaaattttatatcggtgtaaaaggaaactcttcagaagacgcagctgaaaaagtagccgcttatgaagcgattatccaaaagatgacagaagaataaaaaaacttgagactgatggaaaaagtggtaaactttagaagtcagtcttttttcaagttggaggtgaatggattgccagacacgcaaaaaacaaaagtagagaaagtcagccaactattcaaaatgttgagtgaccccactcgtctcaaaattctgctgtatctgaaagacggggaacaaaatgtgacagcaatcacccaagcagtggaaatggaacaatctgctgtatcgcatcaactgcgtttattaagagaaaaccatgtcgtcaagtcccatcgtgagggaaaagcgattttgtatagtcttgatgattctcacgtactggatattttgaaccagacactcaaacatgtggaacatcaataacgataggtgcaaatagagacaaactggactgtgtcaacgaatcttcttcgctgacacagtccagtttttttaaagaaaaattgttagtctgtttcttcggtggtttcagttccataataactatggtcttctaggtctaaagcattcaaaataagtgaagctgtttcttcgatagataaagaagcgacattgattactacgcagcccaatttttcataaagatcattcgcaaaatcgagttcagctcgtattttttcgatatcggaataagcagtatcaggatttaatccgtaagagcgcatccgttctttacggatattgtttaaaatatctgggttattcgtcagtcccacgatttttttaggatcgatctcccaaagctgtttgggaatatgtgcttgtgggatcaaaggtagattggcaacctttaaatttttgttagctaaaaacaagctcaaaggcgttttggaagttctggatacgcctagcaaaacgacatctgcttctagaaacccacgaggatctttcccgtcatcgtattttacagcaaattccattgctttgatccgtttgaaatagttctcattcaataaatgaagggcgccaggttgccgaatgggcttgataccagttaagcgctcgatttctgatatcggcggagtcatcacatcaaaactaaataattgatgttcttcacaaaaagaacgcgtcatctcgatcaattcttgattgatcaatgtgtgtaggacaagggctttttcttttagtgcatcttgcagtgcctgcatcaatgttttctcatctgtcacaaatgttctgcggaataaattgaactcaacggtaggatattgggccatagtggcttgcgctaattttgtcgcagtttctccagcagagtcagagatgacaaaaaaagtaacgatttctgtagaatcggaagacatggataaaacctcacttgcattttttttatgtttattataccatactctagaatgtgtacttcgtaatcattttgatttggaggaataagtcatgaaaaaacagacattgattgaacaatcactagaaacattgaaaaataacggttttaaatatactaaaaaaagagaagcattgttaacttatttagtgaagcgcaatcgctacgtatccgctaaagaagtttttgactatatgaatcaggaattcaaaggagtaagttacgatacgatttatcgaaatctccatgattttgcagaaatcgatttactggaagaaaccgatttaaatggagagatgaagtttcgttttcattgctgtcaaggggaaatcggccatcaccatcactttatctgtacggtgtgcggaacaacgaaagaaatccatatgtgtccaatgaattatttcgaagaacagctcggtggatgtacgatcgaagggcatagattcgagattttcggaagatgtgaaaattgtcaataaggatttaaataaaataacatttgataattttaaaaaaaagcaagatttccttgacggtcaaaacagcattagatataatattaacaggacagtcttgttttttgagatatatttcaataacaattacggttactttttaagctcggagggagggaattaacatgtcaaaaacagtcgttcgcaaaaacgaatcacttgacgatgctcttcgtcgcttcaaacgttccgtgtcaaaagcgggtactttacaagaatctcgtaaacgtgaattctacgaaaaaccaagtgtaagacgcaagaaaaaatctgaagcagctagaaaacgcaaaaaattctagttctgtgatgaattggagttggtagtgtgtcactactaagtagattaaacgatgacatgaaaacagcgatgaaagcgaaagataaggaatctttacaagtcatccgaatgatcaagtcatctatacaaaacgagcagattaaagaaggtcacgacttgacagaagaagaagaattaacggtgttgtctcgcgaaatgaaacagcgacgtgattctttgcatgagtttgaagaagcaggacgtgacgatttagctgaaaaagtaaaaagtgaaattgtgatagtcgaaaaatacatgccggaacaactttccgacgaagaaattcgacaacttgttcaagaagcaatcacacaaactggtgcttcatcaatgaaagaatttggcaaagtcatgggtgcgatcatgcctaaagtcaaaggaaaagcagatggaaaccaagtaaatgccattgtgaaagaactattacaatcttaattttatcatttaaactgcggacaatcattgtccgcagtttttttgtgcgcgtaaaaaagagaactaaaaaatagctagacgaaagaataggattctttcatctagctggttttttcctgtttaatatttcttatgttaaattgtgtttgatttggttattcttctggtagttcatttgcttcttgtttataccctgataggcgataggcgtaataaaacagtaggctgccagcgtaaccaagtaacgttggcaccatccagccaagtcctaatgcagcaaaaggaacgtgatgatgataaaattcgagcatgcttgctacaactctttgttgactcactaaagcaggcgaatttgccagcatatccaatacggcaggaacagcagcaaacaacatcgttacttgatagacaaatggtgtcttttggaaaaattttgctgttaaggaaagcaagatcaacgcaagcgacaatggatacaaaagcatcaatactggtaaagaccattggatgatattgtctaaaccagcatttgcaacgacaaaagagacgaaagtcgttaaccgcagccatgtcatataactgactttagggaacagtttatggaaatcttgcgcaaaagaaacaacgagtcccatagcggtagtgaagacacctaatgtgaccatcactcctaagaagctagcaccgaagttacctaaataaaaattagtgatctgagaaagtgcagttccgccattttctgataaagacatcttattcaaactcatcgcaccgagaagaacaagtccaaaatagatcatgacttctagcgcaacgctcaggctaccagcttttgccgttaattctgtgacttttttatctttgaaaccaaggtcacggactgcatggacaaaagtgacacttaaggcaagcaaagctactgcatcaaccgtgttataaccttctaggacaccatttgttaaagcgtttgtttgataagtatctgcagcagattgatttagatttcccattggatggaataaagaaacgacaaaaatgattgctaataatgcaagaaacaaggagtttagatactttccgacgtatttgaccaaccgtgttggatggacagtaaggaaataagcaagtaaaaagaaaagagcagagaataaaaacatacctaatgaattatatttttcaggcaaaaatggtttagcagccatttcaaaagcagtagcagctgtccgtggtgtaccgaaaaatggtccgatcgtcaaatgaacaaggattaagaacaaggcagcataccattttccgacaggtttagctaagtcatacagaccatcactttttgtcactactacagctaagatagctagtaatgggaaaagagcacctgagatagcaaatcctacgccagcactgacccagtttgcgccagccatttgacctaagtggacaggaaagattagattacctgacccgaagaacatcccgaagataagtgaactgaccatcaatagttgtttccatgaataagtttttgtttcttccataaatttttcctccaataattatcattttgattgacgatataaacgttgcagcaattagtaatgccactaatatcagattccatgaaaaccaccaccttaaaataaaaaaaagcccttttccacttgggaaaagggctctagattctagaacggtaccaccttttttcgcttaaaaaagcttcttcattcacggacgctttttgataaagttatccgctagcctgataatggaggcagccacaatgatctacgttttcgacattgactcggaaatgatgttcgtctattcgatttattgtcatttctcacttacatgactcactgggaataaatcgttgaatagcctactgttttcctcgacgctttgctgtatgttcatttgttgacgtaataatacacctgttttttttgaaatgcaagaatattttaactattttgttttctttttttgaaacaggaaaaatacctagagaatacttgttgaatgaaacgaaatattttgttctccactttcatataacttacattctcagcttctttttatcaaaacgagacctttagcgaatggaaacggctattttttaacgtttcttggtacgtatggttaagcgactcttttacaaccttttcttatttgctatatagtttcttctgagtatggtaaaataggaaagaatgaatcgaaaaaaaggggatgtctatttttgacggaagagtctagttctttagagattagattgacagctgctgatgatgtcagcatgcttttaggtgcacacgacaagcatataaaactgatcgaggaaacaacggaaacaaccatccatacacgtggagaaatcattcagatcattggtgagcaatcccagatttccttggctgcctcagtcattcggacattacaggaattgatcaaacgaggaatccacgtaagtacgccagatgttgtgacggcattgaagatggggcaaaaaggtacattagattattttgttgagatgtatgaggaagagatcgtcaaagaccgtaatggaaaacctatacgggtaaaaaacagcggtcaaaagaaatacgttgaatcggtagccaaacatgacatcgtatttggtgtagggccagccggaacagggaaaacgtttcttgccgtagtattagcaattgctgccctaaaaaaaggcgaagtgcaaaaaatcattttgacgcggcccgctgtggaggcaggggaaaacctaggctttctacccggggatctgaaagaaaaagtggatccttatctgcggcctgtttatgatgctttataccaaatttttggattggatcatacgaaccgattgatggaacgaggcgtgatcgaaatcgcacctttagcttacatgcgggggcggacattggatgatgcattcgttatcttggacgaagcacaaaacacgacagtcgctcagatgaaaatgttcttgacccgtctcggttatcaatcaaaaatgattgtcaatggggatacaagtcagatagacttgcctcgtgggacgacaagtggtcttgttcatgcagaacgaacattaaagcaaatcaaaaaaatcgattttgttaattttgaagcaagtgacgttgttcggcaccctgtagttgccgaaatcatcaaagcttatgaaaaggcggatcttcatcaagaataagctttgcttaggaggataagcacatgttgaataaaacactgcagaaactacaagaaaaactcggaaaggcagcattgcctttccttctgttcttgttttttatcattgtctgcggcgttacatttagtagtgtcaaacaaaaggccaatgatttcagagaaggccaagtagcagaagagagtatccgtgcgaataaaacgattgagaacacggaagaaaccgaacaaagaagaaaactggcagcagaagcagtgactccagaatatacttatcaaaaagatctggcagatgaccagaacaatcggatcaagcaattattcgaattgatcgataagacgaatgataccatcaacaaatcttataatgacaaggtagataaggcgaaggaagatgaaaatatcccgaaacctactacagaagagcggattgctacactgaagaaaaattttgaaaacgtgaatgcagaaaacgttgcgttttaccaaaaactgccgaacaatttttattcgacgatatttgaaatgactgaaacggaaattcacacggttagggatgaaagtttgaagctcattgacgaacagatgagtaaacaagttcgtgaaagcgaattggaagcttttaaacaagaagcagaagatcagattcaatatttgaatgtcacaacagagcagcaacaaatgattcgctacttagtggatcaaggcattgtagttaatgatgtattgaatgagaaaaagacagaagaattaaaacaatctgcacgagaagctgtacaaccagtgatgatcttccaaggagaaattattgttcgcgaaggaaatcaaattgatgcttcagcgatgaaaaaattggaattactaggattgacgaatcaaacgacttctattttcccactcattgccatggttttagctgttttgcttcaaatcggtgtactgatttataattcacttcaattccaaaatgcaggagaaagaacaaaatacgtacttttctacgtgacggcaatgtcagtaagcgtcgtactaatgaaatttttccaactcttccaaacagaacaagctgcttatattccgctgttttaccccgcggcttttgctccacttgttttaagctttttcttgaatcgaagagcagggatcatggctggtatttttcaagcagtatccgcacttttcattttttatgattcgattggcacgaactttctgacagttattttgatgtcctatgtattttctggtctcatggcaacgatcgtcagacgcaaacggatctcagaacaagggttatccgctgctatgtgggtcattatttttcctgtgatgatggatgtcattttgattatctaccaaggaatgagctttggggatgcaacgacttggttaacgctagtctgcggattcacaggtgcactgttttcattcttgctgacgataggtctgcacccctatattgaattgatggtcaatgatgatagtgtgatcgtattaaatgaactcagcaatcctaatcatcctttattgaaacagttgctggaagaagcaccaggcacgtatcaccatagcatgatggtagccaatctaagtgctaatgctgtagcagaaatcggtggacgttctttactaactcgagtagcttgctattatcatgatatcggcaagatcaaacacgccagctttttcgttgagaacttgccttcaggagcggaaaatccgcacaatttcttattgccagaagacagtaaacatattatctttggacatgtgacagatggtgccaaaatattggaagattataatatgccgcaaatggtgatcgatatttgcagacagcatcatggaaccacgctgatgcgttatttctacgttaaggcaaaggaacgcaacccggaagtcacggaagagcaattccgttatcctggaccaaaacctcaaagccgtgaagcaggaatcgtcaatatagctgacagttgtgaagcggcagtacgggcaatggaccatccaacgagcgaaaaaatcgaaagttttgtccataatcttattgaagagcgtatttccgatggacaattggacgacagtggattgacgttaaaagaaatccgtaaagtagaaaaatcattgatcagcggtttaagcagtaccttccattctcggatcaaatatcctaaaatgaaatcggaagttgagaagataaaagaagaacaagaagaatagcaagaagaatagaaagaagcgatgtataatggatattactttcatggatgaaacaaaccaagtctcagaagagaaaataaaagaaatcgacgacttgttgcaatttgcagcatcatatttagagttgccagaagaaacagaaatgtctgttactttcatggacaatgcagcgatccaagtaatcaatcgtgattaccgtggaaaagatgcaccgacagacgtcatcagttttgccttggaagaagagggcgaagacgaaatcccagtgatttttgaagatggagagaatccattgcctcgtgtactgggagacatcatgatctctactgaacgtgctgcagagcaagcagaagcttacggccattcgtatgatcgggaacttggctttttagcggttcatggattcttgcatatcaacgggtatgaccatatgacaccagaggatgagaaagaaatgtttggtttacagaaagagatcttagatgcctatggacttaaaagataaaaacgtagagaaaaacaaacatttcctgatgtccgtggaatttgccgtccaaggagtcaaaaccgtttttgaggaagaacgcaacatgaggaaacatgttgcgttcggaatcctcgctttgtttatgggcgtgattttccagcttgatcggatagaatggttatggctgcttttagctgtttttctcgtatggatagtagagatcatcaatactgtttttgaaaatgtcgtggacatgtttacggattttcattttcatccgattgggaaaaaaatcaaagatatggcagctggagcagttttagtgaccgcttgttttgccgtcatcgttgggttgattttatttgtccctaaaatatatcatttgttgtttaattaaaaaggagaacgtatatgccagaacataaatcagggtttgtcgcaatcgtcggccgcccgaatgtaggaaaatccacattattgaatcgaatcgtgggtcaaaaaattgccatcatgagtgataaggcgcagacaactagaaataaaatccaaggagtatatactacaccagaagctcagttgatttttattgacacaccaggaatccataaaccaaagcatcgtttaggagattttatggtagaagcagcttacagtgcgttgaaagaagtggacgcggtcttatttatgatcagcgctgatcaaaaacgcggtcggggagacgattttattattgaacgtctaaaaaacgtgcattctcctgtttatctgattatcaataaaatcgataaaatccatccagacgagttgttgggaatcatcgaagattattcaacgcagatgccgtttgcacaagtgattccaatttctgctacagaaggaaacaacgtcgaacgtttgatggatgtattagtcagtgaaatgccagagggcccacaatattttccagatgatcaagtgactgatcatcctgaatacttcatcgtttctgaattgatccgtgagaaagtcttgtttttaacacgagacgaagtgcctcattctgtcgcagtcgttgttgattcgatgaagcgaaacgagaatgataaaatccatatccaggctacgattattgtcgaaagagatagccaaaaagggatcattatcggcaaaggcggaaaaatgctgaagcaagtaggaacgaaagcgagaaaagatatcgaaaatcttttaggagacaaagtctttctagaactttgggtcaaagttcaaaaagactggcgagacaaaaaagtctatctgcaagacttcggctaccgaaaagacgaatattgatattctgagcttcttgtaagttaggtatagaaataaactggataaaaatccgcgtgttgagaaaagctgcggaagatcgtaacataagtgatctggatcggcagaatctgcttttccagatttattttttaggagggagaatatgagccagcttgcagaatcaaaaggcttgattttatctagccgtaattacaaagaaaaagataaattagtcaaaatctttacggaatcttctggcaaaatgatgttttatatcaaagggatccatcggcaaaatcagcccttagctccggctttgctcccttttactgaagcagtttatatcgggaattttcgaagtgaaggtttgtcatttttaagcagtgtcaaagatgtccacgcgtttcgacacatccaagaagacatctttttgagcggctatggcacatatttattgaatctagtagatgcggcaatcgaagatcatcagtatgacccgcatttgttccagtttacgcaacaagcactgcaacggatggatcaaggagatgatgcagaaatcatcacgaatatttttgaagtccaaacactgcaacgtttcgggatcgcgccgatctggacgcactgcgtcgtatgtggggaaacaaaaggaaagtttgactattcttccaaatatggtggtgtgatatgcgaaagacactggtcgatggacgatcaccgttatcatgcagatcctcgagctgtttatttcgttcggatgttttcagctatttcttatgataagatcagtggaatccatctgaaagaagaaaccaaacaagcaatccgtgaactcatcgaccagttgtatgatgaatatgtcggtatccatttgaaaagcaaaaagttcatcgatcaaatgaagtcttgggcacacgtgttaaagacgccagagaaagatcagtctaaaaaagaaaaagagacacctgaaaaagaagaatagtaaatgaaacatacaacaaaaaatcaaaaccatttgacaaacacagggagttccgtctattattaaccgtagatcaaatagatcgttcagtgagaggatctattatagaaacaagaaaactgcaaaatgaatacgtacattgaccaaaatcagtaaaaaatacgtggtttagcgagttcgggagagtgggagccggacccaaacgatttttgaagaggcacttgcgagtacgataaatgaagctgccgaatctttattcggaagtagggtggaaccgcgaattattcgtccctatgtctgtagtcagacatagggattttttgtcgttttctttcctgtattcttatttgacagcaacgctttaaaattgaaaggggcaaaacagatgagtaaaaaattgaccgtccaagatatgattttaacattacaaaaattttggtcatcaaacggctgcatgctgatgcaagcttatgacacagaaaaaggagcaggtacgatgagcccatatacctttttacgggcaatcggaccagaaccatggaatgctgcttacgtagaaccatctcgccgaccagctgatggacgttatggcgaaaacccaaaccgtttgtatcagcatcatcaattccaagtcgtgatgaaaccttcacctgagaatatccaagagctttatttagaaagcttgcgccttttaggaatcgatccattagaacacgacatccgttttgttgaagacaactgggagaacccatccatgggctgtgccggtgtgggttgggaagtatggcttgacggaatggaaatcacacaattcacgtacttccaacaagttggtggactgccttgtaaaccagtaacttctgagatcacttatggattagaacgtcttgcttcttatatccaagaagttgaaagtgtctatgatttagaatgggctgatggcgtgaaatatggcgagatcttcaaacaaccagaatatgaacattctaaatattcttttgaagtaagcgaccaagacttgctactaagcaactttgatcgttttgaaaaagaagctaaacgctgtatcgatgaaaatcttgttcatccagcgtatgattatatcttgaaatgcagccatacattcaatttattagatgctcgcggtgcagtatccgtaacagagcgtgccggttatctttctcgcatccgcaacatggctcgtgctgtatccaaaatctttgtggcagaacgcgaaaaattaggattccctttgttgaataaaaacacagcaaatccagaaaccgtgaaggaggctgaataagatggcaaaagacttattacttgaaatcgggatggaagaaatgcctgcccatgttgtcacaccaagcatgaaacaattagaagaaaaaacagcaaaatttttagatgaaaaccaattgacttatggtacgatcgaaacattttccacaccgcgccgtttagcaatcaaagtaacaaacattccagaacgtcaagcggacagtgaagaagaagtcaaaggaccagccaaaaaaattgctttggatgcagatggaaactggacgaaagctgcggaaggatttgtccgcggacaaggtctgacgacagatgctattacttttagagaattaaaaggtgtagaatatgtctatgtaacgaaatacactcatggtaaggaagcaaaagaagtattgacaggtttagcagatgtcattaaaagcctgactttccctgtaacgatgcattgggcagaatacgattttgaatatatccgccctattcactggatcgtggcattgttagatgacgaagtaatcccgtttgagatcttagatgtcaaaacaggcagagcctctcgaggtcatcgtttcttaggcgaagatgtgacatttgcgcatgcaaaagaatatgaagaaaaattgaatgaacaattcgttattgcttcaccgcaaaaaagacaagaaatgatcgttacacaagccaatgaattagccgaaaaaaatcattgggttattgatctagacgaagatttactagaagaagtcaacaatttagtcgaatatccaactgtcttttctggcgacttcgaagaaaaatatctttctgttcctgaagaagtactagtcacttctatgaaagaacatcaacgttatttcgaagtacggaacgatcaaggtatgctgcttcctcattttatttctgctcgtaatggcgatcgggtaaaattggaaaatgtggttcgaggcaatcaaaaagtattgacggctcgtttagaagatgcggaattcttttataatgaagacaagaaagcttcaatcgaccaatacgttgaaaaactaaaaactgttactttccatgaaaaaatcggtagtatctatgagaaaatgcagcgggtacaagtcattgcccatatcattggcgaacaagtaggactatctgaggaagaattgatggatctgcaacgagctgctgaaatctataaatttgatctagtaaccaacatggtaggggaatttcctgaactacaagggatcatgggcgaaaaatatgctctgctgaaaggcgagaaacctgctgtagcgacagcgattcgtgagcattacatgcctatatccagtgaaggagagctacctcagtctacagtaggttctgttttagcgattgcagataaattagatagcatcttttctttctttgctgttgggatgatcccaagcgggtcaaacgatccgtatgccttacgtcgccaagcatacggtgtcgttcggatcatcgaatcgaaaaaatgggcctttcctttgtctgttctgcaagaaacgattagtgatgttatcagtaaagatacggatcgtttcggcattggtttatcagaagggcaacaacaagtgattgactttatcaaaggtcgtctgcgccaattattgacaacgaagaacatccgtcatgatgtcatcgatgctgttttgaatgcggaacaaaaagatctgacaaaagtatttgcagcagcacaattgttcaaacaacatcttgcagatgaagacttcaaaccttcaatggaagctttgacacgtgtcgtaaacttagcgaaaaaagcgcagcttgaaaaacaatcagaagtagaccctgagctgttcgaaaacgacgcagagaaagaattacacaaagcagtagaagcaatgaaagcaagttttgctgaccaaacgatccacgaaaactacgaccagcttgtcgctcttcgtccactgatcgaaaattattttgatcaaacgatggtcatggctgatgaaccagcagtacgtaagaaccgactaacacaactaagtcaaatagctgccatggctttgtcattagcaagcttggatcaaatcatcacaaaatagtcttttgtttgaaaaacagagagcatgcacgaaacgtgttgtgtctctgttttttttgttataaatagctgttattaattctattttaataatttttgttattttattctttgttcgaattttcaaaacgctcatgaaaagtgaggaaataaaaatgaaaacgattaatcataatcttgttactgttttatttacttttaaattaggaatttccctagtcaagaaaactgtttgtggtattattatatagggaaaaaaggtaaaaagatggactagaaatagttcatctttttttgtttaaatcttttactaaattgaactaatagagttttctatgaatatcaaagttagttttcacctactttgtttttttatagttggttattataaaataacgatataattgattttgatacaatacacgtttatttataaatcaaaaatatagagaacagtatacaaatgtccgtttctattcttaaaatgattcttatacttacttaaattaggtataattagtatatgttttgtaagaaatttagacttataatcagtagtgaatgtataattaacgtataggagacatggataaaatgaaactaattggtatagatttagacggtactcttttgaattctgaccagagcattagtcaaaaaaatgcaagaacaatgcaacatttacctaaagactgttttccattcatttgttctggaagagaagtagaagacattaataatattctcaaaaaatctggtttaatggttccagcagtaggattaaatggttctgttggatttgatggagaaaaaaaaatatttgagtcttttttcgataaaaaggatgtaaaaaaaattgattctgtcatatcgaaatttccaactaaaatatatacgaatctcggaagttatgaatcgcagaactataaaaataaaatgaaaaaaatctttcacgaggtaggcagtgaattttctgtcaaggagttgaactatgagcttgagtatgaaaaatctatttgctctattccttataataatattgaggaaattatagaaaaggatgatatcagcatttacaaattttttatttttattcccaatcgtcaattgaaagcgaatatatttaaccgtttgaaaaagatgctaaatgtgactgttactgaatcagcacctgtaaacattgagatcgtgcctcaaaatgtatctaaaggcacggtgtttgatcgtttggaatcaatctacaatttaaaaaaacctttgagaatcgcgatcggggatagtttaaatgacttatctatgtttgagagtgcaaatattagttttgcaatggaaaatagtcatcaagagatcatgaaaaaagctgattatattaccgtttcaaacgataaagacggagtatctcaagcttttgaaagaattcttaccatataaactaatttagggagtatagaatataaatatttaggattgtgacaaaaatcatgtcacaatcttttttcgaataaactcattttttgaagccgactatttatcgtaatttctttacataatacgaacaaattttcggttattgatgaaaaaaaacattgaaaatggtatgataaaagaaaaagaggagggaatttttaatggtgaaatttatccatgcggcagatttacatatggatcggtcatttgaaggactgacaactctagataaaactgtacaggaaaaactattgaagacgaatctgaccgttttatcaaatatcattgaacaggcaataataaataacgttgattttgttttacttgcaggagataattttcatcaaaatcgtccttcattaaaaatacagaaacatttttcagaacagatgaaacggttagaaaaaaatcatatacctgtatttataatattcggaaatcatgatttctatcaaaaagagcggtattggttctcctttcctaaaaatgtccatttatttacatccgaaacggtagagacaaaaaaaataacgataaaaagtggagaaactgtctctctcagtggattcagttatcgacaaccatggattcaaaaagacaaagtgatggaatttccttctagagaactcacagattaccatattggtttgtatcatggggaacctggtacctcgcaaaaagggaactatgcccctttccaaccttcaaaaatgcaagaaaaaggatacgattattgggctttggggcatatccatgtgccaacagttttaaatgaaaagcaaaccatcgtttatccaggtgcgcctcaaggtcacactaaaaaagaacaaacttctacatccattctacttgttgaattaagtaaaggaagttgtcaaatacatccgattaaagtagcagaggtctattggaagacaaaggaaatatcattgaggcaagcgaggacgacaaaagaggtcattgttcatattcgtcagcaactttcaaaagtagaggatggatttagtttaattgagataaaattaaaagattatgaccatctcaatacagatgttctagagcgaatacaatcaggagagttattagattatctgttagaggaattttcagataggataagggatttatttatttggcgtatttctctcatggaggatactttttatacgaagattccacttgctgcttctgctaaattgatggaacagctatttcaatactatcagacacctcaagatttccaacaaattttaaatgaagtatatagccaccaagaagcggctaaaatattgagcgaactgccggaatatcaagaagaaacacttgaaaaagccaagcagctacttaatcaagattttttatttgaggaggatcaggaatgaagattttaaggatcgagattgctgcttttggaaaatggcgtcaaaaaagttttgatttttattcaggcaatcagctgatctatgggggaaatgaagcaggaaaatcaacgatttatcaatttatccaagccatcttatttggattcccttcaaaaggccgcaaaaaaaaggattatacaccaaaagacggctcagcctatggtggcaaaatatggcttaaacatcctatatacggtgagtttgctgtcgaacgctataaacagcaaaatcgtggaaaatcgaaggtatggctggggaatcaagttggaagtgatgaattactagaaaaactgattgcacctttgacgaaagagttattccagcaggtatttactttccagcaagaacagttgatggaactagatcacttgagagaaaaagagctacatgatgcactgatttctttaggaattacgggcagttctcaagtattccaaaaaagacaagaatattatcagaaagcacaacagttattcaagaaaaaaggccaaaaactgctgatcaatcaaaaattaaatgaatggaaagagcttcaagagaaaatccatctaaaacaagaacaggaagcttattttggcaagttgatccaacaagaacaggaatacgagtcgcaacagcaacagttactggaacaactaaatgaggcgaataagcaatttgcactagccagacagcaagaactcaatttttctttatatgaagaatggcaatccctcaaaaaaaacatcgctacaggtcttcctgatgaacaacttcttcttgatctggagtctttttccaaacggtatcagcaaacaaatgagcgtttagaagaattagaagcaactctggaaaagcatagcgggatggatcagcagtcagctagatattatttttatttagagcaggagcaagaactaaaagacctccaacaactccagtttacaacggaacaattaagcgaagaatggcaaagacttcaaatagagactagagaaacaaattcagaattgaaaatcttggaacaaagatggcagtggcagaaaaatccgttaccggaagaatttttatatgaagaagagtggaagaatcttctggctgaagaaagaaggattgctgatctagaaagccagatttctgtgcgtctccagatagctaaagaacagcaaaaaatgatcgaagcagaagtgaatgagttggaagagacttatccagcattattacaaaatcagtcagagatagcaccaaccccttcatctaaaccctatatgctaattgctagcggagcaataatcattgcaggtatatttgttccaatgcccttaaaagtgatccttttactaattggtgcaggcatgattggctatttcttctacaaacagcaaccaaaggtcaaaactaaaaatgatttctcagaaataaaaggaatgtggcaagaaaaactaggtcagcttgatttagctttagcccaattagcagaagcagaagaaaaacaaaagagaatagaagaagaaaaacagattcttcagcaagaagtatatcgttttgctgatcatcggcacttaggaaagatggatacactcaaactcatgaaagaatatgggcaagaagtcatagattatcagaaattgtatggcgtatttgtgcggaaacataaaagagagcaggaaatccaagaaaaactacaacagatcgatcagaaatttgagtttgttaaagaatggctacccatacaagataagacgatctcagaaaaaatggctatgctttcccgttttatccaagaaatggaacagatgaaatttgccagaagctatcagcaaaatactttattgaagcaagaaatcaatcaattgaaaaagaaacaaaaagtatgggtacaagaatacagcgaacaattgagccaagctggattatcttatccttcggaagtacctgtctttttacaaaaagccaaacaagccgaacagcagatgaaaagatacaatgaactgtcagaaatgcttcgtccactgtttcctgaagaactgacgaaagagaaattatctgtaagactgcggcaactgaaagaaaaacaaggccaactccagcaagaagaaaaagaagcaagtgaaaatcggcaacgactccaacttcaagtagaagagctgcaaagagacggcacattggacgaactctatcaacaagctagccgacaaaaagcaaaattgcaggaattgctggaggaatggggcgcatttgaaatcgccggaacattcttaggcgatctttcaacagagatgagtgaaagacaattaccacagttgttaaaagcagcgggtgattatttaggtattttaacaaaaggaaattatcagaagatattactgaaaaacgatacactgactttaacagacggatatacagactttccaatctatgagttgtctacaggtacgaaagatcagctgataatggcgatgaggtttgcttacctctcgttagaagccaatcgttcgatatgcccgatcatcatagatgatggctggcttcattatgatcatcagcgaaagtatcaattagctgaacttttagctaaatttggagaaaagtatcaaataatttgtttttcttctgataaagaaatggtaagctattaccatgagatgaaccaaaccgtaaaacaattagaaggagcaaataatgaaaaaaattcgtgatttagtaatcgatgagcagtttgagcaatttgtcctgatcaaaagtgcagatgtaagaatcgctaaaaacggaaaaaaatttattgcttttactttccaagatacttcaggtaccatcgatggcaagtactgggatgcttcggaagaagaaatcaataaatttacagccggcacagtcgtttttctaaacggtaaaagagaggtttatcaagggaacccgcaagtaaagattcttcacatgcgtttaacaaggatggatgagccaggggaacctagtttatacatggaaagagcccctttgaagaaagaagaaatggaagaagaaatcaatcaattattatttgaaatcacaaatgcgcattggaatcggatcgttcgctatctactcaataaataccaaaaacaattttttgagtttccggcagccaaaagaaaccatcatgcatttgccagtggattagcttatcatactttgacaatgcttcacttaggaaaatcaattgccgatgaatatcctgagttgaatcgaccattattatatgcgggtatcattttgcatgatttaggaaaggtgatcgaactttccggtcctatgtcgacagaatatacgcttgcagggaatttaatcggacatttggtattgattgacgaagaaataactaaagcctgtcttgcgctgaaaatcaacgaagctgacgaagatgttctcgtattacgtcatatggttttagcacatcacggcctattagaatatggttcacctgtacgtccaaggataatggaagcagaaatattacatcaaatcgacaatattgatgcttccatgcagatgatgttgacttcgattcgtcaaacagaaccaggaaaatacacagatcggatttttggtatggacaaccgaagtttctatgtaccaaaagatttatagcaaaatttatttttttcattcaaaacaaaaaagcgagacataagtcttcgctttttttgttttcttttattttgatgaatcagttgtttcttcagttgaagattcttttgttgaatcagttgattttgtgtcagagctctttgttgaagatgtggcttcacttgagtctttagcacctgatgaagttgttgtgaatgcactcaacacattttcaaaggcatcgtctttgatttttacatttgcatcttttaattcttcaccgattactttagtcgtgaatgcattgtcacttaattttgtttcagtagcgatttcttttaattgatctttgtatttatccatgtcgttgcctttattttggtttttcaccattttgacaacatagtattctgttgcataagaagtagtatttgttgcagtaataacgtcagagacttcgccgtctttcaatttgaaagctgcttcttttacttctgcaggaatggttgttgtcgttgagtcgaatttgactttaccgccatcttcttttgtctctgaatcagttgatttgtcttcggctaatttagagaaatcatccccatcgtccgctgattttttgacatcttttgcttcatcttcacttgataatttgatgatttgtgcttctacttctggatggaaagattcccaagcagttttcaaatcatcatctgtaatatctacatgagccttcaaaccagcttcaaaagctagattgttacggatatattctttgtaagaatctttcgtatacccagcagtttctaattgtgattcaaaagtatcacctaaagatttcgcttgtttgtcgtattctgcatccacttgtttatctgttactttatcgccgtatttgttattgaatactttatagatgatcatccgttgtactaatgattggttcgatgattcgagctttgcttcatcgtagaaatcagatacagtgatcgttccgcctttcatcgttgcgatatctttattggtatcgcctgaacaagccgctagagttaaaacagccaacgcactagtagctgccaaaataattgatttttttttcattaatgtttgcactcctgtaattagttattattttttatatattaactataccataccccatgccctttaaaagcgttctcgtgatagtttcaaacaaaattcaaaatttcatcacattcctaggaaatgtgcaattattcctctattagacagtcatatctgttgagaaaatgatcattattgtatgtgatcaggatactcaggcagatcagctgttagtttttctacttgttcattgatttgggcgatacgtggttcggcttggaatttaaaattttcgatatctttgttgatggcttcttggaaagcgggaatcacagattcagctgtttcttttgtctcgatcaatgcgcttttaaaatgatccaagctgttatttaaatcgtttgtcagagtggttgcttcttccagttcttcaatcagtttttttcttgtttcgttcccgctcctaggtgcaaatagcagaccaccgacagttccagcagcagctccgaatagcagtcctttgaaaaagtttttaatcatcgctatgcacctgctttacgattgtttcttgaatagcttttagttcttctggtccataactgtcttgatggttgccaaagtggatagaaaaatcgtcctctttgctatagcgaggaactaaatggatatgtgaatgaaaaacagattgataagctaattcacggttgttattcaagatattaagacctttcatttctggaaaagctttttctaatgcttgagcaatcttaggcacacgtgaaaaaacttctcctgcaagttcaggatcatattcaaaaatatctgctacatgacgtttaggaacaactaacgtgtgtcctttcgttgcttgagaaatgtctaaaaaagcatagactttgtcgtcttcataaattttatagcttgggatttcttgattgatgattttgcaaaaaatacagttttccataaaaaacatcctttccataaagaataaatacttcagcttaactttaccataagttaaagccattgtaaggaaaaaaacaaaataccgtcattttcttcgtggtataataaataaaaataaatggcggaggaaaaagaatgagtttaattatcgatcatgtcacaggagggtatggccatctccctgtgttaaaagatatcagtttcaacgtacagcctggagagatagtaggattgattgggctgaacggagcagggaaaagtacaaccatcaagcacattatcggtctgttggaagctacaaagggaacgatagaaatcaatcatctatctttaaagaaaaatacagaagaatatcgtaaacaaattgggtatattccagagacgccttctttatatgaagaattgactttgagggaacatatcgaagtcactgcaatggcctatgatatacctatggatacagcaatgaaaagagctgaaaagctgttagagactttccgtttgtctaatcgccttgactggtttccggctaatttttcaaaagggatgaagcagaaagtgatgatcttatgcgcctttttgatcgagccttctttatatatcattgacgaaccattcttaggattggacccactagctatcaatgcgctgcttgaattgatggtagagatgaaaaaagaaggagccggtattttgatgtctacgcatattttagctactgcagaaaaatactgtgaccgttttgtggtcttacataacggagagatacgagcagatggaacccttgagatgttgagaaaagaatttcatctgccggattcttctttggacgaaatctatatcgctttaacaaaggagcaggcacatgagtagtttttttcaaaaacgtttagcaaggcatcaaaagaaaatgatgaaatatatgcgctatgtgttgaacgatcattttgttttagtttgtcttttcttaattggtggcgtgggattgtactattctagctggttgaaaaccttgcatccgccttttgcacttgggggaatgataatctctgtattttggatgctctgtttatttgtaggcaagatggctacttttgcggaggcagcagatattgtttttttacttccgaaagaaaaggaaatgcagacctatttggaacgagcttttcgctattcttgcatttttccgatgatccttttgatattggcatgcggatttgctatgccattagtggtggttagtactcagcaagtcttttcgatgtttttcgtctatctgattatattatggagtttgaaattcagtcatctgcaaattaagcgagcagaattgtttcggctagatcaacaggtcattcgttattggaaaacaggttggttactttcttctatgctcattttgcttctttcattttattggctagtctgggcaggggtagcaggtgcattggtacaggcaagtctatattactggtttttgtggaagcaacaggaaaaaggattggattgggagaaaatggtgcatgtagaagaacaaaggttgcatcaaatctatcaatttattaatttattcaccgatgttcctgaaattacggcaaaggtaaaaagaagacgctacttggatcctatattgactcatattaagagagaatcaaaaaacacttatctttatttgtttgcaagaagattggcaagaggttctgattttagtggtctttacttccggttagtaattataggtggggtattgattttcggagtgatcgacttttattttagtctgataatcggttctttatttttatatttaatcggtttccaattgttgcctttagcgagccagttccgttacatggtgctcgttcagctttatccaatccatgagaatcagaagaagcaagcaatccagtatctgctcacatgggtattagttatcgcatcggttatctttggattgattgctgcagtcgtattggatggtcagcagcgatgggttccgctagcggcttatttgattgttacgggtctctttgttaaactatatgtaccaactcgtttgaagaagatgtcagactgaaaacaaagctgtgtaggataaaaatgaacatgaaaaatagagcgttgacagtaagaatgctgttcgttctattttttttgagaaaagtcggttttttgaatggcaaataaatgaaaaagaacgtatatgtgcttgacgtgtagtgatcaggcgactagaataataagtactgcaaaacaaagagtaagaggacgggagaatgcatgatggagtttcagttagaccaagagtggcggttacgtcccatcaaaggcgatacaggaaaaacatacataggcatgcgtgatgaagacaaagtctttattaaacgaaacacgactccgatgttggctgctctttcacgggaaggaattacaccaaaacttgtttggacaaaacgaacggggaatggcgataccttgacagcacaagaatggctagaaggccgcttgctaactcctaatgagattggtcaaagaaatgacgtgattgatgttttgtaccatttacatcattcaaattctcttaaaaccatgctgacccgtatcggcggacgtgttatgacgccggagaagatgttgcaaaaatatgaaaaagaattaccagaagaactccagaaaaatcaatttctgcaaatcgtccatcgatttcttcgtgagcagatcccgccgatagataaggaaaatctatcagtggtgcatggagatgtaaatcatcgaaattggttagtatgtaaaaattatttatatctcgtggattgggattcaatcatgtttgcagaccctgcggtagatattgcaacgattttagggaattatgtgcctctatccagttggaatcaatggctgatcagttatggcatacgtccaactgacgaaatgcttgaaaagtttcactggtatgcggccatgaatttgctccaagaaatcactagatactgcaaacgtgaagatcatcgacgaatgaacgaagaaattttacaattaaaacgaattttcagtggctgaggtttggcccaaactctgcggagatttggccagacctttttaattagagaaaggaatggagataaataatgcgtgtccgaaatcgtccgggagcagcggaaatgttagcggctcacccgaattttgtaattagtgatccaacattgtggaaggggaaatggaatgaattgtttggaaacgatcatccaatccacattgagattggaatggggaaaggccagttcatcactggaatggcaaaagcccatcctgaaatcaattatattggagtagaaatgcaagtaagtgttgtttctatagcattagacaagttgattgaacaaccgcttcctaacctgaagcttctgcatgtggatggatcagcattgacagaatatttcgctgacagcgaagtagatcagatttatctgaatttttctgatccatggccgaaaaaacgacatgaaaaacggcgcttgacatacaaaacttttcttgctgtagatgaacagatcctccgcccaaatggagaaatccacttcaaaacagataatcaaggattgtttgagtattcgctggcaagtttttctcaatatggcatgatcctcaaacaggtatggttggatttgcatcaaagtcaatttgaaggcaatattatgacggagtatgaagaaaaattttcttcgaaaggtcaacgtatttatcgagtagaagctcaatttcaagataagaccaaaaagaaaagtctgtgaatgaactttttactttcataaaaatataaatcaaatcccagaaaacacattacatctgtcatgtgcattttctgggacttttttgatttaagatatacctatttcctcggttttcaacaaggtggaatcaattggaatcgagagaatgaaaataatcctttgtcagtgatcttcaattcgggtatgacagataatgttaagaaagaaagtgtcaaaaaaggatcaaaggttttagctgcccctagttgatgtgtttcagctattaattcattcagctgttcattgacgaacgaaaaaggttcctgtgtcatgataccgcctatcggtagaggaagacaagccatttccttctgtttattgacaacagtcatcccgccacctttttgaatcaaaagattagcagcatacagcatatcctcatcatttgtccccacgacaactagattatgagagtcatgagcaatcgttgtcgctatcgccccttgtttcagctgaaatccttttacgatgcctaacccaatatttccggtttgatggtgacgctcgatcaccgcaatctttaattggtctttttcgattgaaggaatgaatcgttcgccttgtcggtccactttttctaccaaatcgttcgtgacgagactattcgggataatttcgatcacatgggcttgtgaagaagggagaagcagctctaacgaacgaggatgcaatggttgagcatttaggtttggtagacagcacatgtatggatttgaataatcagcaaataaatggtcttcgagttgaccagattggacgaccaatgttcccttatagaaaacttcatgaattggcagcttggtaagatcgtctgttaagaagaaatcagcttgatatccaggagcaatcgcacctagtgttttcaaatcaaaacattctgctgcattcaatgttgccatctggattgcctgtaatggatcaattcccattgaaatagcttgacggacgatatggtcaattgatccttctttaactaaatcattgatgagtttatcatcggtgacaaagaagcatcttcttgaattatcaggcgtgatcgccggtagtagcgatgccagatcttttgcaacggtcccttctcgaaccattaaatacataccaagatccaaacgttctttagcctcttttgcagttgtagcttcatgatccgtccgaataccagctgcgggataaacatttaattcttccatgccgataccagctgcatgtccgtcaatctttttcttatgctggtgcatcaattggatcttttctaggatatctgcttcattatttgctactgcttgatagttcatgacttcagctaagcctaaaacttcgggattttgtaaaaaaggtgctagatttttggcatttagatttgcaccatttgtctcaaatggagtgacaggtacacaagaagggagcataaagaaaatattcataagcgtttgtcttgcatcttctatcataaattgaagaccagtactcccagcgatgtttcctatttcgtggggatctgttactacagtagtaactccatgaagcaaggatacttttgaaaattcacttggtgataaaagtgaactttcaatatgcacatgtccatcaatgaatcctggtactagatattgccccttagcattatgtacgctttttccttcatattcaccaatccctacaatcattccttcgtaaatcgctacatctttttccatgatctctttcgtaaagacattgacgatcttagcctgtttgattactagatcagcgggcttttttttacttgctacttcgatgtatctctttaatgttgattccaatggaatgcctcccaagataaatttttataagtataacataaattcgttttttgccaatgttttttaataaattcattttatttgaaacaaaaagatcaaaaagacgtatgttttttgtggaggggagaataatggaaataaaacgattatcagatcaaatgataagtgaaagtttcgccaaacatgcccaagacgtatatgtcttgccagcttcagaagtattttacatctattttcgctatggcaaaaaacgaacgttctggaaggaagtatcttcggcagatggccagcaattgatttcaagatttaagtatttgggacaaatggatatcggagaaaaaagaaaagctcaattaggtgcattgacctattctttagaaaaacagaaggttcggttacgactgtcttctgtaggagattaccttcaacgagaaagcttagtgattcggctattatacggtatttctgaaacacctcatcgttgctttaattctcgagattttgcaactatttcgcagaaaaccgttagacgtggattatatctattcagtggaccagtcggatcaggcaagacgtcattaatgtatcggttggctttgaaagaaaaacggcaagtaatcacgatcgaagatcctgtagagatcgaagaaccattctttctgcaattgcagatcaatcccaaaatagcacagacttatgacacacttttgaagctcgcattacggcatcgccctgatttgttgattattggtgagataagagatgaatcaactgtacatgctgcggtaagagctgcactaacgggacatcgggtattcgcaaccgtacatgcacgcaatcttgaaggtacattgatcagaatccatgaactaacaaagaaaaaagaagagctatctgaatgtttagctggagtcatttatcaagaacttttggaagatgccgatcaccatccttctgtcttgtggagttatcaatttatggaggaagaaccagtaaaaaaatcatgggaggaaagctatgaagaagctcagaaaaaaacttggcagtcagaactattttaaaggattgacaagaagccagcaaaatcagtttgcacaaactatgggagagctgcttttaactggttttagtttgcaagaatccctttatttattactcacgatccgttcgttccagcctgctattttggcaaacatccaacatcagctaaaggaaggacaaccgtttagtgaagtactttcgcaaacagggtatggagcagaacaactggtacagatcgaattagctgaacttcacgggaatctgccggcaactttgttggaaattgccaaacagttacgtctggtcgaaggatttcgcaacgatttgaaaaagctgctcgcctatccgatgctattgctcacctttttgctaggtatcttatttagtatgcgtttgatcgttttgcctcagcttattggttcagggatggttatagaagagcattgggggattcagctgatacaagtctttcactggtacgttctactatttatcctagtggttactttattgactttgctagtaaggtatcggctgatgaaattgtctcctattgatcggagtgaatggataagtagacaattagtgattggaccaatatattccttatatcaatctgcttatttgtcgctagagattggcaaactttttcatgaaggtttcgaattaaggcaaatcatcgtttgcttgaaggagacgaaacaagaaagtctgattcaacaccttgcttccaagatgatacaaggattagaggcaggtataccattagctgatcagttccagaattaccattttctatctgaagaattcagcaagattattttgcagggagaggcaaaaggaaatttagggaaagagctgatattttacagcgaatggacaagaaaacagcttttcaaacgacttcagcactggctgcattttattcagccaattatttttttgggcgtagcggttttgattttactggtttatgctgctgttttattacctgtttatggaagtatcgaggaggtcttgccatgaaaaagaaaagaacaccttattatagcggttttacattaatcgaaatgctgatcgttttactgatcatcagtgtactagtattgttgtttgtcccaaatttgtcacgttataggaatcatgtagaccaagaaagtcgtgaagcaatcattcagttggtagacacacaaaaagagctctacgcgcttcaaaacaatggaagaatccctaccgtggaggaattattgaatgaaggctatatcaaacgagaacatgcagacatctaccagcggccttgaaggaaaaacattagcatcaggatatacgttggttgagtcactcttactgattttattgcttacaacaatcctttcttttccagttctcgcattttctgcatggaagaatgaattggcagtctatcaatttttcagccagtttgaaaaacgaatctataccactcaaaaaatcgctattgtgaaccaaatccaaacaggcttttattggaacattgacgaaaatcagatcatttttcgtatgtcgcaacccgatgaagcgagctggaaagtattagatattcctgatgagattaccttgaaacgccatgcttccatcacttttgctgctggaactggaaatgaaagttcactaaaagcatatcaattttattgggaagaaaaagggcaaacgattacgtatcaattccagatggggagtggacgttatacaaaaagaattgaatagaaaagggtttattttattagaatcccttacagcgctgatgattgcttccgtctgtgtgtacttagtgagttttggtcagctttttttacttcaggcagaaaacaacagcggggaggaaatgctacttattcgaatggtttacgaagataccaagacacaacggatatatcacaaaagaccagagcgaagcgaagaaatgactatgtacgatatccaaattgtcgaaaataatggagtaatcgaaaaagtgcttgtcaatatggagaaagaagcgatcaatattgaaaaaacaagaaatcccggcatttacgctgattgaatgtctaatcggactaatgatagtaagcagtatattgctgtcattcaatcttttgatccagcaaactatccaagtaagtgactttctgcagcgtaaagatcaaaaagagtggctgatatttttagcacaattagaagaggaacttaacagcagtcacaatgtttccgtgaaaaatcagcaattgtattacactgtagaggataaacagtacatcatcgaaagatatcagacgatgatacgtaaaagaagaacttccggcggacatcaacctatgttaacaagtatcactgagtttcaattattggaaaaagaacacacaatttctttttatgtacactttgaaaatggagaagatggatatgccatatggacaaaaaacgatcaatagaaaatgttgtaagggatctattttattttctgtgttgcttttatttcttttatgtacgtttttattgacggcagcattagaaagctatcgcttgtcaatagatctgaatatacgaataaaaaattattatatagcaaaaataatgaaacagatgtctctatcggaacagtctatacttgctgagaagtcggaagggattttttactacacaactggatctgtaacatatcaatgggtacaacagtctctattcttggaggtagaagtctcgccgtttatctttcgattcatagaagaagtaaaaaatgatacagatactggtacagaatgaggggttgttcgtgaaagcgccctcttttttgttataacactgtttttaataaaaaaatgtttgccgtttcacaaataaaaaacagtgaaaacgattgaaattttgtcaattgttcgatagaattaaacaggtgaaaaaattgttataatatatctagaaatgaggtgcaccatgttaccagaaaaaatggaacaagggttcaatcagaacctggaagctattcagcttttacagaatgcattgggaacttcctttttagaagcctatgtcgaaaatgcagaaaatctaatagatgattatcaagtacgtgtggtggatggagtgccgacaaaagagacaacacaacggatcacagctctttatgaagagttgaaaaaactttctttcgagccagaagaatggcgcagattgtctcaattgcttttattgaagggcaaccagacagaacatctgcaggcgaaccatcaactcactcctgatagtatcggttttttatttgtttttcttattgaacaactatacacaaataaaaaggaaccagttaagattctggatattgcggcaggaatgggcaacttgttattaacagttcttttaaacctatcgaatgcggggtatcaaacagaaggatttggtgtggatattgatgatacattgttggctgtggcagcttctacaagtgatttgacacaagcaaatgttcaatacttccatcaagacgggttgcaggatttattaatcgatcctgtcgattttgcaatcagcgatttgccgatcggttattatccgaatgacgaaaaagcaaaagaatttttaacaagtactgaagaaggccacagttatgcacatcatttattgctggagcaatcaatgaaatacgtgaagccggatggttttggtttgtttttgatgccaagcggttttttagaaacggatcaaagcgaagaaatcaaaaaatggtttaaagaagaaggctatcttcaaggaatgattcaattgccagatgagttgttccgcaacaaacaatcacaaaaaagtattttgatcttacagaaaaaaggaccacaagcaaaacaagtaaaagaagtgttgcttgtgaaacttgcttcactaaaagaaccagagaaggtgacggaatttttcaacgagtttaaaaactggaaatcatctgctctgtaatcattcaacgagaaggagagtcatatgtctaaaacaattgcaatcaatgctggaagttcaagtttgaagtggcaattatatcaaatgccagaagaaaccgtagttgcgaaaggaatcgtcgaacgtatcggtttacaagattctatttttacaatcaagtacggcgatagtcaaaaattcgaacaaatcatggatatcgaaaaccacgaagtagcagtaaaaatgctgttagatcagttgattgaactgcaaattttaagttcttatgatgaaatcaccggtgtagggcaccgtgttgttcacggaggagaaacttatggggattcagtagtgatcgatgagggagtaatggaccgcattgctgaattagcagaatttgctcctttgcataaccctgctaacctgatgggaatcaaagcctttaaaaagattttacctgacattttgagcgtagctgtatttgatacatcttttcactcaacaatgccaaagcaaaattatttatacagcttgccagtgtcttattacgaagatttcaaagtaagaaaatatggcttccacggcacaagccatcgttatgtatcggaacgtgcagcaaaattattgaataaaccgattgaagatttaaaaatcattacttgccacttaggaaacggagtatcaatcacagctgtaaatggtggtaaatccatggatacttctatgggattcacgccattagctggtgtaacaatgggtacgcgttcaggcgatatcgatccggctgttcttccatacttaatggaaaaattagagattgatattgatgaaatgatcaatgttttgaataagaaatctggtttgctaggcctaacaggattgtctagcgatatgcgtgatcttgaaaaaaactatgaaaaagaacacattcgtttagcttatgatatcttcgtggatcgcatccgaaaatatatcggcggatacgtgacaacgatgaatggtgtcgatgcaatcgtctttactgctggcatcggcgaaaatgacggacatgtacgcaacgaaatcattaaaggtatgtcttggtttggctgtgaaatcgatccagcgttgaatgaattgcatggtgaagaagtagatatctctacaaaagaatcaaaagtaagagtattagtgattccaacagatgaagaactaatgattgcccgtgacgtggagcgtttgcgcggctaaaaatacacgcgtgttctctttagaaaatggataattttatatccgttttctaagaggacatgcttttttattttttacacagaaggagctgaatataaagaagtgagtgaatccaagtattctatgaatcgtgagaggaaagacgctcaataagcgactttattttttgaagagcaaaaaaagctgtgtccagacaagtgatcttcaaaagttttacttttgagatcccctctgaaacacagcttttcatcaattagtcttttttaggaggcaattggttttctaaatcagttcgaacaacaagcacatcgcaagccgcgtttctaataacatattcagaaacagaaccaataaataaacgttctacagcattcaatcctgtagctcctaacataatcaagtctacttgattatcttctgggatttctttcgcaataatttgttttggtgagccatattctacaacagaggttacattattcaagccagctttcttcgcgttgctttcataatctgccaatgtttgctttgccatttcagtagcttgttctgccaacattccatcaaaagatgaaacggtttggaaagaacgtgtgtcaatgacatgtgctaatagaagttctccgttatttcggatagctacattgaccgcctttttaaaagctaattcagcttcatcagaaccatccacggcaaccatgatttttttgtattgttgtaacataagcattcactcctcaagtcaatcgtgttgtactcttttattgtagaacaatttgtggaaaaagagaattatttactgctttggttcagcaattttttttgcaaagcggatactgaaggtggcagaaacgagaatcacaatcaataaaaagatcaaagcgatgaagcgttgattgaaaaaagcggctaaaacacccataacgcctaaaacagcatacgcagctccataaaattgtaggaatccttgatttttgtcatttttcttgatcaatacaaaaaagatatcctgtttattaaataaataatagctaacgaataataatagtaaagtggcgataatcatcaaaatcctaatcatgaacaaatcctccaaaataagcaacaaatagaaaaagcaatttgccaagagcaaattgctttattctttaaaagatggtaatctccgttaatgccgttatttgtcctgtagtattgatcccgcgaattcaagcaggtgggtcccatggtcgtagcttcgaactaccaaatgataaggcatgttaccagcagtgacacaagacgggtcccaagatatcaataaaaatgttcggtcaacacacaaagaggacaattcgaacatcacagatttcccatctctatagtagcatatgaatttaaaaagagcaatgagagagctcgcagaaatagaaccgttttcttgtttaattttttaggggatgttttttccactcttttatgcggtaatactgttgacctagcgcttgttcatattttcctgtatcctttggctggtaatattgagcattttttaacctatctggtaaatattgctgattgacccaagcatgatcgaaatgatgaggatactgataacccacaccgcggttgagggatttcgcacctttataatggctatctctcaaatggtcgggaacatcaccagctttgccctctcgaatatcagcaagtgctgcatctaatgccatataggcagaattggattttggcgacaagcaaagatcaacgacgacatctgctagcgggatacgtgcctcaggtaaccctagtcgttcagcagctaatacagcgtttactgtacgcgcagcagcagcaggattgcctaaacctatatcttcataaccgataaccatcaggcgacgacaaatacttgccaaatcacctgcttcaactagacgggcgagataatgaagggcagcatccacatcacttccgcgaatcgatttttgaaacgctgaaataacgtcataatgagcatctccatttttgtcatgggtaagagcttttctttggacacattcttcgataatcgacagagtaagatgaatctttccttctttatctggaggagtcgatcgtgcagccagttccaacccattcaaagcactccgcaaatcgccattcgttgcacgagaaaggtgaagaagagcctcttcatctaactggattgcttgttgaccaagaccgcgttccttatcctttaaggcgtgtttcactgccaactggatgtcttgctctgttaatggcttgacttcaaaaatctgtgtgcggctgcggatcgctggattgatagtaatataaggattttcagtagtcgctccgatcaagatgattctgccactttctaaatgaggaagcagaaaatcctgttttgttttatctaatcggtgtacttcatccaataagaggatcacagtaccactcattttagcttcttccgctacaacctgcagctctttttttgaatctgtagccgcgttcagcatgcgaaatgcataattagtagaaccggcaatcgcacttgcgatactcgtttttccagtaccaggaggcccatataaaatcatggaagaaagcatacgagcatcgaccatgcggcgtatgatttttccttcaccgactagatgttgctgaccaacgacttcatcgatcgttcgaggtcgtatgcgataagccaatggctgttgcataggattttcctccttcttgtttttacgttccttaattataacatatttagtaatatagctagaaagaacagccttctgttgttttgttttcatagcttatccaactaatattgtgtatgataaagtaggtgagaaaaatgacggataaacaaaagatagatgaatttttttggaataaaacgacgccggaagtagcgcgggatttattggggatgtatttggagcatgacacacctgaaggaagattagctggatatattgtagacgcggaagcatacttaggtccagaagacgaggccgcccatagctatggtttaagaagaacaccacgtgtgcgggcaatgtatgaaaaaccaggtacaatctacctttacacgatgcatactcatcggattttgaacatcatcactcagccagaagggattcctcaaggagtaatgatacgtgcaattgaaccagctacaatgattgaacaaatgagtaaaaatcgtggtggaaaaactggtccagatatcagcaacggtcctggaaaattagtggaagcattagaaattcctcaagaactctacggacaatctatagcagatagttcattacgtttagtttttgagaaaaagaagataccaaaaaaaatcgatgctttgcctaggatcggtatcccgaacaaaggagaatggacagaaaagccgttgcgttttgttgtgtctggcaatccatatatctctttacaaagaaaaaaccaaatcgaggaagattggggttggaggaaagaaaatgaaaaagaaggatctattaacatacttagatgaaataatcgaaaaacaagtgacggactatgatgtggctttagattgggatacaaaaaatcatacgatcgaaatcgttgttcgtttgtttgcggaaaataaagcacaatttgagattgatgatgcagaagggatcgtttcgcaagaaccaattatcgaatttgaagatggcgtactcctttttaatcctcagaaatctgtttttgatgaacaaaattatctagcggtaatcccctatgaaggaaaaaaaggattggcaaaatcagtagctgattctttagtggaatatttgaatgaagtattagcacaagggcaaagtgatttgcttgattttttagatgaagatgatgacgaagctgtattcgaactccattgggataatcagaaactagcagagttagtaaaagcaaaacagcaaaatgaaatagagacttatttaccgtacccaagttattaaggagtgacagacatgaaatggaatgaagtaaaagtagaaaccgaaagtgaagcagtcgaagcggtcgctaatattttgatggaggcaggagcgagtggtgttgcgattgaagactctttagatgttgaacattttcaatcggatcaatatggtgaaattttagataaaaatgattttacatcgttgaaagaaggcgcgctagtcatggcttattttccagaaacgacttttttaccggaaatcttgccttttatcaaagatcgtatcacgcaattgcctgagtttggtctagcgattggaaaaaacaaagtaactgttagcgaagtagaggaaagcaattgggcaacagcatggaagaaatattatcatccggtgcgtattacacgaatgctgacggttgcgccaagctgggaaaactatcagacagaagatcctctagaaaaaatcatcacattagatccaggcatggcgtttggaacaggcacccatccgacgacttctttgtcattgacagcactagaaacagtattgcgtggtggcgaaacattgctagatgttggaactggttcgggtgtactaagtattgcagcaaaatatcttggtgcgaaagatgtctatgcctttgatttagacgaagtagctgttcgttcagcgaaagaaaatatggatatgaatgaagtagctaaagatgttcacgtatcagctaatgatcttttgaaaggaatcgagattgaaagtgatgtaatcgttgcgaacattttagcagatatcatcttattgatgatcccggatgcatggcgtttactaaaacaaacagggacattgatcgtttcaggaatcattgaagagaaaaagcaaatggttctagatgctatgatagaacaaggattcatcgtggatcaaattttccaacaaaaagactggtatgcaattattttgaaaaaaccagaggtggaatagatgcagcgatattttttgaaagaatcgtatgaaccaaaagaccattttattttaaaaggggaaacctatcatcacattgtacgggttatgagaatggaaccgaaagatgaagtttttttggcattcaatgatcagatagccgttgttgcagaaatcacaaaaatcaccgaagatgctgtttatctgaaagaaattaaaaaagaagaaaaccaaaaggaactgccaagttcgataaccatagctagcggctatcctaaaggagaaaaattggattgggttattcagaagtccactgaattaggcgcacaagcttttattggttttccggcatcagcctctgtggttaaatgggatgcaaagaaacgtatgaagcgacaacaacggcttgaaaagattgctcaagaagcagcggaacaatcccatcggcaaatcgtgccctcagtagagttactggaaacgaaacgtgacttatttgaacggttagatgattatgatgtagtcttggttgcttatgaggaatcagcaaaacaaggcgaaaaatcaaatgtagccaaaattcttagtgaaacaaaaccgggcagtcgaatcttagctgtctttggaccagaaggcggcttgtcccacgaggaaatcgattatttcgtagaacacaaagggatactatgtggattaggaccaagaatccttcgtacagaaacagcgcctctttatttattaagtgctgctagctatcaatgggagttaatggatccctctcatagctaacatttttcatcaataaaagagtatcgacggaaagaattgaaaaaatagggaacaatttgtataatagaaacaattatttgtacaatgaatacgaaaaattgtttgaaaaagctttttaaaagcgaacatttccgtaaaaaaatgtataacttcacggattttggggcaactatcaaacagatatttgtcccgattcctgttttaccgaaaaagaaagggggatcgattcctgtgccaaaagaagaaattttaacgggtcccggtgtcataaagctcgttagtcaatatatggggcccgaacatgtagcatttgttgagaaagcatgcgaatatgcgactgctgcacatgacggacagtttagaaaatcaggagaaccctacattatccatcctatccaagtcgcaggtatattagcagatttaaaaatggacccccacacagtggctactggcttcttgcatgatgttgttgaagatacagaagtcaccttagaagatctgagagaagaatttggcgctgatgtcgctatgttagtagacggagtaaccaaattagggaaaataaaatacaaatcccacgaagagcagctagcagaaaaccatcgaaagatgctgctggcaatggctcaagatttacgcgttatcatggtcaaattagctgatagactacataacatgcgtacgttgaaacatctgcgagaagataagcaaagaaggattgcccaagaaactttagaaatctatgcacctcttgcacatcgtttaggtatcagccgaatcaaatgggaattagaagatacagcacttcgttatcttaatccaaaacagtattaccgtatcgttcatttgatgcagacgaagcgagaagaacgtgaaaaatacgtgaatggtactgttgaggatattcgagtagcaacagaagagctagggatttttgcagagatctatggacggccaaaacatatttattcgatctatcgtaaaatgaaagaccagaaaaagcaattcaacgaaatctatgacttgctagccattcgagtaatcgtagattcaatcaaggattgttatgctgtattaggtgcgatccacacaaaatggaaaccaatgcctggcagattcaaggactatattgccatgccgaaagctaatatgtaccaatctttgcatactacagtgattggtccggcaggaaatccagtagaaatccaaatccgtacacaggaaatgcatgaaatcgctgaatttggggtggctgcgcactgggcgtataaagaaggaaaaaatgaaaaagtagaaccagatggtatgacgaaacaattaagctggttccatgagatacttgaactccaagatgaaagctatgatgcctctgaatttatggaaggtgtaaaaggagatatctttagtgataaagtctatgtcttcacgccaaaaggagacgttactgagctgccaaaaggatctggaccactggactttgcatacagtatccatacagatatcggtaataaaaccactggtgcaaaagtaaatggcaaaatggtgcaacttgattacaaattaaaaaacggggatatcatagaaatcatgacttctccaaattcatttggtccaagtcgtgactggttgaaattggtggcaactagcaaagcaagaaataagatcaagcgtttcttcaaagcacaagatcgggaagaaaatgtgatcaaaggtcacgagtctgtggtcaagtgtattacagatttagggtttacacctaaagatattttgacaaaaaacaaacttcaagaagcacttgatcgttttaactatcaatcagaagatgatctatatgcagctgtaggatatggggaagtcagtcctttgacaatggccaatcgtctgacagaaaaagaacggaaagaacaaaaaatcgagcagcaaaagcaagaagcagaagaaatcatgaatcagccgaaaaaagaacctgagaaaatgaaagtacgtcatgaaggtggcgttgtcattcaaggggtagaaaacttactgattcgtatcagccgatgctgtaatccgattcctggtgatgatatcgttggctacatcactaaaggcagagggatatccatccatcgtcgagattgtccgaatgttcagcctgataaaccaaatgtagcagaacgtttgattgaagtcgaatgggaagatacatcgaatacacgaaaagagtacgatgcagacttggaaatctacggctataaccgttcaggcttattgaatgatgtacttcaaacagtcaatgcgctgacgaaaaatctcaacagcgtcgaagctcggacgaataaagataaaatggcgacaatccatttgacggttggtatccagaatttgtcccacctaaaaagtatcgtggataaaatcaaagcagtacctgatgtctacagtgtacgccggatgaatggataggagggccagatatgagagcagtcattcaacgggtgagtcaagcggcagtgtcagttgatcagcaagagattggaaaaattggctgtggcctactcgttttattaggtatccatgaaacagatacgccaaaagatgtggaatatctagtaaaaaaaatcgcacaaatgcgtatttttgaagatgatcaaggaaaaatgaatattagtgtagaagacgtaggaggtcaaattttaagtgtctctcaattcacactatttgcggatacgaaaaaaggaaatcgaccaagttttgtggaagccgcacgaccagaaatagctattcctttatacgaatcgttcaatgaaggaatcagaagtcgcggcatcacagtcgctaccggacaattcggagcagatatgtcgatttctctcgtcaatgatggacctgtaacgattattattgattctaaaaacaaataaagtcagttggttttcatcaataagaaatataaatcaagtcgtttaagttagactgaaaaactctaacttaagcgacttttttctcgtctataaaaagcgcttcttttgtcagcagtcagaaaaaaagttaagcttaaattatacaagttatttttgggaggttgctgaagatgaaagaagtaccagtaatagatgtcaaaatcacggatctaaaaagattgtatcaaaagggatacaatatgttggaggagttacgtcatgaagcagacgctcccgttgtcaaagcaaagattttcaataaagaagctattgtgatctacggatcgtcagcggcaaaaatattttatgacccaagaaatttcaaacgaaaaggtgctatgccaaaattagtgttgaagacactttttggtcaaggtggagtacagactttggatggagctgcccatcatcatcggaaaaatatttttatggatctgatggcccccgaaagaatggaagattatcatcgtatcttagataagaacctgacgcaagcacttgaaacacagcatggtcaatttgaattatttgatttaagcaagatggttttctttacatcgatttgtgagtgggcaggtatcaatttatctttgctttctaaggatgaagtcaaaaaattagcagaatatcaaatctctatgatcagcggaacgtttacttctccgattgatcacataaaaggtgtcgaaaatcgcaaaaaatcagaaaaatgggcgcaaggcttgattgaagaagctcggcaaaatcctgtggctggaaaagaaaatgtggcattatatgcttttgccaatgccacagatctagacggacagcttttgcctctggaagtagcagctgttgaattattgaacatcatccgtccaacggttgctctaactgtgtgggcggcgttgatgggacacgcgcttttcagcagacctgatttgtaccaacaattgaaaaacgacttttctacgttgcaagatccgttcattcaagaaatgagacgctattatccgttctttccgatgttacctgcgatttctctgaaagaagtagaagtcgatggttatcgtataccagaagatagctgggtcattctagatttatatggaacagatcatgatgaacgaacggttgaagcaccagactcctttatgatcaaacgatatttaggaaaagcaaaagatatttcatataaagaagaatatgagatgattgcccaaggtggaggaaactttcgacaaatgcatcgctgcgcaggagaatggatcactctccacagcctacgtgtgttttctgatcagctagtaaacaagtttgaattctctgtacctgaacaagattggacgatcccattcaatcagtttccgacttatccaaatagccgagcgctactttataagaattagattagtataaacttatcgaaaaaaggaagatcagcactgtttgatcttccttttttcatactactataagtggataaggtcaattgctcaaaatccgtgaaatgcttcatcaatggtttgataatcctcactggataaatgcaaatctaaagcttggacattatcagagacttgctctggacgtttagctccgggtatgactacagacactcttggattcttcatataccaggctagaacaagttgcgcaggggtggcttggtatcttttagcaatggggcgaagtatgtcgacagcggctaaaatttctttgaaacgttctccttgaaaatccggattgctttttcgaggatctccttcgccgaattgtttttcctgaccacgttcatattttcctgtcagtaaaccggaagcaagaggaaaataggggacaaagctgattttgtttttttcaagataaggaaataattctttttcagcctcccgatggatcaaactgtatttatcttctactacatcgacatatccatctgcattcgcttctttcaattgttctaacgtgaagttcgatacaccaactgctcggatttttcctgcttctttcaattcatgcaatgcagcaactgcttcattttttggtgtgcttttatccggaaagtggatataaaaaatgtcgatgtaatcagtttgcagacgtttcagtgcgtcttccaccgattgtttgagaaattcgggtgaattgtcaaatgttcgtcctttatttggcacatgagcagcttttgtagcaatgacgatacgtgaacgatcatattctttttccttcaatacctcaccgatcagttcttcagaacggccgtttccataagcataggcggtatcgatcaaattgattccgctattcaaagctgtacgaaccacttgttttcctgtctcgtcttccaaaccgtcaaaaagattgtgtcccccaacggcatttgctcctagtccaagctgttctgcgtagacttgtgaatgtccgattcttatttctgccatagctgattcctcctttttttctagtctaaaacaaaagaacaaaaagctgaactaaaatgtttttgtgagggaaaatagtcagataactcttgactttgagattggtttttagtaggttataagtaatatcgaaatgtcaatgaaagagcgagtaagtttttgaaactttacaagagaggatcatcgaggctgaaaatgatccaaagtttcattagcccaaagacactctggagatggacgagtgaaaagccgtcccgcgtacgagcgttattcgtaagaggaaagagaaatctttcaaaattaggtggtaccgtgtatgaatttcattcacccttgttcaagatgaacaagggtgatttttttatttacatagctaagaaagggagagaaaactatgagtttccaaagaccaaaaggaacaaatgatattttgccaggcgaatcagaaaaatggcagtttgtcgaagaaacagcacgtttattgttcagagattatcagtataatgaaatgcgtacaccgatttttgaacattatgaagtgatatcccgcagtgtaggtgatacgacggatatcgtttcaaaagagatgtatgatttttatgacaaaggggaacgtcatgtgacgcttcgaccagaaggtacagcgccaatcgttcgttcttttgttgagcataaattgttcggtccagagtatgcaaaaccgttcaaaactttttatatgggaccaatgtttcgctacgaacgtccgcaaaaaggacggttacgtcaattccatcagatcggagtagaagcatttggatcagagaatcctgcaacagatgtggagagcatggtgatggcactcgatttcttcaaacagttgggaatcacgcaaatccgtctagtcatcaattcattgggtgataaagacacacgtcaagcctatcgtcaagcattaatcgactatcttttaccttttgaagcagagttgagtgaagactctaaacgccgtcttcacgaaaatccattgcgtgtgttggatagtaaggacaaacgagatcaaaaatttgtagcagatgcgccatctatcttagattatttaagcgaacctgctcaaaaacattttgataccgttgtttccatgctggatgcattggctgttccttatgaaatcgacagtaatatggttcgcggattagattactatacgcatacgatttttgaaatcatgagtgacgcaccgaaaatgggggcacaagcaacgatttgcgcaggcggacgttatgacaatctagtggaagaactgggtggtccttcaacacctggctttggatttgcaatgggtatcgagcgattactcttgactatggaagcagaggaagtagttatccctgcatttaatgagttggatgcttatgtggtcgcactcggagacgaaacaaatatcgaagcattgaaagtggtccaagcgattcgaaacttcggtttttcagctgatcgcgacttcatgaaccgtaaagcaaaagcacaatttaagacagcagataaagcgaatgccaagttagtattggtgatcggtgaagatgagcttgctagccaaacaatcaatgtcaaagcaatggcaagccgaaaagaaaaaagttttccattagaagaaatatatgagcattttgatgaagtctatgatgaaatgactttattcgagtaggaggaaaaaagaaatggcacaaagaacgatttattgcggattagtttccgaacaacaattagaacaaacagttacattaaaaggatgggtacaaaaaagacgagaccttgggggagtaatctttatcgatctacgggatcgtgaaggaatcgttcaagtcgtcttcaatcctgaaatcaacaaggaagcatgggaaatcgcagataaatgtcgcagtgaatacgtgatcgaagtaactggggtagtcagaagacgcggtgaaaatgcagtaaatcctaaaatggccactggtgaatttgaagtgattgcaagtgaaatcgtgattttgaatcaagcaaaaacaccgccatttcaaattgaagatgatcaagcaatcagtgacgaaatacgtttgaaatatcgttatttggatctgcgacgtcccaaaatgactaaaaacatcaaattgagaaatgcgacaacaaaagcgattcgtcattatttagacgataatgactttctagatattgaaacaccttacctaggaaaatctacaccagaaggcgcaagagactacttagttccttcacgtgtccatgctggacatttctatgcgttgccgcaatctcctcaactattcaaacaattgctgatgaatgctgggttcgaccgttattatcaaatcgttcgttgtttccgtgacgaagatttacgtggagatcgtcagcctgaatttacgcaagtagatattgaaacaacgttcctaacagcagaagaaatccaaacttacacagaaggattgattgcgaaggtaatgaaagaagttcgcggcattgaagtcacattgccatttccccgtatgacctatgatgaagcaatggctcgctacggcagcgacaaaccggatacacgttttgaaatggaattgatcgatctaagcgaaacagtcaaagaagtagaattcaaagtcttccaaatggctcttgaaaacggcggagtcgtgaaagcattgaatgcgaagggcgctgcagatcgctactcacgaaaagatatggatcagttaggacaatatgtagggcaattcggagctaagggacttgcatggctgaaagtggaagaagacggtctgaaaggcccgattgctaaattcatgggagaagcaacagaagcaatcatcaaagcaacagatgcagaaccaggtgacttgctgatgtttggcgcagataaaagtgaaatcgtcgctgctgcattaggggctatccgaacacgtttaggaaaagaattaggactgatcgatgaatcaaaattcaatttcttatgggtaactgattggcctcaatttgaattttcagaagaagaaggtcgatatgtctctgctcaccatccattcacgatgccaaaagcagaagatatcccattactggctgaagaccctgcaaaagtctatgcagaagcttatgatatcgtcttgaacggctatgaattaggtggaggttctatccggatccatactcgggaacttcaagaaaaagtgttgaaaactttaggcttcacaaaagaacaaatggaagaacaatttgggttcttgctaacagctttagattacggattccctccacatggcggcattgcattaggattggatcgttttgcaatgttattagcaggggaagacaatattcgtgaagtcattgcctttcctaaaaacggaaaagcagccgatgtgatgagtgatgcaccaagtatggtttcacctttacaattgttcgaattgaatattgatgtaaccaatatagaagaatagccgataaaaaggcaaaaaggatttgtcgaatctgcttcttttggcaaccttgatttaattgaaaaacactttataatgaagccataacatataaagcggggcttttccatgaaaaaaacattcgaaaattgggcttaccatgattacacgaccaaactttcggtatcaatcgtttatgcgttgattgcatctgtcgcattgaatttcttttatcaaccaggacatatttattcaagtggtattacgggcctggctcagattttgacgactttgtcaaaatcactgatagggttcgaggtgccggtatcaaccactttgtatttactgaatatacctttgttcgtcttggcgtggttcaaaatcgggaagaagtttacaattttcacttttatcacagtcactttgacctccctttgtatccatattttaccggaaacagtcttatctaccgatccaatcatttgtgcgttgtttggtggggctgtgatgggactagggattgggctagcgttgagaaatggcctatcatcgggtggtctagatatcgtgagtatcacgattcgtaaaaaaacaggaaagtcgattggttctatctcgatctacttcaatgcattgatcgtttttgttgctgggattctatttggctggcaatatatgttttacagtacgttgtctattttcgtcagtggaaaagtaactgatgtcgtttatactaaacaaaagaaaatgcaggtaatgatcgtaacgaaacatccagaaaaagtagtgaatgaaatccaaaactgtatgcgtagaggaatcacgattatcaatgaagcagaaggtgcttataaacatgataagcagacagtattgatgacaatcgttacacgttacgaactgcctctactcagagaagcgatgaaagcttctgatccgcaagcttttgtaagtattgcagaaaatgtccagatacttgggcgtttctacgaggatggcatttagatcgagtttgacaaaaattcatgaaatactactgtagacagacattcgtttgtctgcagtttttttctaccaaaggatggatcagcaaatagaaactacttttttatttgaaattttcttaaagttgaaaaaaagcatgtttattttttaaaatttatgggatgatagaaaaaaatagtagagaaaggacacgattctacttgctattttcacttaatacccgtatattacgaatgaaaaaagtttatgaaaagttggaatattgaatggaaaaacaaaaaaggttaaaaaacagccgctacatcactgggtttgatgggctccgttcattagctgtggttggtgttatcttctatcaccttctgccaactagtatgaaaggcggctatttgggcgttccgatttttttcgtcgtatctggttatctgatcacggatctgctaaggcaggaatgggaacaaaatggaaaaatcaatatttggcaattttatgtcagaagaatgaagagactctatccggcactcgtttttatgcttgttacagcttcggcttatatcaccttgttccagcgaggattgttgaataatcttagaggagttgtcgtcagcagcttactgtatgtcaacaattggtggcaaatcaataacggtttatcttatttcgaccgatttgctaatgaatcaccgtttacacatatctggtctttagcggtagaaggtcaaaactatttggtttggccaatcttgtttgtattgttgatggtatttgttcgtaaaagaaaatggatcttttataccgtgttaggtacatctttcctctctgcgatcttgatgatgattttgtatacaccagggggcgatccaacccgtgtttattatggaacggacacccggctgttttctatatggttgggaagtgcgctcgcttttgtttggccaagtactcgtttgaagaaaaacatcccgaaacaagcaaaaagtatcctgaatatcgctggaggaatctcactgctggcactgattctttgcttcttctttttagatgatcattacaatttcatctattatggagggatgctcctagtgagtctcttatgcgtagtactagttgcagtgacagcacatcctggagcaagcttgaatcgttggctgacaaatccagtatttacttggattggcaaacgaagctacgggatttatctgtatcagtttccagttatgattttttatgaagcaaaagtgactgatattgctgatcatgttctgttccatactttagtagaaatcacattgattttaatcatcagtgaactttcttatcgatatgtggaacgtccgctagcacgttttgactatggtcgtacattccaagtgatgaaaggatggttcagtaaaccaatcatcagtaagagcaaaccatgggttgttccaggcacattacttgtagcaattgcattcgttggtttcgttacggcaccgaaaaatgctgtaacggccgatcaaaaacaattgcaggcaaagatcgctgaaagtaaaaaattagcagaagaaaccagaaacaattcagaaaataccactagttccgttgaccaagcgattcttgataagtacgagttgtctaaggctcaagaaaacaaggcacaaaaattagagttaacggcatttggtgattcagttatgctagatgctgcaactgatctacaagagctttatccaaaagtagtggtagatggcgatgtggggcgacaattatacgccagtgtaccgtatattgaaaaattaaaggaacaagatttattgaaagacactgttctaattggactaggaacgaatggctcattctctgaagctcagtttgatagcgtgatggatgcaatcggtgatcgaaaagtatactgggtcaatgtccgagtaccgacgaaacgttggcaaaatgacgtgaatgcgatgcttgaacagatgacaaaaaaatacgacaatatgacgctgattgattggtatagctacagtaatgaccatagtgactggttttatgatgatcaagtccatccaaatcctgaagggatgacacattacattcacctagtcagcgaagccttgctaggaggaagttcaagtacgaacagtaacgagacaaacgtatcagaataatagctacaaaaaacttcaggcaaaaacaattgtttttgcctgaagtttttttatatttatcgtgtttttaacagtcatctattttcaggaagcaaaacagttgagtgtgtcttcaaataatgttctttttgttttcgggtgagttttttgaatgcagcttctgcttttgttgcttcgcttcttgaagaaaatacttctgcatggatcatcttaacaggtcttcttttttgaagacgtgtatatttagcgccagtaccattgttatgttcccctagtctcctagaaaggtctgttgtgtacccaccataaaatgtctgatctttacagaataatacgtaaaaataatgtttatttgccatagagcatctcacgaatctctgctgtgtattccccgtctgcatcgtaagtgatcaatggcggagcgactttgaatccatctaatttaccttctttgattccttcaactaacaaaatatttgcctcttttccagcttttgggtaaacaaattggatccgtttaggtgcaatccgatgattttgcataatttggatgatctctaagaatcgttcaggtcgatggaccatagcgaaacgcccatttgtttttagtaacttacttgaattgtcgatcacttcttctaatgttgtatggatttcatgacgggcgattgctaggtgtttattagggttcgttttatttgttggcagccctttgaaataaggtggattgcagacgactaagtcacaagaattatgccgaatgacggataagctgtctttcagatcgatggtgtggactgtcatctgttcatctagatggttcagcgcgatgctacgtcttgccatgtctgctaggcgaggctgaagttcgatagcatcaatagctgcttgagttcgtttgcttaaaaacaggccaactgcaccattacctgcgcaaaggtcaacaatctgtccttttttaggcacacgagagaagtgagcaagtagcacagcatctaaagaaaaagaaaatacttgggaactttggataattttgatatcttctgcgtataattggtcgattcgttcgtcttcgtgaagcatggattccctccaaaatgaaaaaaatagtcgtttgtattatactatttttattaaaaagaaccaaggtggcttgtcaaacctctgttttttatgcatactatgaccataagaagggaaaggaagagactatgttttatcgatttatgcgaggggtagttcgagtactattagctttagtcaatgggaatgcccgttatgagaataaagaagtattaccgcaagatgagaattacatactagttgccccccatcgtacttggtgggacccattatatctagcggtagctgcagcaccgaaggaattcagctttatggcaaaagaagaactgttcaaaaatccggttctgcgatttatattaactcgatctaatgcttttccagttaaaagagagaatccaggaccaagcgtcattaaaacacctgtaaagattttaaaatcgacaaatttaagtttaatcatgttccccagtgggacaaggcatgctacagaacttaaaggcgggatggcgttgatttccagaatgtctaaagcgaaaatcgtaccagccgtataccaaggtccactgacacttggggatttgttcaaacgtaagagagtaacagtgcgtttcggtgaaccaatcgacctatcagatatcaagaaaacggataaagaaggaatggcggagattgaacgacgaacacaagcggcttttgacaaattggacaaagaagtgaacccagattttaaatatgaaatcaaaaaaaaataaagtgataagtttaggagtgggcggtctttttgaatctcctgttctgttcagacttttcgatgaaaaacgagggagagacgtcaagtctgccctctttttgctttctaacgtgcaaaatagaagacaggtgtcatgtaatggatcaaagtgttataatgattagaaggacattttttgaggtgattggatgcgttttttacatacagccgattggcatatcggaaaaaaactacaaggttatgacttgattgaagaccaacgtcatgtattatcttctatactggatatcgcgaaagaagaaaaagtagaggcaatcgtgattgcaggagacttatatgataggagtgtgcccgctgtcgatgccgtagcattatacaatgaattgatggttgattggaatttaaaggaagggatcccaatttttgctatatcaggaaatcacgatagcagtacgcgactttcagctggtacgccatggttcagttattcgaactattttttgcgaacgcagctagcagaagctttcgaaccagtcgagtttaacaacatacaatttttctttcttccttactttgaaccaattgcagccagattatattttgaagatgacagtatccgcacgatccagcaagcggtagcaaaagtgatagataaaatggaggagctgttcgattcagggaaaaaacacgtattgattagccatttttttgtaatgggaagtgtaaaatctgattcggaaacgaaaatcgaagtagggggtctggattcgatcccaggagaactacttacaccgtttgattatgtagcattaggacatttgcataatcaagcagctttaagacaggataatgctcgctacagtggctcgccgttgaaattttctctatctgagatcaaccagaaaaaaggcgtatggatcgttgacctggcaacagacctagagttgaattttagggagatcgaaccactgcatgatattgaagaaataacagcaagttttaaagaattattggatcctgccttctatcagtccgtcaatcgggagaattatatccagatctatctcacggacagaacgatcatcccgaatatgatgaaccagcttcggcaaatatatcctcgtattttggggattgaacgggcaaacggccgagcagaacaaacaaagcacaaacgaaaagtactagaaatgaaagatcctcaaaaattagcagaagcattttttagtgaaatgacggaagaacagctaacggcaaaccaagaaaaatggctcggagaaacgttgcaagaaatcatggaaatggaatgatcaagaatgaaaccgaaaaaattaaaacttaaaaattttggtccttttatcaatgagaccgttgatttttcacgattgacagaagcaccgctttttttgatcagcgggaagacaggagcaggaaaaacgacgatttttgatgggatcactttcgcactttttggtgaaacttccggaagacttcgttctggaaaagagatgcgttccttgtttgctacaccagaagaagaaacaagcgtgactttttcttttgaacatcagcagatgagctatgaaatcgaacgaaaaccagagcaagttttagcgaaacgaaaaggaaacggaacaaaaaaacaggcagctaaagtaacgttgaccatttttgatgggaaaggaaaagaaataaaacaaatcacaaaacgtacagaagcagaccagttgatcagagaactgatgaatctcgatgcgaaacagttttcccaaatcgttttactgccccaaggagaattccgtaattttttggtttcatcaagcagtgagaaagagactgttttacgtcatttgttcggtactcagcttttccaacagttcaatgagcgattaaaggaaaaagcaaagcaacagcaacaaaaactagatcatttagagcaaaatcttcatcttctgcaaaaaagatttgttttagtcaaagaagaggaagcagtagcagggtttgaagccgttctttcccaatggacaaaccatcaggccatactagaaaaacaaatcactaaagaaaaagaagttttagtagactatcaggagaaacagaaacaattagaaaattcctactatcgttttgaaaccttgaaaaaaagctatgaagaaaaagcgacattactaaataagcaaaagaaattagccgctcaaaaagacgaaatagaggaaaagaaacgatggattgggtattatgaatttacacaacgcttaattgaaccaatccagcacctgaaagaaataaaagctgaaaaaatagaactgtcacaaaaaagcaatgaacaaacaaagaaactagcgatgactacgcaacattatgaagagtggcaaaaaaatgaaacagaccgcatacatcggcaaacaaaaatcaaagaagctgctcaacaattgcaaaacaaacagatgatggtaccgattgtcgaagccttgcgtagtaaaaaacaagaagcagaacaattaaaacattcattagataaagaagaaacgaacgccgaaaagctacatcaaaaacaggctatttatcaggaaagaactcgatttcttcaagaaatcttattagatcaggaaaaactgcaggaagatcgtcttgcttttggacagttaaaatatctagatgaaaaacagcaggaaataaaacaacaaaaaacaaaaagcatcgaatcactcgaacagataagagaagagctcaaaaaagcagccgaagaaacaacaaaaaataatcagcgattgaaacaacagatagaacaagcagaacagctgaaaagccaatgggcaaagcagcaaattgctcgtcttcagcttttcttgcgtccgggggaaccatgtctggtttgtgggtcgacagaacatcccgtacaacaatcaaaacatgaacagccaaataaagaagatatcttgaaagtagagcaacaactggcagaagctgagtcagctgtagaaagaacccagcaaatcattgccaaaaatgaagcacatgaaaataatcttcaacagcaattatctgatttagaacaaaaaatcatggaaacgaatatacaactagctggacaagaaaaacacttacaacaggctttacaacaggcatttcctgcgataacagaacaaacaacaactgctcttacagtagtcgaacaatctttagataaacgaaaaagcaagatagccaatgcaagagcagaactagaagaaataagccaacaagtagaaaagattgagcagcaattagctgtctacaagcagcaacagacagcaaaaaataatcagcttcaacaactgcaaggcgaaatcaaaagtttagaaaaacaattacaagatacggatagcaactgtttagaagaagagatacgacaaattgaaaaacagttagaagaagactcgaaccaactcgctgctgaacagaaagcaggaatgcaattgttgcaagatctgcatatgcttcggacacaacttgatcttcaacaggaacaaatagaaaaaacagatgaaaaaatagaaaaagaacagcaaagaatagctgaaaagctggaaacccaatcgtatttttcaacaactgaggaagtctgtgcattcgcacaacagcaagcacaatacgaagagaaccagcgcataatcactacttatcatgaagcacaattagtgacagctgaccgactacgtcaattagaaaatatccagctgacggagatagttccagatacagaagagatcagccagcaattggaagagataagagagatgatcgaaacaaagcaagaaaagatatacagtttacaagaacaaaaaatcaataaccagaaaatctacgatgaatgtctttcgatttatcacgcaagccagacgcaattagatgaacttacgcaattacagcaactttcgcaaacattcaacggagaaaatcctaagaaaactagtttagaacggtatgtgcttcaagtttatctacaagaagtgttacaagtagcaaatgatcatctccaacgtttaacgaaaaatcgttatcagtttgaactagcggatacgatcggcagttatcgagggaaaaccggattagaaatcaatatctatgatgatcaggcaggcatgtctcgaagcgcgcatacgctgtctggcggtgaaagttttattgcagcactttctttagcattagcccttgcggatgtgatccagacacaagctggtggggtagcaatcgatgcattgtttattgatgaaggttttgggtcattagatgaagaagctttggaaatggcgatggaagctttagaaacgattgaaagtgaaggaagaatgattggaatcattagccatgtaagagaattgaaagaacgagtattacagcaaataagaattgatacagaaggtagcggacaaagcaaaatacgctatcaacttggataaaaagggagattggtaactatgaaatggagtattccggaaaaagtcattgcacgtgggcgtcaatacttgcaagaaggccgagtgttatcggttgtccctgaccaagaagaaaacgtgtggcatgcagaagtcttgggcagtgaattgtacatggttgatttggatgggacagcaaaagagatagattactgccaatgtccatattgggaggaacataaatattgtaagcatacagttgctgtggaactttacttacggtcgaaaaatctatctcgtatcatgaaaaaagaccagccgatgttagaaccggtaaaaacaacaagtgaaggagaaatcattgcaaaaggtttttctcgtctaaaaacacaaaaaaatcctcaagcggtgcaacccttgattattgaataccaagtagaaacgattgagacaaatcagtatcatccagagctttctattttggcgctttacttacgtatcggttctttggcatcgccgaaaaagacatatatcgtaaaaaacatctatgattttttacaggcttacacagaaaaagaaacctacacagtcaataagcagtatcagtttcgtctagataaacgggcttttcaaaaagaagatcaaaaaatactcgctcaccttgcaggaagtgcccaaacgcatcaattattaggcacgaatggcttgcaagtcaaagggaaactagataaaagatacctgcttctcccagtagaacaagcccgcttcctgctagaacagatgaatcagacgacacgtttgcatctgcaaataaatggacaaaacgatcaaggaatccaattttccgatcaaaacaagcctttatcattcaaagtggaaaaacaggaagaagactatttattgcaagcattgaatgattttgattttttctttatgcattatcagtggggacttatccagggagtattctattctctaacgaaacatcaacaaacagtttatcaaacttggaaacaattgattcgccgattggagaaaccagaagtaatattcaagaaaaaagaactaccggccttgtttaaagaaatcattcctcttctttcggagattggagacgtagtggttgcctctgaagtagaaaaggaagtagcggatattccagtcgaatttattttctttttccgaaaagccaaaggaaaaatccaagctcgagtcgatttcgtttatggcgaagtcatctattcgaccgatccaaaacatgaggtctcggccaatcaggactttcaggtgctgcgtgacagagctgaagagaaacgagtccttgatttattcaggatgtatcgctaccagaaaaatgaaactggctatgagcgtccgttgccaagcggggaggaactgtatgcctttttccgtacagaactatctgttttccgtcagtttggtgaagtcagacttggcagaaagttgcgggagttgtatttagatgcgcataaacatcaaccgcaaatcgaagtaaccgagactggttcatggcttgatattcgattcgacgtatcggggatagaagagcaagagattgatcatgtactgcaaagcttgttgcgaaacgatgctttttatacattggaaaacggacaggttctttcttttgattcagaggaattccaacaaacaagccaagtattgcaacaattacgggagtcaatacgttcagaagaagggacgatccatgtacctaagaatcaaggactgatcattcaaaatcaattggaaaaaagcaatgctacttttagcgaatcgtttcaaacgatggtccaaaatctcattcatccagaagggtatcaggcacaacttcccaaaggattgaatgcaaagatgagagagtatcagaagcaagggttccgatggttgaagatgttgggccattatcagtttggcggtatcttagccgatgaaatgggacttgggaaaacactgcagacgattgcctttttactttcggaaaaagaagaacgggaaagcttttctgctttgatcgtagcgccggccagcttaatctacaactggcaggcagaggtaaaaaaattcgctccttctttgagtatccaagtaatcaatgggaataaaaaagaacgggaagaattgctggctaaagacacagatattcgagtgacctcttatgccagtttgagacaagatttagctgattaccaatcacaaaaaattgattatttgatccttgatgaggcgcaaatggtcaaaaatagtagtacgaaaactgctcaagcattgagagaattagctgtgcctcagcgatttgcattaagtgggacaccaatcgagaataatttagaagaattgtggtcgttgtttgcaacaatcatgccaggatttttcccaaccaaaacaaaattcagagaacttgccgcagaagaaattgcgcaaatgatccgaccgttcattttacggcgagataagcaaactgtgttgaaagacttaccagaaaaaacagaaatgaatctatattctgcactgacagaagaacaaaagaccgtttatttagcttacttgcgtcaaatgcgtgaagaaatctcgtcaatggattctgaagcattcaagaaaaaccggatcgggatactagcaggtctgacaaggttgcgtcaaatttgttgcgatcctcgtctgtttattgaagattaccaaggcggttctggcaaactcgaacaagtaaaagatctattagtcgctgccaaagagaacaaacgcagagttctgctgttttctcaatttacaggtatgcttactatcttacaagaagagttagccgagctggggatctcaacattttatttaagaggcagtacaaaaccgcaagatcgattaagtatggtagatgcatttaatgcaggcgaaaaagatgttttcctgatttctttaaaagccgggggaacgggactgaatttgacaggagcagatacggtcatcttgtatgacctttggtggaaccctgcaattgaagaacaagctgctggtcgtgcgcatcgaatcggtcagaaaaatgtggtagaagtgtggcgtatgatttctgaaggaacgattgaagaacgaatggattcgctccaacaagaaaaacgcgaactgttccaaaaagtgatccaaggaaatgaagaacagctgacaaaactgactgaagaagatatccgcatgatcttaagtgtaggagagattgagaagtaagagattcgaaacaatcgttcagtaatggataagaagatctttcgaaaaaagcaggtgtttagttgatttaagaaatagcaaggaagttgggtttccgttttaacccgatttccttgctattattttttgtttttatttataggagttaagcaaagattgtcttcattgtttctaacagctgatcaaaagaagaaatttcgatatcgcaaataggagtctggtcgattttgcgttctcgatggttgaaccaaagtgcttgccagtcggcactttttgcacctagaacatcattgtcataattgtcgccaacatatagagtttctcctggaagcatatgaaattctttctcagcaagttgaaaaatctctttttctggtttttggaaccctgttgcttgagaaaccagcatgttgtgggaaggaatccaattgttcaattgaagttgttttaatttttttgtctgatggtcagtcggtccatttgtgataattcctaatgggacatttttttccttcaagaagtcaagtgtttttttgacctcctcatgcaaacagatattatcaagttcttcctcgtaaattttttgaaataggagacctttttcttctgtgatgtgagggtagtctaaatcttttagtgattggctgattcgatgtgctcgcatatattctagcgtccactctcctgccattacttttggaaagttttcatcactatgatgacggaagcggatatatagtggatgcatatcttcatctgaaacaagcggcacgactctttttaccgcgtttcgaaatggctgctgctgatcatacattgtatcatcaacatcaaacacaactgatttaatcaaaattttacacgcctttcggttttcattgattttttcacaaatccttgactattgtaacagaaaaaattatctaaaaaagctgataaataaaggtttttcttactatatttctgtttccttgacagaataaggtttttagatttcagtttttttcactaaaaatcatgaaacacgtcaataggtttgatgaacaaattaatcattattgtgtaactcggtgggtttattttaatgcaatctctgaggaattttcgaaaggtttatttttttaatacagtctcaatataactattcaaacataaaataacgttatttagtttatttgtttatagtaaattttatctagtaatcattgctttaaaatattgtgcttatataacagagaaaataagcgttataataaagaacaatattatctaaaatgacaagaaacattactatcaaagaaataaaaaacataaaaaatcttaagaaatcggtttcatttgtgcttctagataaaataatagtacagttttattggctgtttcatcgtcttgtaaaatttgaattagatttgaaaactctaatttttaaatgatagaaaaagcaagaacgctggttttactgtatattaaccttagataactttcatttttttaaaaaaattatgaaaaaaaggtagctatttaaaagttgattatgtataatagaaacagatgggagattattatgatcttctgttacaaaaaagtgattcttatcacgaaaaggagtggtgcacgttgttaacattatatacttccccaagttgtacttcctgcagaaaggctcgtgcgtggttgcaagaacatcagattccatttgttgaacgtaatattttttcagaaccattgaacagttctgaattaaaagcgattttacaaatgacagaagacggaacagaagaaatcatctcgacacgttccaaagtattccaaaaactgaacatggatttagatgatctgccgttacaagaactattggaacttgtgcaaaacaatcctggattgcttcgccgtccaatcatgattgatgataaacgtctacaagttggttttaatgaagatgagattcgtcgattcctgccgcgcgatgtacgacaattagaattgcgtcaagcacaattgatggctggattatagaagataaaatgaaacttggaaaaactattacgatgatagtttttccaagtttttttgtttttataaatagcgttctttattgtgggcacaaaaaagggtgtgagagtggtcatggtatgaaaaacagaagtgattgattagctaaaaagtcggctatatagtattcatctcccaaaaatgttatagttaaataagatagcttgaacgattgaaaaaatctgctggttttattaaattcacttaacagcgggattttttttctttacatttaagctgatttcgctacaatgaatctatattgaacattgcggcaaagtgaggtgtagcaaaatggaaatggaacacattaatgaaaatacgatccgtgtactgataggtcatgaagatttagaagaacggggcgtttcatttttggatttacttggcaatcacaaagaaatcgaaaatttcttttatagtattctggaagaagttgatatcgaagaggagttccgaggaagcgaagctgtcactttccaagttttgccaaaaggagacggattagaactgtttatcagtaaaaacctgccagatgaagaaatttctcaatcagaagattctgctgttgattcagaagacgtgagcgaatttctccgtcagcaaattattggtagcgatccggaagaagaattatctggaagcgccctagaagaacaggaaagacaagcaatttttgcttttgaagattttgagcaagtgatccagctggcaacagacgttgaactagagtctgcttggactgatttgtacttatttgaagagcgttattacctagtcgttcatttctggatggagaatctcaaccaagcggatgtagagaatcagattgctcgaattttggagtttgcagaaaagagcgatcgtacaccagaaacattgagtgaatatggaaagtgtctgatggcgcgtaatgctatcgagcgtacgaaattttattttgtataaatcactattatagtaagagccatatcgatcatatatcgatatggctctttttcgtgtaaataaatggctagacgtaaataagttcagagggagaaaaatgctgcttgcgatgaatgaatatcatgaatgctgttctgctaaatatgcagaaaaagagaaaatgtattattgtcgtagttgtcggaaaagagtggttttgaaaaagggaaagaaaaaatgtgctcattttgcccatcgaaaaaccgaaaactgttcggtttttagtgagggggaatcagaagaacacttgcagttaaaggaatgtttcatggattggctgggacagtcagcagaacctgtatttttggaagcttatttgccaagattgaggcagagaccagatattttattggctaatctagcattagaaatccaatgttctaggttgtctcatcagagattttttgaaagaaccaaaaattatttgaacaacggttaccaagtatggtggatacttggtcattcttttcttggacaacggcaattttcattgatagaaaaaagttgctgccattataatagaaaaaggggggtacattgttggaaagctgaccttaagaaccaaaaactttatttatatcatcatattacagagactgtatcaggtcacatttcttttttcagtagctgctggactttttctggtaatgatcttaaaaaaatatttactaataatgagatcaaaataaatcagatgaagaaaacagacaagttaagcgaggatgggaagaagtggttggcgcgccagctgatttacaaacaaaaaaatacagtatccatacaagaacagtgctacttgcgtcacaagcaccttttgtatctatcaccgtggatctatcaaaacagtcggtttttcttttatttacgagaacaggtttttctttatcgaatgttgtacgaagaatccttaaagcaacagaaagtacctgattttagctcatggttttgccaagtaaaagaatataaaagggagtggcttttccctatgattgaggaagagatggtctatcggcaattttttgatgaatgcacacatttatcctcttggaaaatatagtaagtataaaaatagaacaggaaccggttttctatgtaaaacaagtttcagttgtgctaaaattgatagaagcagacacatagattagtagaaaaatcagacgctgtaacatgtggatgtgagacgaggatctattttgaaagaccgagacaaaaggatataaaaaggagtggatttcatggaagtaaagcagttgccaaaacgcgaagaattgcctgaaaatttaacttgggacttgaccaagatcttttcaagcgacaaagaatttgatgagaaatatctagaattatcagaaaagttaaaaaaatctgaaaaatataaaggaacacttaatcaaggcgcttctcaatttcttgatgcgattgaatttgtgttgagtgtttatcgccaaaccgaaatcatttatgtctatgcacaccttaaaaacgatcaagatactgggaatacagaatatcaagcgctttatgcaagagcaagtagtttgttttcaaaggttagtgaagctgtttcctggtttgaaccagaaatattgcagttatcagatgaacggatttggcaatatttcaaagaagaaccgaagttagaagtctatcgtcactatatccagcaaatagtagataatcgtgcccatgttttatctgccgatcaggaatcgcttcttgcaggagcaggagaaatctttgaggcttcaagtgatacatttgctgttttgaataatgcagatttagttttcccaacgatcgaaggagagaatggtgaaaaagtccaattatctcatggtgtgtacggtcagttgctagaaagcacggatcgaagtgttcgcgaagccgcatttaaagggttgtacagtgtttatgagcaatttagaaatacgtttgcttctactttaagtacgcatataaaaggacataattttaaagcaaaagttcgtaattacagctctgccagagaagcatctttgagcaataatcacattcctgaaagtgtatacgacactttggtagatgtagtaaacaagcatttgcctttgctgcatcgatatatggaattacggaaacgtttattagaagtggaaaaactgcacatgtacgatctttatacaccggtcttaggagaagctccaatcacctttacgtatgaagaagcaaaagagaaagctttggaagcactgaagccaatgggcgaagagtacatgactattgtagaaaaagcattctctgaacgttggatcgatgttgtcgaaaataaaggaaaacgaagtggtgcctattcttcgggaagctatgacacaaatccatatattttattgaattggcatgatacattggatcaattgtttacgcttgtccacgaaatgggacatagtgtccacagttatttcacacgatcgagccaaccttatgtatacggtgactactccatctttttagcagaaatagcttcgacaacgaacgaaaatatcctaacagaatatttattggaaacagaaaaagaccctcgcgtccgagcttatgtgctcaaccattacttggatggatttaaaggaacagttttccgccagacacaatttgctgaattcgagcacttcatgcatacggaagatgaaaaaggtgtgccattgactagtgaatatctaagtgatagttatggtaaattgaatgcaaaatattatggtccggcagtcgaagaagacccagaaatcaaatttgaatggtcacggatcccgcatttttactataattactatgtcttccaatactcgactggtttttctgctgcttcagcgttggcgaaaagaatacttagtcaggaaccagatgcgctagagaactatttggcttatctaaaagctggtaacagtgattatcctgttgaagtgatgaaaaaagcaggagtagatatgacacaggctgcgtatatcgaagatgcaatgtcgatgtttgaacaacgactaaacgaattagaagaattgattgatcgtttataagatttttgattttttcgaatagaaacgaaaaaaatacgtcggctctcttgtaagggagtcgacgtatttttttaattagaaagcaagtgtaaatggctagttcgtgaatggaactgagaatcatttgtatgtaaatgttcaccattaaaaacttgatacgagttatctgttgttttacacagctctttgattctccaaaggctgcttgtgccttctacttctactaaaacaccaaaatcacgatcgcaagcgtaattgtaaacgactgcggaaggatgtttcgtgatgcccatttctcgagcaattttttgatcggaaaagaatacttctttaacaaagtcagattgccgatcttctttaaacatattcaaatcgccgccaatctcttcaaatatcgattcagcaagtgcatgagaatatggtatgttattgcagccgactgcttcttgcagtttgatcaaaaaatggcggccttttttctttccttggaattgagccgctttgcagtctaatgcggcagaataagtcgttgagaataagtggttgcgtttctcaagattgttttgagaaattcctttttgttgcatgacatccccaattgtctgcaaattgaccaaaggaagaaagcgaaattgcatcttttcttttgatggtgttccgtactcttcttcaataaattgtaataactgttgctccattttgaaacaatattcccctaaaggattaacaaataaatagatttcgatcatatgaatctcccccaaaatagattctatacaactagtgactagattctttcacatcctataacttaacagaaaaaagtaaaaaaatgaactcaagtgcctcgtgaaaatgaaaggtttctaatttttagcctcaagcatacgttgaatcttgttcttagcaggacgataaggcaaagaaaaacgttttaaaaaatttataaaagcaatttttcccgcagatgcatccactacctctagttctagttcaaaatcgtgaagattgtctccccagctttcatcgatagctaaaagtccttctttaatggggaactcagcccgttttgttgtaagctttcctgtttggatcaatgaagcaggatcgatattcaaatcagaaagtttttgaaaaactgcgcctgagcgaggcaaacgtttttgaaagatgaatgcttctgcttcttctgttacaaaggtatccgtcgtttcgagacgaccttcctcagcaggtgtttttaatgtatattcagcttgatgaccaacgaaacggattcgtaggccacaattttgtttcttcagctgttcatcaacggtatcgaagtaaatattagtctgtacacggaaatcattatctgttaattgatagtgagcgatgaatatctcgtactcttgctttgtcagcatagatttatattcgatttcaagcatttgcgtcatttgatcgactcctttttgtctattttgcctaattttctttttttggtcaatgcataactcaagagtacgaaaaaactttgcatatatggtagaataaacaatgaatgttaatgaagtagaggtatcagctatggaacgagattgggaagcatttttagcaccatatgaacaaactgtatcagaattgaaagtgaaactgcggggaatccgtaaacagtttcgtgaacaaaatcgtcatgttccaattgaatttgtcactgggagagtcaaaccagttgacagtatcgtaacaaagtcacagttacgtcatattccaatgggacgcttagaagaagaaatgtctgatattgccggcttaaggatcatgtgtcagtttgtagaagatatccatcaagttgttgagattatccgtaaaagaaaagacatgaaagttcttcaagaacgggattacatcactaataagaaagcaagcggctaccgttcgtatcatctggtgatcgagtatcctgtacagctgatcagtggtgagaagaaaattttggcggaaatccaaatacggacccttgcgatgaatttctgggcaacgatcgagcattcgctgaattataaatatcaaggcgtttttccagaagaaatgagcgaacgacttcagcgtgcggcagaagctgcgtatcaactggatgaagagatgtccagtatccgtgaagaaatccaagaagcacagcgattgttctcccatggaagaggaaaatcagatgatgtctactatcgaacgcttttgaagaaagaaagcgaaagagaggaggcaggggatgaaagtagcgatcgttcacaataaagaagcaaagactatagaagtggctgagcgcttgaacacactattagaacaagctgggatccagagagatgatcatgaaccagagttggtcatctcaattggtggagatggcacattattatcggcatttcatcactacagtcattgtctgaatgatgtgcgtttcttaggcgtgcatacaggtcatttagggttttatactgattggcgagattacgagctggaagaactagtagacagcttgcgaacaaatctggaacaaagtgtcagctatcccttgctggatgttcggatcagttatttggatgaaacgcctgatcagcattttttagcactaaatgaatcaacgattaaacgggccaatcgtacgatggtagccgatgtatacattaaaaatgaattgtttgaaagtttcagaggagatggattgacgatttctacacccactggttcgactgcctataataaaagtgtcggcggtgcagtgatccatcctagtatcaatgcctttcaattggctgagattgcttcgctgaataatcgagtgtttcgtactttgggttctccaatcgtgattgcccatgatgagtggttagaaataaaattggaaaatacagaagattatcttgtaacggttgatcaattgaatgtcgcaaaagccgatatccgttctatttattatcgaatagcagaagaacggatccattttgcttcttatcgacatatgcatttttggcatcgcgtgaaagatgcctttattggtgaggattaatatgcagtttacatgggattatgagaaagatcattctcagcaggtaaaatattttttaaaagaaaaagggatctcaaaaggtctgttagcgaaaataaaatttcaaggcggtcaaatcaaagtcaatgatcaagtagaaaatgtcttgttttctctagccaaggatgataaggtaaccattgtgattcctgctgaaggagaacatgaaaccgtacttttggacgaaacgccgatcgatatcgtgtatgaagatgaacatgttctggtagtaaacaaaccagcaggcgtttcgtccattcctgcccaataccatccaaatgggacaatggctaatcgtgtaaaggcttattacaaaaaacaagggtacgaaaaccaagtaatccatgtagttacacgactagaccgtgatacgtctggcttgatgctttttgccaagcatgggtttgcgcacgcaaaattagacacgcaacttcgtgaaaagaagtttgtaaaaaaatatcaggcattagtcagtggaatgcttttaaatttatcggcacatggtcatatcgatttgccgattgcccgagattattcttcgctactgaagcgaatggtctctgatgaaggacgttctgcacagacggagtactggatagagaagcgactaacagaaatcgcgttagttgatatccagctgcatacaggaaggacacatcaaataagagttcatttttccgccattggctgtgcactgctcggtgatgatatgtatagcggacgaatggatctgggaataaaaagacaagcccttcattgttatgatctgcgtttttaccacccatttacagaagagctgctagagttcaagcagcctttagccgcagacatggaggcagttgtgagacggtttgaagaataaggcgaggtgagattggtttggatgaaaatcaagaattagaggaaagatttgcccagttgactcaagatttaagggaaaataatattcaggcattcagaaacagttttttagagatgcatatctatgagcaggggcaattctaccaatctcttacagaagagaacaggcagctgatctattcctatctgtcgcctaaagaattagcggatatgttcgatgtgattgaagaagacaacgaacatatgaaagaatatctggatgagatgcgtcctagctatgcagcagatatgctttctgagatgtatacagataatgctgtcgatttgcttaatacgttagataaaaagcaaattgctaaatatttaagtttgatgtctgcagacgatgccagtgaaatcaaggaattgctccattacgaagacgaaacagctggtgcaatcatgactactgaatttgtttcgatcgtagcaaatcaaaccgttcgctctgcgatgtatgtgctgaagaatgaagcagatgttgctgaaacaatctattacatctatgtcgttaatcaagaaggtcaactagtgggggttatttctctacgcgacctaatcgtgaatgatgatgatgctatgatttctgatctgatgagcgagcgggtgctttcagttcatgtaggcgacgaccaagaagatgtggcacaaacattcagggattatgacttcttagctcttcctgttaccgattatgatgatcatttgttgggaatcgtcacagttgatgacatcattgacgttattgatgatgaagctgccagcgattattcaggacttgccggggtcaatgtggaagaaatcaatgaaaatccagtaaaggcagcatctcgacgtttgccttggctaatcactctgttgtttttaggtatgtctactgcttctttgatcagtcattatgaagacttggtaagtgaagcgagcattttagcggtcttcatttcgctgatcacaggaacagctggtaatgctggaacccagtcgctggctgtggctgtccgtcgacttgcaatctctgatgacaaagatcacgggtttgtccgacttgttttggctgaagtcttgaccggcgtcgtaacaggagctgttacagggatgacgatttttctgatcgtgggcttttggaaacataattttatcttaggatttgtgatagggatggccatgttgtttgcgataacagtggcgaatcttgcaggtagtttgattccgatgctgatggatcgtctaggatttgatccagcggtagcaagcggtccatttatcacgaccttgagtgatttgacaagtgtactgatttatttcaatattgcctctttatttatggggtattttatgtaaaaagcaaaaacattggcaacaagcagtatacttgttgccaatgtttttgcttataagattatggctgaagttcaacgattttagttccgtggacttcactcacgtttaattctttagctacatgtgctgcattcgctgctgttacgccaccaccgggcaaaatgatcaaacggccatctgcatagtcaatcaattctttgagccgtgggaaatgttcttcaatcgtttgatcagcagggccgccatgcgttaagatacggtcaacaccgtgcgctgctagccaatcgattgcttcaaattgccgttcttcaggaatactgtcaaaagccatatggaaggtgatctgtacgccttctgcggtttcgatcaatagttccaatgcttcttcgtctagccatcctgagggagtaagacaaccaaaaactacgccatccgtccctaatttctttgcttcaatcaaatcagtatgcataattttcaattcgatatcgttatagacaaaatcgccccctctaggacggataatcgtcattacagggatatttttttcccctgcgtaacttaatgtttcttcgatcacaccagtacttggggtcgttccgccgaccgctaagttgtcacataattcgattcggttagctcctctggcaattgccagaggaatagatgtgtagttttcagcacaaaattctttgatcatctgatcttctcctttgtctttcgctttcttctaggcattgtatcatatttttaccagttgccaaagtgagcatctaacggtaagataaaacagaaatgagggggaactatgttaaaaaaaattgaccgaggacgccagtttttggcagaaaaacatcagctgttccgctgtccagtttgccaagaagaggtagaaaagtctgataatggcttgatatgcaaaaataatcatcgttttgatctgtccaaaaaaggaacactttactttttatcccacgcggttaaaacagaatatgatcaagaaatgttcgttccaaggcgtagaatgatccaatcaggcatgtatcagcccgttattgagactatcgcacagtatctgcctaatgaaatctcgctattagatgtcggctgtggagaaggaagcttcttgaatgaactttcaaaattgaaaaagattcaaactgctgttggatttgatatttcaaaagaaggggtctatgcagctacggaacaatctgtcgaggcattttggtgtgtagcggatttgaccaatttgccatttgctgatcagacatttaacacgatcttaaatatcttttcgccttctcattaccaagaattccaacgtgtactgtcagaagatggagaggtgctgaaggtagtgccgcaagaaaattatttaaaagaactgcgtcaggctttttatccgaatcaacctgaaaagcaaagttattctaatgatcgtgtagtcgcaaagtttactgaatcgatgaaactaactgaacgtcagcgtgtgacttatgaatttgagataccagaagaaaatcgaaaagatcttttagcaatgtcgcccttagagtggcaagtcgaggaggaaatcaaagcagacttgtacaagaatcctttgaaaaagattacaattgacatagaattattaaaaggaactaagagaaaacggttttctagtagtttttaaagagtagaggttgcaaaagtaagttgagggtgttatagtagcaacaagttgttttttcattggtttttatcaggttcctgttctgataaaagttagtgagaagagcttcactaacgtaacgactcgcagtgactgacaccgagttgatacgtttttttttatgcaaaaatcaaattgtcagaaaatagaaacgaacataaatatgagaggaatgatcctgatgaatcatatcgttttattcgaaccgttaatacctgcaaacaccggaaatattgcccgtacgtgtgcggccacgaatacgccgcttcatttaattgagcccctaggtttttcaacggatgacaaacacctgaaacgagcagggttagattattggaacgatgtaaatattacttatcacagtgatttagaagcttttttaacatttttaggtgatcgtaaactacacttgatctcaaaatttgctcataaggtatacagtgaagaaaattttgctgatggagaagagcacttctttttatttggaaaggaaacaactggcttgccagaagcgtttatgcgcgaaaacgaggaaaagtgtttgcgcatccctatgaatgatgagcatgttcgttcattgaatttatcgaatacagctgcaatgattgtgtacgaagcacttcgtcagcaaggattccctaatttagaattaacgcaccattatgaaaatgacaagctggattagacagtttattatagagtaaaataaaagaaagacaggagtttgctgcgtatggaactatattttacccgacatgggaagacacaatggaatcaggaaagacgttttcaagggagcaatggcgattctccgcttttgcctcaaagttacgaagaaatcaaagcatttgggaaaaaagtaaaatatgttccttttaaagcaatttattccagtacagcaaaacgagcatgcgatacagcagaaggtatcaacaaagagcttgctagtccggtagagattttctatacagataaactgcgagaactagggctaggtactttagaaggacaatcaatcgatgaaatgtatcagaaatacccagagaatttgccgaatttgcgtaatcacttagatctatatgatccttctccttttcatggagaaacgattgaatcagcaatcacacgtattgaaactgttgtagcggatgcggttgctcaacataaaaacggacctcttttattcgtaggtcatggggcctcattaactgctgccattcaatggatgacagggaaagagctaagtgagttgcgggaaatgggcggtttgttcaatagcagcctgacgattttagagactgaagagccttgcaaattattgccgtataaactgaaagtatggaaccaaacagattttttaggaactgaaacagcaccagaacctttactatagaagaaggaggcggcttccgatgcagccagaagaaatgccttatttcgttggtacagttgccgcgattttttttcaaaatcctagtaatttttacaaagtgcttttggtacacatcagcgaaactacagctgattaccgtgaaaaagagattgtagttaccggaagctttggcgatattcaagaaaatgagacctatcgtttttatggagaactagtggatcaccctaaatacggaagacagcttaaagtcgaaagatatgagcaagaaaaaccaacaactgcgaatgggatcgtagcttatctttccagcgaaaaattccctgggatcggtaagaaaacagcagagaaagtcgtcgagttgctgggagaagatgctatcgaaaaaatcattgctgatccttcggtattaaaacaaatcgctggtttaacgaagccaaaaagagaaatgcttgctgaaacgattcgtctaaatcacgggatggatcaagtaatcatgggattgaatcgttatggattcggtagtcagttagctttcagtatttatcagacctataagaacgagtctttggatatcatcgaagaaaatccgtatcagctagtcgaagacatagaaggaatcgggttcaaacgcgcagataatctagccgaacaaatcggtattgcagcagattcacctagaagaatccgagcagccatcttgcatcagatttttcagcatgctgttcaaacaggagatacatacgtaccggcggaaacattgcttcagcaaaccatccgtattttagaaacaagtcgtccaatagaaattctgcctgatcaggttgctactgtgattatccagcttgttgaagaaggaaaaatccagcaagaagaaacgaatctttacgaaaacagtttgtatttttctgaatggggtatcggcaattccatccaacgtctgctcagccgtaaaaaagaaatccattatcctgaaaaagaagtgcagaaaaatattcggcgtatcgaaaaaatatttggtatacagtatggaccttcgcaagaacaagcaatcgctgaagccatccgttctcctctatttattttaacaggaggaccaggtacggggaaaactactgtgatcaatgggatcgtcaatctttttgcagagttgaatggtctggaattggatccgtcaaaatatacccaagaaatttttcctattctgcttgcagcacctactggccgggcagctaaacgaatgaacgagacaacaggtctgcctgccagtacaatccatcgtttacttgggctgaatggacgggaaaaaacaccttcagtcagcacgaaagaattagaaggcggacttttgatcgttgatgagatgtctatggtcgatacatggctggctaacacattattcaaagcgattccgacgaatatgcaggttattctagtaggggataaagatcagcttccttctgtcggtcctggacaagtgctacatgaccttttggaaatcgaacaaattcctaaaatggaactcaatcagatttatcgacaaggtgatggttctagtattattcctcttgcccatgaaatcaaagaaggacgtctaccaaaagatttcacaaagaatcaaaaagatcgttcctatttccgaagcgatgcttatcaaattgaacccttgatttctaaaattgtggaaaaagcgaaaaataagggattccgtgcacaagatatccaagtattagcaccaatgtatcggggaccagcagggatcgacgcgttaaataaaatgatgcaagagatattcaatccagggagacctgggaaaaaggaagtacattggaacgacaccgtttatcggataggagacaaagtactccagttagtcaatactcctgaattgaatgtattcaatggagatatgggagaaatcacggggattatcttggcaaaagattcggaagataaagtggatgaattagttatccagtttgatgcaaatgaggtcacttataaaagaaacgagtggaataaaattactctttcttattgttgttcgatccataaatcacagggcagtgaattcaaaatggtcattttgcccatggttcatcaatatcagcgaatgcttcagcgtaatctactctacacggctgttactcggagtaaggaactgttgattttgttaggggaagagcaagcgtatgccacttgtgtagcgaatgaatcggcaagccgaatgactacgttgaaatcaagaatcatcgataatggaaaaatgactatcactctgcggacaaaactagtagcttatgaagattctttgattggaaatgatccatttgaagatgggacctatacaaaagagtcgcaggacataaaagaaaagttacctataaaagacgacagtggaacgaatgaatcgaaaaaccaagtaatggaaacagtggaaccagatctattttcttcatcggttgtagaagaaaagaaagaagagatagaacctgctgttcccaaggagttcgttcttactgcagaagcgattaatcagaaattagtagatccaatgattggcatggaaaacattacaccgtatacattataaaagaatctgacgatacgtatgcgctatttgtcggcaatattgatcacttaaaaagcggatgtgacacgacttgtgcctcatccgctttttgaaattattcttggtgacttgtagtgaaattgtaggctcatgccgtcttggtaaacggtgttcaaaagacagtttcttggtatgaagtcaaatttttgcaaaaatgtgaacaggcatttccacaaaatttttctacaaactcgaaactacttgaaaaataactggttttttgtagaaaattgcagatcaaaaggacgaggagcgacatcttctccatcttcttgaccatattgcggcgttggtgaaacgattcgtaatctgtttgttgtgtagtgatggaaatatttcgatttcaattgttttttctgcataagtaaaaggataagccatatgattttaaaaatattgattcgttcgaccatgacaaaatcaatgactggtttagtcgcatctgcagttggagcgattgcgattcctcctccaaaaaaaggatgcttcgttgctgtacataaaaatgcatttgaaaaacttaactgctttcctcctgcatccactagaattggaaatcctttttgagtaaataaagtccggagaatagagaacaaatacgaaaaagaacctaagttgtatttgttcaatcgttcttttgtagaagaatgatttgtcgcgtggacgatagctgcgtctaatccaataccaaaattattaacagctattccttttttttcacttattttttcttcataagccattatatggactttatctggtgattgagctgctaaaatcagctgaagtgcttttttaggattcttaggaagtcccgctcctcgagcaaaatcatttccagagcctgctggaatataagcgacaggaaattcaacttccatctgatagaaagtatcaagtacctgatgcaaggttccgtctcctcctacgatgatcaaaagagggaaagtttcgattgtttcctgttcttctgtccaaggtactaatgtttcttttgccagaatttcagcaatctccgcatcatgtcctttgtattcactgtaatgaagggtatagttgacatgtttgttttttaatatcggcaagattttttctgctactttatggccgtttccactgcctgccgatggattgatcaataaatgataatggaatttcatattttcctcctgctattcaataaaacaagatattttaatcatcctgtttgctggttaaccaataattagcaagttttttctatttttggaatgaaagaaacttgtttttacaaaaaaacacctgttacaaaattaattcttggttattatagcagaagactaggagaatgaaaaaggtctggagaccgaaacacacaaaaaagcctagcaagcgcatcatccattacttacgtaaggagaagttccaaggttcggtatgtccacttagaccttcagctgcctgctagactattctctagtaagaggttgctcaaattcccacatccttttttatttatttaagtttcacaacaattctgttcgtgcagaacctacttcgtctgctttactgggaatccttatgaccccttacatttatcttataccatattttgagacttttagcaaacgtttacatttttgcttgtttacttttttcaaaagtagataagacagattgaaatagatgaaaagtctgttataattattgtttgtttcacataatcgcggttcatcaaccatcccgcgttaaaaaaactaggagaaatgaggagagaaaatgcaaaaaacgaaaagcagacaacggttgtccgtaatcgttgtcaatggtatcatcatggctctttatctagcgctaactattttagttgcgcctgtatcctcagggccaatccagtttcgtatttcagaaagtttgaatcatttagttgtctttaaccgtaaattactttggggagttttgggcggggtcatcgtctataatgccttctttggatttggtatcatggatgtggtttttggtggtggccaaacattgctttctttaggtctgacagctttgctgcaaaacaaagtgaaaaatgtaaagatgcgtttagtattgaacacgatcttctttactatcagcatgggattgattgcttacatgctagttccgacaggtggccaagcattttggacaacctatggtacacttgcattaagcgagttcatcatcatggctgtttcagcaccactgatgtattatttagatcgttcgcttgattttgaaaagcgtgtctaattgtaaaaaaacgacaaaagaaagcagctgagctgtatttcttttgtcatttttattatgcttcttggttttgcaaattttcgatttctaccactttataattctttttctctaagtggttgatgatcgtttcacatactttcggttcagtgttcgccggcagcgtaatcaatgtacgtcggatgtattcgtctttttcaatatcaagagtaatgcagctggcaatgctactgtattttgaaatgatttttgcgatagcagccagatctccttgctttcctgtagaagcaattgtcagcacatagcttccttgttctacgctccaagattgagagagcatattaagtaatgtgctatgtgtcaaaataccataaaaatgattttcactgtcaaggacagcaatataaggaagctctttgatcgtaaagaatactttgaagaaagaagtatccagataaatgaactttgtggcatttttcaaaagatgagtgacaggaagcgtcatatcaccgccgtttgctttatgacgatagatgtgcattttgtaaatatttccacggaaaatattccctgaagaatctaagatcggtacacaacggtatccggaagtttctaaaatttttaatgcttcttctaatgtactagtctctgtaacggttgtcagatcttttttcttatatacaagtgtttttaatagcatcgctatacctccaattgtctcattttagcttaatttcaaattaatcatatcataattttatctaaaacaatagatagtttatttcacaaattgacaagtaaaaagttacgtgatactgttattaagtataagtctgattctcagcaagggggcagaagtaaatggcaaagaaaaaagcagcactcgcttgttccgtttgtgggtctcgtaactacacaaaatcagtcagtgaaggaaaaagcggtgaacgtttagaaatcaacaaattttgtaaatattgtaatcaatatacattacataaagaaacgaaataaacagcaaaggagggtgtctcatgaaatttctaaaaagcgtaaaagatgaaatcaaacaagtaacttggccaaacagaaaacaacttcgtaaagatacgttggtagttatcgaaacttctattcttttcgggttgatgttttacgtaatggatacagcaatccaaagtttatttggctggatcttaaaataactcgctagccacaacgtgcttttagtgctataatgaagcgaaagaaaaacttcgggtgtactgaggtttttttattttacaatgaaatgaggagccttcaatggaatcttttgaaaaaaactggtatgtcttgcatacatattcaggatatgaaaacaaagtaaaagcaaatatcgaatctcgtgcgcaaagtatgaaaatggccgactttattttccgtgtcgttgttcctgaagaaaaagaaacagaagtcaaaaatgggaaagagaaagaaatcgttcataaaacatttccaggatatgttcttgttgaaatgatcatgacagacgcttcctggtatgttgtccgtaacacaccaggcgtgacaggattcgttggttcacacggagctggaagcaaaccagcaccactacttccagaagaagtcaatcatatcttgcgttctatcggcatgagtctacgacaaaatgatttagaagtagaagttggcgaagttgtgaaaatcatcgaaggcgcatttgctggattagaaggacaagtaacagaagttgacggagaaaaagaaaaattgaaagtcaacatcgatatgtttggtcgtgaaacaagtacagaacttgatttcgatcaagtagataaaatcgattaataaagagacttgaaatgtcgatcatacgattgacctttcaagtctttcttttttctatatggaaaggaagaggcgaatgacaaatcgaatcaaaaatgtatgcaaacatgcggctacagcagctttagtgcttatcagcttgtttgcgataagtggttgccagacgacgaagactactgcagtttctgataaagaaaaaacggtagaatccagtaaagtgatagaaaaaaccactattccaacactttttttccatggctacagcgggacagaaaattcctttaaagggatgttgcaacgtttggaaaaaaatcaaaaagcagtaaaagaattggttctaatagtagaagccgatggacaaatacaagcagaaggagacttatctggaaaagcagacaatccgatggtccaagtattgtttgcagataataaaaacaacgagtggaatcaagcagaatggatcaaatcttgtcttttgtatctgaaagaaaactatagcatagacaaagtcaacatcgtgggacattcaatgggaggagttagcgcgttacgctatttaggaacatatggacaggatacgtcattgccgcaagttcagacatttacggcaattggtgcaccttttaatgattttgtcgatgacagtgggcaatctctgacagaggagttagcaatgggtcctgctgttgtttctagccgctatcaagattatcagcaaataatcggaaatatgcctacaactactcgatttttcctgattgccggacaattggacgaagcagacttgagtgatgggacagtaccgttaaacagtgcattagctgtctatgcgttgttgaaacaacacggaaatgaagtagaagaaaaaatagtaaaaggcgaaaatgccgctcatagtatgcttcatgaaaaccaagaagtagatcagcttgttagtcgatttgtttggaatgaatagcaagaaaaggatccgagagtaaatgtttgcttactttttgtaagaatagtatgatttacatgtaatcaagaagatgaaagaaggatctactatgacttatcatacaagtaatgaagaacatccaatcgatattgtaaacattgcttcactagaaggtcgtgtaaaagagcgaatggaagcaggagcttttggctatattcgcggtggttctgaagatgagtggacgatgaaagaaaatacgacttcttttaatgcaaaaaaaatcatgccacggatattacgcggaatcgactcagcagatttgcatacatcagtttttggaattgaattagacacaccgattatccaagcgccatcagcggcccaaggattggcgcatgaaaaaggggaagctgatacagctaaaggggtagctgctgctggatcaatcttttccatcagcacttatgcgaatacgacaatcaaagatgcagcagatgcagcgccaggtgcaccgcagtttttccaattatatatgagtaaagacgatgggttcaatgagttcattttgaacaaagcagtagaagcaggggctaaagccatcattttaacggcagattcaacgctcggtggttaccgcgaagaagatgtgatcaatcaattccaatttccattaccaatgcctaatttaactgcttatagcgaacaaagtgcaagtgggaatggcgaaggaaaaggaattgcagaaatctatgcagctgcaaaacaaggcttgacaccagatgacatcaaaacaatcaaagaaatcaccaatcttccagtcatcgtaaaaggaatacaatcgccagaagatgcagtcatcgctatctctgcaggggcagatggtatctgggtatctaatcatgggggacgacaattagatggaggtcctgcttcctttgaagtattgccaaaaattgccgaagtagtcaataaacgtgtaccagtgattttcgactctggcgtccgtcgaggagaacatgtctttaaagctttggcaagtggtgctgacttagttgcgattggccgaccagtaatctatggattgaatctaggtggggcagaaggagtaacctctgtttttgaacacctgaacaaagaattgtcgatcacgatgcaacttgcaggaacaaaatcgattgatgaagtaaaaaatacgaaattgatggattaataaaaaaaacgaagagaggcctaactgtgcgtctcttcgtttttttgtgatagaaataactaatctcttaatactcgaaactaggcagcttttttacgacctcttatttaaaatctcttctgtaagtcgcttagcagttggcgtaacagctaagccgccttctgctgtctctttgaaaatcgatggcatttgtcgtccgacttgatacatcgcagcaacgacttcatccggtggaatgacactttcgatacccgctaatgccatgtcagcagagatgaaagcttgagaggaccctaaagcattacgtttgacacaaggtacttcaactaaacctgcaacaggatcgcaaatcagtcccatcatatttttcaatgtgatggctactgcttgagctgcttgatgaggagtcccgttttttgcacaaaccaaagccgccgccgccattgcacttgcagaaccaacttctgcttgacaacccccttctgcgccactaatagaagcgttgttcgcgattactaacccgaaagcgccagcagtaaacaagaattccaattgctgttcatgtgacaaaccaagccgatctcggacagccattaacacaccaggaacaacccccgcacttccagcagtcggcgtagcacaaatcaatcccatttttgcattgacttcgttaacagctacagcattgcgtacagcctttaagatcgtttctccgctcaaaaaatctgcttcgttcaaataatcatctaatttttttgcatcgccaccggtaatccctgtgacggaggtgacaccttcttttccctcgttgatcgattgttccattactgaaagatttttttccataatcgcaatgatctgactacgggaacggccgctcatttccatttcaactgcaatcatcaattctgctacacttgaataagctttcgcttggtctactaattcttcaatcgataaaaacattttttcagctccttaatcgaaatagtttacgctgtcgatatttggcagatgtttgagtcttcttactgtttcttcaacttgaggattatctacttcaatgatcatgatggcgctttcgccttttgattcccgtgtcactgtcatagtaccgatattcgtattggtttcagaaagtataccagtcactttagcgatcatccctggaacatcttggtgaacaacgatcaaggtaggtgttcccatgcttaaagaaattttgaatccattcaattcagaaatctggatattgccaccgccaatcgaaatgccagtaactgaaagctttcgtgttcctttttttagaagcatctttacagaattcggatgttcggctttttcactcttaggaacaaacaagacttccatgccagcctcatatgccaatttcaaagaatcagctaaacgttcatcatcaggttccattcctaatagaccaccaactaatgcaatgtctgttccgtgacctcgataggtttttgcaaatgattcatatagataaatatctacagaatcaggttgctcgccaaatatactgcgtatgatcttcccaattctagctgctccggctgtgtgggagctacttggaccaatcatcacaggtccaataatatcaaagacacttctataccttaaatctttcattttctccacctcattttgttatgtaggaatctttgtacaagggtctaaaaaaccgtgttattgtttgctttcatctgttgaaccatgctagcgcaagtgtaacataaaagaagaaatgggaacgaaaaattgttgtttttttagaataaatttagcgtttattcaagcaaaatgtaaaaatagcagaaaaaaatcttgaaaaaacaaataaatttgctatactgtaccagtgtgcattgttttgcacattatttgtctggattttttcagatcagataaaacgtgggaggagaaatatgcatctccaattaaccacatcacggacttaaggaggtatgtctcgtggcaaagaaagtagaaaaaatcgttaaattgcaaattcctgcagggaaagcaactccagctccaccagtaggtcctgcactaggtcaagcgggtatcaatatcatgggattcacaaaagaattcaacgctcgtacagctgatcaagcaggtttgatcattccggttgttatttctgtatacgaagaccgttcattcacattcgttacaaaaacaccaccagctgctgttctattgaaaaaagcagctaaaatcgaaaaaggttcaggtgaaccaaacaaaaataaagttgcgaaagtttctagcgatcaagtaagagaaatcgctgaattaaaaatggaagacctaaacgcagctaacgttgaagcagcaatgcgcatggttgaaggaactgcacgaagcatggggatcactgtagaataatctctataccctaagacagcagcttctcagttggctctatattgaaagatatagaacacgtgggaggtacaaccgttataaccacaatcaaggaggaaccaaaatggctaaaaagagcaaaaaaatgcaagatgcattaaaaaaagttgattcaagtaaagtttatcctgttgccgaagcagtagctttagcaaaagaaacaaacattgcaaaatttgatgcaacagttgaagttgcataccgtttgaacgtagaccctaaaaaagcagaccaacaaatccgtggtgctgttgtattaccaaacggaactggtaaaacacaaactgttttagtttttgctaaaggagacaaagcaaaagaagctgaagcagctggtgcagatttcgtaggtgacgacgacatggttcaaaaaatccaaaacggatggtttgactttgacgtagttgttgcaacacctgatatgatggctactgtaggtcgtctaggacgtgtattaggaccaaaaggcttaatgccaaaccctaaaactggtacagttacaatggatgtaacaaaagcagtaaacgaagtgaaagctggtaaagtaacttaccgtgtagacaaagctggaaacatccatgtaccaatcggaaaagtttcatttgatgatgaaaaattagttgaaaactttgcaacaatccatgatgtattgctaaaagctaaaccatcagcagctaaaggtcaatacatgaaaaatgtaacgatcacaacaacatttggacctggtatccatgttgaccaagcttctttctaatcaaatattagaacgttgattgatccaactgaaaaataattcttgactcaactagtttagcatgctaagctagttgaggttaataattaacttgtaccgaagacagtaggtggcgccaagccttaatttcctaccgaggacgtttattgaatatattcaatagtccctctatgtctgcggtggcatagagttttttattgtgaatcactatgaacgaagagaatagatgatgaacaatactggttgagcaaagaaactatacaagtgatttgccttttcagttcaaaaaactcttccatcaaaattcaggaggtgaaactcaaaaatgagtgaagcaattatcgcaaaaaaagcagcaatcgttgatgaagtaagcgaaaaatttacagcagctgcatcagtagtagtcgttgactaccgcggattaacagttgatgaagtaacacgtttacgtaaacaacttcgtgatgctaacgtagaaatgaaagttatcaaaaactcaattctctcacgtgcagctaaaaaagctggccttgaaggcatggacgaagtattcactggacctacagccgttgcattcagtaacgaagatgtagttgcaccagcgaaaatcatggacgaatttgctaaagaagcaaaagcattagaaatcaaaggcggtatcatcgaaggtaaagtatcttcattggaagaaatcacagcattggcaaaattgccaaatcgcgaaggacttctatctatgttgctatctgtactacaagcgccagtccgcaacgtggcttacgctgtcaaagcagtggcagacaaagaagatggagatgcagcttaattgccgcataaagtattaaataataaagaacatttaaacggaggaaattataatggcattgaacattgaaaacatcgttgctgagttaaaagaagcaactatcctagaacttaacgacctagttaaagctattgaagaagaatttggcgtatctgctgctgctcctgtagctgtagctgctgctggtggcgctgctgctgctgaagaacaaacagaattcactgtagaattaactgcagctggagaccaaaaagttaaagttatcaaagcagttcgtgaagcaactggcttaggcttgaaagaagctaaagctgtagttgatggcgctcctgcaccagttaaagaaggcgtatctaaagaagaagctgacgaattgaaagctaaacttgaagaagttggcgcatctgtaactgttaaataattttttaactatttaaaagcactgagatcctatcttggatttcggtgcttttttgtttttatgttaaactattatttaatgaatatagtttttttcaggaggtaatatgaaaaagaaaaaaatccgattgattttgatcacgttgggaatcgttctgatacttatggtgggctatcggttgtatttggaatatcagacagatatacaattatttttaaaccctagagcaagtaaggaagagctgcttgcacatattcgttctcatggtttttctgcatcgctactcttgattgtgttgacagcggtgatgtgtgctgttccgggtatccctacttcggttattggtgtcattgccggattgagctttggtccgtttattggggcaggtatcaatgttttagggaatgctctgggcaatatttccgctgtgtttttgatgtaccgattgaaatttttagacaagaaaactgaaaaaaatcattgggtgcaatccattcggcaaatgagacatcccaaaataggcgtcatgttaggttacatgataccggtgatcccatcttctatggtcaattttgctgcagatgcgatgaaattgcctcttcagcaaatcgtaatgtcgatcgtgattggagtcatcccttcatctgtgttgtatgcgtgtgggggagaagctctgtttcacggatataacaaaactgcagtcacgttggttgcaagtgttactgtgttagtagggttagttgtcttcatttataaagatcgcaagaaaaaacaaggaaaacaaagacaaaaataataagtatggcgaatagttgtatttttctatttccaatcttttccataagttgtaaactaagataggaaatgggggaaatcaatggagagtaaagaaaaaacacctttaacaacatcgcttattttattattatcaatcacttgcggcgtcgttgttgccaatatgtattatatccagccgattggaacaaaagtagcagctagtttatctgttagcataagtgcagtcgggatattgacaatgttgacccagttgggctatgcactagggctactgtttttagttcctttaggagacgtggtggatcgtccaaaattaattatacgaatggcagcgttatctgctatctcgctgttggccgctttttttgcgccttcgtttgcgttatttgcatgcgcttcttttttaataggattactttcgatcgtgccgcaaattatcattccttacggtgcggtactagcaggaccaaaagcaagaggaaaagtcatgggaacattgcttagcggtttactcgtggggattttgctttctcggactgtatctggtattgttgccagtcttttttcttggcggatgatctatttatttgctttatgtgccgtcgggattcttacacttctgctttactggaagatgccgcgttctgtccagcaaagtagtacatctgtttcataccttgattcactcaaaagtttgccgcatttagttgcctctcaacgtttattaagagaagcggcagtcagcggattttttatgtttggcacattttcaatcttttggtctacgttgattttttatatcagcagtcccgcttacaattgggggacttttgaagcagggatattagcgatttttgggttgtctggagcagtcgctgcacctatcgtgggacgactggcagattcttattctgaaagaaaaattgtatatatgggacttgttatgcaaacaataagttttattgctttattggttggcggaagccatttggccattttgcttttagctattattttattagacgtcgggaatcaatttggtcaagtcgccaaccaaacacgagtacaaggactaggtgaagcagcaagcaaccgaaataatactgtatttatgtttatgtactttattggaggtgcggctggttcattgctagggacgaccatgtggcaacagtatggttggttaggtgtaacggttagcggacttgtttttcagggatgtgggtttttctttcagttcgttgtttttcgagagaaaaaagaaaactgaacaacaaaaaaactgatgatcatgctatcatcagtttttttgtctttttgtctcattactttggttcaatctcaatgactcgttgaacaagatcttgataaaattcttgttcatgagagacgatgatcaccgttcctggaaatttccgaatgccatcttgtaagctttcttttgtttcttgatcaatatggttcgtcggttcatcgagaatcagtaaattaccttggttcattgtcaactgtgcaagtttcaccttggtttgttctccaccacttagtgtagtgagaggatcgcttgctaattgattgactagtccagctttagctaattggcgacgtaattctttgatagtcgcttttggaaattgactgcttaagtattgcagtggtgtttctaatggattttcccagtatagatcttgtgaaaagtaattgatttttgtgttatctgggaagtggaaatcgccacttattttttcgatctcaccaatcaatgtttttaacaaagtagatttcccaatcccgttgaagcctcgaatggcaatattttcaccaaaccggatggtcaaattaatgggcgcaagtagcggtcgatcatagccgatgactaaatcagttgtttccactgccaacgtcgtgacaataggcgagaatggaaaatcaaagacagctttacttgctgaagcgggaggcgtcaaccgttcgattttatctaattgtttttgtcggctttttgccatcgttgatcgggaaccggctttgtatttccgaatataagcttcagtcttttcgatttgtttttgttgagcatgatattggcgcaaatagctttcacgattttgttccttttgtttcaatgcttgttttagatggccagtatacttagtaatctttccaaactcgatgtctgcgatatgggtggtgatctgatcaagaaattcttggtcatgggaaatcacgatatacgcaccgtcaaaatcctgaagaaactgcgtcagccattggatatgctgatcatctaagtgattggttggttcatctaagatcagaacatctgggttttctaaaagtagttttgctaaaatcacctttgaacgttgtccaccacttagatttttcaacagtgaatctaaacctaagacatcgatccccaacccgctgctcatctcagcaactaaggtgtcgatttgataaaacactccttggtctaattccgtttggagtttcccagctttttctagcaaggaatcatcgaaggtctcgctatatgtttggtaaagaaaagcaattttttcttctttttcgtattcttttgcgtacgcagtttttagaaattcttcgatcgataatgtttcatcgacttctacatattgatcaaggtaacctttatgaatatttttttgccaatggatctgtccatcatctggcaggatctcaccagtgatgattttaatcaatgtacttttgccggctccgttttgtccgatcagcccaagatgctcgccagcgtttaattgcagatcgaccccttcgtagaggattttatcgccgaactgctgggtgatgttgtttaatgtcagtatactcataataactcctttttcataaaaaaactgcagacataaagtgtccacagtgaatcaattgcttggttttcatgcaacatgggttgtttgattgaaccatcttatgaaacctaacacggatgcccttttgttgtcaagaaaatgaaaaaaatagaatttggtctatactgattattgtaaaaagaaaaaaagaatgctataattgggctataccaaaacacaaaggagcaatcactatggaaatcattcgtgtaaaaaacgctgaagaaggcggaaaaaaagcatttgaaatcatcaaagaaggtatgaacaaaggtgcaaaagtattaggattggcaacaggaagcacaccagttactttatataaagaaatgacttcaagcgatttggatttcagtgaaatgacttctgtaaacttagatgagtacgttggactaggtggttcagatgaacaaagctaccgccatttcatggatgtccaattatttgataaaaaaccattcaaggaaacatttgtaccagatgggaaagcagaagatctggaagcagcatgcaaaaagtatgatcaaatcatcgatgctcatccaatcgatatccaaattttaggaatcgggcaaaatggacatatcgggttcaatgaacctggtgcttcatttgacggaacaacttcagtagttgatttgacagaatcaacgatcaatgcaaacaaacgattctttgataaagcagaagatgtaccaacaaaagctgtttcaatgggaattggctcaatcatgaaaagtaaagaaatcgtcttgatggcgtttggcgaaagcaaagctgatgcaatcaaagggatgattgaaggacctgtaacgaatcatttaccagcaagtgtattgcaaaaccacgacaatgtcgtcgtgatcatcgatgaagaagcagcaagtaaattgtaatttaccaaagaggctgggacagaagcgtttaactccaagaaataagaaggaattcacgaaaattgcttttcaaatttctgtgaatttcagcttatttccgaaggagttgcttctgcttccgccgtttacacatgtttagagtgtgtgacaaaagtttttctttacttttgtcccacgctctttttcgtaagaggtaaaaattgcactttttttgtctgctcctttcagacatgatatattggactggagggtgtttagatgaatgatatggtattgacaattccagagattattttacgtttagggatcgctatgctatttggcggagcaattggctttgagcgacaatataaaaatcgtccagcagggatgcgtacgcatattttagtttgtatgggagcatgtatcattgcattgatccaagtcgagatcgctagtggagcattaagagatgctttagcgtatccacagcttgctggaacgatccgttcagatgaagcaaggctgattgctcaagtagtgagtggcgtcggtttcttaggtgcaggaacgatcatcgtcacgaaacaatcagtgacgggacttacgactgccgcttctttatgggctattgccggattagggatcgccatcggcatgggttactattccattgcgatcatcagttttatcgggattgctattgcactcacagtagtgaaacgcgtgatccatgtacctacgactaaaaagttagaaatccaatttatccatagaaaagaaaccaaagattttcttaccgattattttgaagagaaaaatatcgtgatcgaagatgtgaattttgatgtgaaattcgttgatgactatcgtgtatataaaaatatatatacgatcgatcttcctaaaggactcacttatgccgatgtaatcgaggaattgtccgtgcacaaaaatatcacaaagctacatttagtcagtattgcgcaataaacgatctgcccaaaacgatttttattttgggcggatcgtgtttttgttgaagtactcttctgatcagtaaaatacctttccttttttattttgttttttttaagcaaatgaaaatctcagcgcgtaattctttgttaaatgatagaatagaagtatcaaaggaacttggaggagaggtatgcaatcacgttttaaacaatcaaaattatttttctggacagtggagctagtactcacgatcgtcggtgtgtatttcattttacaaatgccgaatatttttagtccaatattgaaaatgctttcggctatttttttgccgttgcttgttgctggttttatctattatatgttcgatccaatcgttgtttttctcgaaaaacatcggattccgagagtgttgggttttttattgacatttttggtcgtaatcattttagttgttttggctgtcatgaatgtagtacctcagttagtggagcagacgattcaattgactcagagcctgccaatctatgcagatgaaacaagcaaatggctaaatgaattggcgcagcgagaagagtttaaaaatttcaatttggaagaacaattagcatcagcgaatttatctctcagtaatttgttcaatatcatattggtcagcttatctgcaagtgtcactaaaatcatttcattcatgatgcaattttttattttgttatttacggttccatttattttgctgtttatgttcaaggatggacacaaatttattgatgcgttgtctcatttctttccgaaagcgattcgtaaagagttgcgacaaacagtgaaagaattaaatgaaacattatctgcctatatcagcagtacgatcttagatgctttgattattggtgtgatgagctttttggcaatgagaatattcaatcagccttatagcttattgcttgcggtcatttgcggcatcacgaatattatcccatatgtcggcccttttattggagcagtaccagcaatcattgtcggtttgtttatctctccatttcaagctttgtacatggcgttgtcgattttagtgattcagcaattagatggaaatttgatcaagccgttgttgtttggaaaatcaatgaatatccatccactgacgatcatcttggtattgattggagcaggaagtgtcgcaggaatattaggcatgctgatttgtatacctgtctatgcagtgattaagacaataatattaaatattcggaaaatctatttattgagaaaaatggaacatgtttctgaaaagttagatagtccaaaattgctggaagaaacaagtgaataagcctatttaaaaagggatcttagcgttcattttatttagatgtacgttgagattcttatttatatgatccagttgatgcttttttataatctaatcgatccgtcctgtttagggtggacgaatgagcaaatcatggggtaaatattgtttactggaaatggctcaaaggtatattagatttctttcattttagatagagtaagtaaaacgaagaaaccacaagaaatgcttccaagagaaaacaatactaagtgtgttaacatattaagttttgactatcctgttttctcactcatttcattttcatctcactcagaagtctctcctgaaaccgattttctaccatggtatcctaaagaaaaagaattcggagggttgtcatgaatcagttaaaacaaaatctatttttgacgcggcgcgattttgaagaagcactagaggagataattttgcctttaaaacaggaactattcaatagtgaaaaaccaggagtacgtctagggagtagcggcgcggtttatgacgagaagagagcagaaatggaggcatttattcgtccattatggggattggcaccttattggatgaaccatgagacgaaagatgagttgaaagacgtctatcgaaagaaaatcttgaaagggatgaatccaaaagattctttttattggggagatattaacgattatgaccaatatatcgtagaaatggcagcgttatctttgaatctgttattgaatcgaaactatttctttgatgaactgtcaggcacttccaaacaacagttgattcattggctaaaacaagccttagataaaaaaatacctaaaaataattggacatttttcaaaattttgatccgaatcgctttaaaacattgtggtgaatcattagataaagaaaaaatggaagcagaattacgctttattgatacgatgtatgtaggaaaaggctggtatatcgacggtaaatcttcgcaaaaagattactatgttccttttgcttttcattattatggattgatttttgcagaagtggaagcaatcccttggggtcagataaagacgcttctttccaaccatatgaagcagtggatgacacacgatatctttacttatgacggacggctatccattgggtatcattatgagaaccttgtgatggcagaaggttataacgcaccggggtctccctattgggcattaaaagtatttttattactagcaactaaaaaagaacatccgtattgggaagccaaacctgaaccagtcaataccaaagagaaaagattgattgataatggaaatatgcttttgtgtcaggcaaaagaaggaaaacatgtacttggttatccacatggtttgatgatcgatggccaagcgcatgccccagcgaaatatagtaagtttgtctactctactaaattcggctttagtgtgccaaaagcgggaatcacatatgaagaaggggcatttgataatacattagctctttcaagagacggtgaatatttcaggacaaagaaaaaggtacgaagtagtgaagcaacagagacttttgttatgtatgaatggcaaccattccaagaagtgctgatccaaacagaaatttacccatttggtgaatggcatgttcgattccatgaaatatatacgacgattcctttagagataagagaaggcggatttagtcttttggtaaaagaaccagaaataactttgtcgaaagactgtgcaaaaataaaagaaacgcatgtgtctcaaatcattgcaatcgaggggtatgaagaagcaggtattcaggtactagaaccaaatacttctgtattctttccaagaaccaatcttccctatttgaaaaagaaaatcgaacctggcacccatcgctttatttgtttagttggcggaataataaatggaggagaaaaaaatgatccaaattgatctaaaaaataaaaataatcaagtagttattggcaaaatcgatcacgagaaaaaagaaaccgcattttctgcaaatggagaagaaatagcagttttagcaatcaaaaatcacacatatgaagtaggagacaaactggtcataacgaaagagaaaaatgatcactattttgttgtgcaattagatgaaacattggcaccgacacttctttatattccagagaagaaatgggaatatgtgattccgctagaagaaacgaaagcttcagtagagacgggatttcgttcaaaaagacatcacatatatgttcgtaaagcctatgattttgaagtggaaagctatcggaatgtatctacaaaccctcatgatcaaaaattgttcagtggagcatatccacatgcatatgctaatgtagagacgagaaatgatgtgactttttttgctaaaaatgcgattgacggaaagtttggtaaccgctcacatggatcctatccatttacttcttggggaatcaatcagcaaaaagatgcaactttgacgatcgactttggacgctcaatccaaaccgatcgagtaaatcttttgtttcgaggagattatccacatgatagctattggacagaagtttctatttgtttttctgatggagaaacaataaaagtagcaacaacagatacgcttgaatttcaatcgttttactttcctgaaaaaatgacgagttcagttactttgaaaaatttgaaaaaagcagaagatacgtcaccattcccagcattaacacaaattgagattttcggacgagaagtaatcacttgtacttgattaagagaaataataatagaaaagctattcactatataagggaatccgctttgaaaatcgaacaatgattttcgtaggactccctttttgtataagctaatttacaggatgattattttggatcgttcatgacaaatctttttttattggttgatctgaaaaaatcaatgtatcaattgatataccttctgtttcaaaaataaccacttcatttctgccttttttgagtacatcttttggacaatatagtgataaaacaggcccatgattccagtacctcccgagattgaatccattgacgatgacgatccccttaccatataaagaacaatcgatataagcatctgcttcttcagcaagatcaaactcaaattgataaaaagaaggctgtgacgggtctttgccagcggaatagtcgattttatctagttgagcttgttcgaaagtcaatgggtaatggcggtatccaagatggaaatggatatcttgcatgacaccattgcgaatcccttttgattgggagggactattcaattttgcaccgtaattaactcttcctaaattctcaactagaacatctaatgcgatagtgggctgatttttttgtccttcaatcatcatttcatcacccagtgtttcttgtgtttgcgtttggtcgtatttgccgtcaatatatatttgtgcacgatcgtttgtttcgattaaacgtaatttatttttatgtccgtaattttttaaggtaagtgaatataataaatagccgtagccattgcttgcttgttccattgtcaaagggtaatctgttttgatttcttcacagatctgttcttttatatgaaatagagaaacgcttccatttaccggataagtccctagattttttaacgtttttgttcggggctctgcttgccaaacagatggacaaacttctttgatgaccctttgaactgcataatatttctcagtaggttgtccagcttcgtttaatagtgcatcgtaatcatagcttgtgatttgcggaagatctgtattgcctcgagcagaacatccattataaaaaccaaaatttgttcccccgtggaacatatatagattcaaggaaccaatttctaacatctcttttacttcagttgctaattcttcgggatcacgcgtaatgataggttctccccatcgattaaaccatccatcccaatactccatacacatgatcggccaatttttttgatgattctgcataaattcttttaagacctgcgcattttcttttgagtggcttccaaaattaccagtcacaaaaatgtcttcatcaattaatgtaccagcatctaacacctctagccaagcaccatcggaggtaaataaaggaacatcaatcgaatgtgcaagcatcaattcttttgtttggcgtaaataagatttttccattccgtaagaaccgtattcattttcgagctgcatcatgatgactggaccaccttgtgtgatctgaagaggtgcaagttttggtagaagtacttgataataatttttcaatttttccataaatcgaggatcggtagaacgtactcttatattaggttctttcaataaccaagcaggtaatccaccaaattcccattcagcgcaaatgtaggcgcaaggacgtaaaattaccatcaagtctaattcttgtgcaatttttacaaatcgaacgacatttttgaatccggaaaaatcaaaggaaccttcttgtggttcgtgaagattccacggaatataagtttcaaccgtatttgctcctagtgcttttaaattatataaactgtgctcccattgagaaggggatattctgaaataatggattgccccactaatgatttttgtaggaataccgtcgactaaaaattcgtcttttattttaaatgtttgcatgtctattcattctccttaccagtaagtgttccattcaggttttgctaaacggataagcgcttctaaataaaagtagtcgccccatagatttggctcatcgactccttttccttccgcatgagcataaacgccatgtaaaagaattccttcattttctggatcatttttagcagtatagtgtgttcctaattgataaatcattccttttgctatttcttttgcttcaggatacgcttccattttttctgcttctaataatccacatgcagcaatcgctagagaagaactgtctttatctgatggaaaatcatcattgaaatcaaaatcccagtaaggtacaagatcttgaggtaaatgttctaagaaaacatcgacgatcgctttgtagttcaacggaaaaggagcagaatgcaagtatcgctcgtttagtggaatccctaaaatcgcccaactttgccctctagcccagatcgactcatcactatgaccttgatgtgttgcaccatgtgttggaactcctgtgtttgagtcaaaataataggtatggaaagtcgtggcatcttcacgaatcacggtatgcaacaatgtctggtaatgcttgaaagccacttctttataatgtgggtcattagaaagcgtacatgcttggaacaacaaaggaagattgatcaaagaatcaataatcaagcggtattcgagaggatcaccgtatgctccccaagcttggataaaattccctttgttctgaaatcttgccactaaaatattcgcagcttgtaaaagcgattctttacacaactgactatccacgactttatacccggctccagcagataaactataaagaaaaccgatatcatgatgatcaaggatgaagtgttggtctaagcgtttttgaaagctatggatattttccattgcacgtactagaaatttctcttcttttgtccattcataagataaccaaagcattcccgtccaaaaaccatttgtccaatcatcattttttttgattcgatattttccgtttgttgcacaagctgaagggaaatctaacccgaaacgaaccatattttttttgatacgcatcatgcaccattcaaattgttcatccaaccaatttttatctacaaatgttcccaattcaatcaacatttcctttttttgttgaagattcatagctacctcctcttaaaatgttaacatattaacttaaaaatagtataacgtatttagaaaaaaaaagcgagtattcaagaggatttaaaaaagtttcttagaagagagcaaacaaaaaagtgaaagctattccgcttccacttcaatttttgttttaaagtatttccaatgtttataactgatgatatattctgctacactttgatctgctaagtaagagtgtttgatttgttgtacaacaggttctcggaaacttagattcaatagattaagtagttctgcatgctctgggaaaacaatttcatttgtttccacagaagcaagggaaaaaagatcaatcccaaaatctttacgaactttttcgtatatacttgaatagacagaaatatcttttgctattggttctttcactaatttttttggtaagtgagtgatgtggaccaaaaagggtgtgtcttcaaagaaacgaacacgtttaattttatagtaagaagcatttgctggtaagcctaattcctttaaaatatccatttcattttcttcctcaatcgagagtactttaactttttctttatctaaagaatgtagttcgatatcagagaatttcacactttgagaaacttttgattttgaaacgaatgttccttttccttggatacgatagagatagcctgcagcagttagttcattgagagccttgactgcagtaattgaactaacagaatatttccgtttgatatctgcttctgagtaaaatttatcaccaggaataaagtggtggtttttgatttcttcaagtaagtcttgcttgatttgctcgtatttaggaatcatactagaagtcttcctttctttcatcatcattatctaataggataacatgttaacatatccaaatcaattaaaacccataaagtctgctattgcagaagtaaataaaattatgacggtagatgaatttagtggaactttataaaaataatagaagtaaattgggataaaacatcacattttagaaagcggatacaaaaatgtctgatgcaatggacaaatttcagtgaaacagatggggtaaaaatggttatgataaagatacaaagggggaaggatcatgactagtcaaatgaatcgagaaaataaattagtgctactattgtcaaaacaaaatcattacatgacttcagaagaattagctgatttattagatacctcgactaaaacggtctaccgcttagtaaaaaaaataaatacagaatttcaaaatggtcacttgattttatcagaaaaggggaaagggtataaattagactacgaaaaatttattgaacgaaacaaagaaacaaataatctatcaattagtctatcgccaaatgaacgtcagaatcgtgtaatggaggaacttttactgtcttcaccaagagcaatcaggatatctgagctttttaatgcctacgaggtgggtgattcggcaatttccaatgatgagaaaagtatcgcccaaaagttgaggaagtttgatcttcaattgattcgaaaaaatcggacattagccatcaaaggtttagaagaagatatacgtagagggcttgcagaagttatttggcgcatgaatatccttgatatagatgaaataaatgcttcgaaaacgttcaatttcaatcgttacgatgtcttgttcgtttcagatcaattaaagctaatcgaaaaaatattagaaggtggacttccttatccttacaatgtcaatattttttcacatctgtatatcttgatcagtcgctcaaggaaaaggagtgctcccgccagagaagaggaactaaccacggaacaaattgaattctttgaaaaagataaccaaattaaaaaaacagccgaaatcgttatacaaaatgttgaaaaatatctggcaacttcgttatctgtgaatgaatcttactatctctatcagtatctagtttcctcaagaatggaaaaaacaacaaaagaaataaaaaaatttccagaagaggtagaaaaaatcactacttactatttagaagaagtaggcaaacgaatcaatatgaaagtgacaaatgaaagtatttttattgatctagccaatcatatcaaaccaatgatcaatcgcttaaaaaaccgtatccacgtaaaaaatggcttgttggaccaaattcagctgacctatgaaaaaatctataacagtgtgtctgaagtatctaaagaagtcagtcagcacttcaaattacctctaatcaatgcagatgagattggcttcataacgttgtatttcgcacggatgttagaaacacaacaattaccgattcagacattgattatgtgtacgacaggtattggaacttctgaattgttgaaagcaaaaatcatcaaaaaatttccagacttaaatatagtagatgtcattgcgacaaaaaactatcgtacggctttagaaaaaaatccgaacatcgaattgattttgacaacagttggaatccgctcacgattaggagtccatacattacttgttagtgcgatgctaacagcagatgatcaatcacgaatccagaaaaagattggggaaatctataatgaaagatgagttcatcgaaaaaatcgaagtatccgttacttctcaacgagaggcatatcattggttagcaagttcactttaccctggagaagaagagaaaataagcatattgatggaagcttttcttatgcgtgaacaaaatggaaatattcaaattgaagaggggatcattcttcctcatattgaacatgagttgatcactgaatcaaaaatcatcattttgtatccccaaaaaaccattattcaatggaacgaagcaatcgaacaagtcgatttgattctttttgtattgctttcgccaaacgaaactacggaaaaaaagaagaaaatagcgaatttcatgagatgtttagctgacgaaagatttattcaaacattaaagaaaagaaaataaggagagacaaaagatgaaaatcgtaggtgtagccgcatgtacagttgggattgcccatacgtatattgcacaagaaaaattagaaaatgcagccaaaaaagcaggacacgagatgcacatagaaacgcaaggaacgattggaatcgagaatgaattaaccccagagcaaataaaagaagcagatctcgtgattctggcaattgatgtgaaaataagtggcagagaacgatttgaaggaaaacgtatcattcaagtaccgacggaaatcgccatcaaatcacccaataaactaatcgaaaaaggcgttgaagtcgtaaaacaagcgtgaaggagtggaaatgccatggaagtaacaaacatcatcgatccgaatacgatcaaaacaaacttagcaggaacgacaaaagaagaagtacttgaagaattagcaactatattgttggaaaatgcgtatatcaccgatataaaagaatttatgaaagatatatatgctcgtgagaaagaagggcagacaggtattgggaactacattgcaattcctcatggaaaaagtgcatctgtcaaaaagatcggggtagcaattggagtgacagctcgagaaatcccttgggaaacattagatggtaaaggggtaaaaggaattattttgtttgctgtgggtaatgataatgatggggctaaaactcacttgaagttgttatctttatttgcaaggaaattaggaaacgatgaagttgttgaacaattgattaaagcaaaagagacaaaagaggtcatcgcagcatttgcatcataaaaaggaggaagaaaacatgaagatcataggagtagccgcatgtacagttgggattgcccatacgtatattgcacaagaaaaattagaaaatgcagccaaaaaagcaggacacgagatgcacatcgaaacgcaaggaacgattggaatcgagaatgaattaaccccagagcaaataaaagaagcagatctcgtgattctggcaattgatgtgaaaataagcggcagagaacgatttgaaggaaaacgtatcattcaagtccccactgaaatcgccgtaaagtcacccaataaactgatcgaaaaagcacaagaaataattgaaaaacaacttgcttgatcataaggagggaaaaaagatggaaaagataaaaaagttaaatttaaagggacatttattgacagcgatttcttatttgattccaatcgtttgtggagcaggattcttgattgctatcgggatggcgttcggtgggacaagtcaaggaacactggtacaaggtgaattttctttttttgatgctttagcaacaatgggaggcgctggtttagggttacttcctgtagtcattgcaacggggatttcttattctattgcagcaaaaccagggattgctccagggttcatcatcggattgacagcgaatgctattggggctggttttattggagggatattaggtggctatctttctggatttctcgtgttagctattttaaaccatgtgaaagtcccaaattgggcaaaaggactgatgccaacattgattattccctttgttgcttctatcctaggtgggttaatcatggtctatatcattggaactcctgttgccttgtttacgtctattcttacgaatttcttagaaggattaggtaattcgtccttgttgatttttggcggtgtgatcggcttactaagtggcgttgattatggtggaccaattaacaaaacggtttttgcttttgttctcacaatgcaagcagaaggaatcaatgggccaattacagccctccaattggtgaatacggcgacgcctatcgggtttggattagcttactttgtcgcaaaaatatttcggaaaaacatctatacaaaagtggaagtcgaaacattgaaatcagctgttccaatgggtgtgatcaatattgtcgaaggtgtgatcccactagtgatgaatgatatcgtccgaggtgtggttgctacggctattggcggatttgctggtggtgcaacgacaatgatcctaggcgccgatgcaacagtaccctttggcggtgtattgatgattccgacgatgtccagaccttgggcaggcgtgatagcaatcttagtgaatgttcttgtgacagccgttgttttggcaattattaaaaaagatgtgggaaaagaagtcgaatccgtagtggaaaaggaagaagaagatattgacttgggagacattcagattttctaagtccttcatttagtcggggattcaatcattgatttttaaataaaggagtcttatatatgagtaaagttttgttctcaccatctttaatgacgatggatctggataaatttaaggaacaaattgagtttttgaatcagcatgtcgattcttatcatatcgatatcatggatggccattatgtacctaatctgacattgtctccatggttcattgaggaagtgcgaaaaatcagtcatttaccaatgtctgcccatttaatggtcacagaccaaagtttttgggtgaatcaattgatttcacaaaaatgcgaatggatttgtatgcatgtcgaatgtttagatgggctagcctttcgattgattgatcagatccatgctgcaggactaaaagcaggagtcgtattaaatcctgaaacacctattgaaactattttcccttatattgatttagtggataaaatcactatcatgacagtcgatcccggttttgctggacagcgcttcatcgaaagcacattagataaaatcgttgatttaagaaaacttcgtcaagaaaagggatatcattatttgattgaaatggacggatcttcgaatcgaaaatcatttaagcgaattgatcatgccggaccagatatctatatcatcggccgtagtggattatttggtttagacgaagacattgagaaatcatgggccatcatgaaaagagactatgaggaaacaactggaaaaagtatagaataaggaaatagttaaaaaggtgagaggcaaaagtttaagagttacttttgcctctcacctttttgtatgctgatactttttagataattgtacagaaataaaaaaacataatatgttaagatgttaggtttacgaatgagataaactatgttatagtgtgcttgtacaaaagataatatgttaagtaggattttatttttggggaggaaaagtgatgcagaatattatattgattagtcatggcagtatggctgaaggcgtcaaggcaagtttagaaatgatcgtcggaaagcaagatcatgttcatgtcgttgcgttgacgcctgatggggacaatcggcaattcgaagaagaattattaaaaaaaatgaaagcccttaacggctcatccttgattattgcagatcttttaggtggtacgccatgtaatgtagcattaagtaactatctagaatcagaaaatgtggaaattattgcagggatgtctttaccattagtcatagaagcaacgttgaattcaactgctacggtaaaagaattgatccaagcagcaacaattggcattgttgatgtgaagcaaaaaatgaaacaaacagaaatcgaaaaagaaccaagcctaccaaaggataatagccaattgtatgaggcatataaaggaaaagaaaatatcgtgaatgtcaggatagacgagcgtttgatccatggacaagttgcgggcatctgggcgcccagtttgcacacacagcgtatcattgtaatcaacgatgaagcagcagcagattcattacaaaaatcttccttaagaatggcagcgcctacatcgatgagactttcagttttgccggttgaatctgctgcgaaaaatatacgttcaggaaagtatggaaaacagcgtctattcctagtattcaaaaatccaacaaatgtcttacgttatttgaaagccggaggaaagctaacacacgtaaatgttggaaatatgagttataaagagggatcaaaagacataacaaaaagtatcaaagtattagaagaagaaattgatgtgttcgaatcaattgcagcaatggatataaatgtaaccgctcaattggtaccaaatgatccagttgttgacttcatggataaactgagaaattaaataaaaatgaggaggaagaaagtatgcacttagcagcgtatcaaattattcttattacggtttatgcttttattgcaatcaatgattcgcttatttcaaatacattaacacaaccagccatcgcaggtatgatttcaggaatgattatgggagacttaaaaacaggattgatggttggaggtacattgcaactaatgagactagggattgcggctttcggtggggcatcagttcctgattatttcacaggagccgtcttgggaacagtatttgcggttatctctgggaaaggtgcagagtatggtataggattggctgttccagtatctttattgatgttgcaacttgatgtagtcgctcgcttttgtaatgtttatctcttgcatcgtgtagatagagcaattgatgatatgaaaatcaatcgtataccgcgattagtcttatctggctcttttctttggggattatcacgagccattccgattttattgatgcttttagtcggtgatgctgctgtttcaacgatcacagaaaatacaccagaatggttgatgaatggactaaaaactgctggtggggtgttaccagtcgtgggtgtgggaatcttgttgcattaccttccaacaaaacaatatattccttatttactattgggtttctttttagccgcttatttacaagtgccaatgcttggtgtctcaatcgtcggtgtgattgctgcaattattgtatttaaaaaagatagtgaaaaagcagaacatccgacagtgacagccacaaataatggaacatttgaaggaggatatgatggggatgaataaccagaaattaacaaaacaagagctgaatgcgattagttggcgctatattttaggaagtcagctgaactggaactatgaacgaatgatgagttctggctatttatatgggatattaccagtattgaaaaaattctatggtaatgacgaatcacacttacaagatatgatgcgtacacataatcaattcttcaataccaacgcgattttcggaaatttgatcatggggattgatgtggcaatcgaagaagaagatggttacaaagcaaaagacacaatcattgccttaaaaacagctttaatgggttctcttgctggcgtaggtgattcattgttccatgtgatttggggaacgatttttggatcgattgcaggaacattagctcaaagtggctcaattgttggatgtgtgatttgggtcatcgcgaatatcgttttgttatttggacgggctgcgttattaccattaggatacaaacaaggagtcaaacttgtcacaactttgaaaaacaaattatctgcattcactaatgccgcaacagttttaggtgtcacggtaattggtgctttgattccttccgtggtaaaggcaacggtcccatttgtttataaaaaagatggtgtggaattagttattcaagatacattagacgctattttaccctctcttgttccgatgttacttgttttattaacttattggatgttgggacaaaagaaattgaattccacacgagtaatctggatcattttgattctttccattgcattaagtgcgtttggtattttagcttaaaaaaggaaaagtgagatacgtccgttcacatatttgtccaaaaagtagaggttaagcggttttctcattcactaagataaatgtgattttagcctctgtatattcatacaatctgatgagaaagagggagcaaagatggagaaggagaaaaaaggtttgggtagaaggattcttttgatgagtatgcttagtttaattagtttatttggaatgagtatatcaacctttgccgaggaagatgaatttcaaaagatggaagaacgatggaaaagtcaacttgtctttgaaaaagaaagtccggaaaatgagtcattaagagcatatatagaagcgttatcaaaagaagcggaaaatttatatcaaacattggatcaatcacctgaccggacctatctatggccacttgaatcgggaaatacttcttcagcagatttgacgacacaatttacgaaactccagaaacttacttatgcctataagacaaaagggacaacactttatcaacagccagaggttgctgcagcaattaaagagggaatcgattttatgattaccaaaaaaggatatgatgggaaaaagtactatggaaattggtgggattggcaaattggtatcccacaaaaatttgtgaatatccttctactgttgcaccaagagctatccagtgaaaaaatccaacaatatacagctattttaaatcaatatgtacctgatccattccagcaattatatactaaaccacaagattcatttgtagaccttgcatttatccctaacttttcaacgactggtgccaatcgaacagacttatcattgactgttttaggagtaggtattttacaaaaagatgccacaaaaatccatcaagcagtgaatgggatcaaagatgtttttcaactcgtgacaagtggagatgagttttacgcagatggttcctttatccagcataatgatattccttatacaggttcttacaggaatgtactaatcaaaggagtcggacagatttttacgattgtggatgggacttcttatgcagcagcttctgatgacattcacgctttcgtagaaaatgtagagaaggcctttattcctttgatttaccaaggtgaaatgcttcccatggtgaatggacgcgctatttcgcgtgcgccttcaaagacgaaggtaggatacgggtcttcaacgatgtataatttattgattgtttcaaaatttgcaccagaagataagcaaaaggaactaaaagaagcagttaaatattggatgcaattgaacccttcgtattatataacgaatgtaagagattataatgatctggtcatgacactatccttattagaagaccagacgattttagggaaggatttaccattcatagggacaaaaatgtatcataaaatggatcgttttgttcagcgtaccagtaagtatatggtaggaatcagtatgtattcgaaccgtatctcttcttttgaagcaggaaataaagaaaacaaacgtggttggcatacatcggatgggatggtctacttatataatgaggatgatgtacaattcggtaagagctattggccgactgtcgatccttatcgattgccaggaacaacggtcgatacagtccctttaaaagatgaaatctcttcttttacgactgtgcgatcaaatgagaaagccgttggcggtgtatcaaatgaaggtcaggcagtggtaggtatggctctaaataaaactggaacaaagaataatgggacagttttgccaatggatgtcaaagggaaaaaatcgtggtttgtgcttgacgatcaattgattgcgcttggttcgggaattaccggtaacacaaatgcgtctattgaaacgattatagataatcgtttattaaacgatcagtttacttataaagttgtaacagaaacaggagaaattacccagccaaccgaacaaagtgaaaaagaatggttattgttacaatcaagtcaaccagaaacatcgatcggttattattttcctgagaaagaaacagtaaaagtgataagtgaagcacggcaaggtaattatagggaaatcaacgaatcatttcctagtgatgaagtttatcatggaagttatcggaagtttttgatcaatcatggaaaacatccaatcaatgaagcttatgcatatgtgatattacccggagtgaacgaaaaaggtttaaaagaatatgcagaaaaagaaccagttactattcttcaaaatactccaaaaattcaagcagtaaaagtaaaagaatccggttatttgggtatcaatttttgggataatactggtggagaattagatggattaaaaacagataaaccactttctgtattaaagaaaataaacgaacaagaaaaaagttatacgtttgctgatcttgctcatacaaagacgaaaataacgattgaattaccaaatgattttgaagctattcaaagcatgagtgaaggaattacctatgatgagcagatgggtcgctttactattgatttttcgcaaacatcggatacacaaaaacaaattgtcgtggaataaaaaaagcgcacaagaatagaatattcttgtgcgtaattttttatccttattccaatccaatcaaataatcgtcatctttcatcgcttctacatgacctaacaaatagccgtttccgacttgtgagaagaagtcatggttgcttgtgcctgttgaaatcccgttcattacgattgggttgacatcattggcagtatctgggaagagtgggtccatccctaggttcatcaatgctttgttggcattatagcgtaggaatgttttgacttcttctgtccaaccgattggatcgtataattcttctgtataacgttcttcgttttcataaagctcataaagaagattgtacatccagtctttcaacgtttcttgttctgcttcaggtaattcgttgaaacctaattggaatttgtaaccgatataggttccatgtaccgattcatctcggatgatcagtttgatgatctctgctacgtttgccaatttgttgtttcctaaataataaagaggagtataaaaacctgaatagaacaagaatgtttctaaaaagacgctggcaattttcttttctagcggtgtaccgtgtttgtagatttcattaatacgctcagcttttttttgcagataaggattcgtattcgtccagtcaaaaatttcttcgatttcttttttcgtgttcagtgtactaaaaatagaagaataacttttggcatggacggattccatgaattggatattgttcaaaacggcttcttcatggggagtacggacatctttacgcaactgatccataccgctttcagattggacagtatccaacaatgtcaaaccgccgaatacatgtcctactgtatctttttccaattgagacaatgtgcgccaatcatctaggtcatttgaaagtgggatacgtgtatctagccaaaattgctctgtcagcttctcccaagtggatttatcaatgatatcttcaatttcattccagtttattgcttcataatatgtttctgacatgagaatgctcctttaattaaaatatgaataagcgaatctatctatgatattagatcacgcagctttcacattgattgcttccgatttcttctgcatcatcagtaaaggtacgtacataataaatggatttgattcctttatggaaagcgtaatgtcttaaaatattcaaatcacgtgtcgtttgcttcgttgttgtcttccattcataaataccttctgggatttcagaacgcatgaataaagtcaaactcatgccttgatcgacgtgttgttgtgccgttgcataaacatcgattactttacgcatgtccatatcataagcagaagtgtaatatggaatcgtctcattggataaataaggcgctgggtaataaattttaccgattttcttctcttggcgttcttcgatcatgcgagtgataggatgaatgcttgcactcgtatcattgatatatgaaattgagccatttggtgctactgccaagcgattttggtgatatagcccatctttcattactgcttgtttcaaggtattccaatcttcagcagttggaataaaaatcccttcaaacaatgctttgactttttctgattttggctggaattctccagttacgtatttttcgaaataagtgccatcagcataagctgatttttcaaaattatggaaaacttgttttctttcacgagcgatattgttgctttcaacaagtgtccaataattcaacagcatgaaataaatatttgtaaagtctaatgaatcctctgagccatattccatttgttcttttgcaagataagtgtgtaagcccatggcacctaatccaatcgtatgattcagcttatttccgttttggatcggtggtacgacatcgatatcagatgcatctgtaataaatgtcaatgcacgagtcatcgtacgcacagattgaccaaagttagggctttgcatcaaattcacgatatttgtcgaacctaagttacatgagatatctgttcctaatacttcatactcctgtttgccgttgatcacagaaggcgtttgaacttgtaaaatctctgaacataaattactcatgataatcttgccgtcgattggattctcgcggttcgctgtatcaatattgattacgtaaggatagccagattcttgttgtaattttgagatttcattttcaagatcacgcgctttgattttttgtttgcgaatgtttggatttgcaactagacgatcatactcagctgtaatatctacataagagaatggaacaccatattctttttcgacactatatggactaaataaatacatatcttcgtttttacgtgtcaattcataaaatttatcaggtacgatcacaccaagagaaagagtttttacgcgaatcttttcatctgcattttctttttttgctgaaaggaaagcaataatgtctggatggaacacattcaaataaaccacaccagctccttgacgctgacctaattgattagaatagctgaaactatcttcgaataatttcatgactggaacgacaccactcgcagcaccctcgtatcctttgataggagcgccggcttcacgaagatttgataaagtaatccctacgccgccaccaatacgggacaattgcaaagcagagttgattgagcgcccgatagagttcatatcgtcagtgacttgagtcaagaaacaagacaccaattcgccccgacgtttacgtccagcattcaagaaagaaggtgtagctggctgataacgttgatggatcatttcatctgcaagagcaagtgctaattcttcatccccgttcgcaaagtaaagtgcattgaaggctactcgatcttcataagtttccagataagcggaaccgtcgttggttttcaacgcatattgagaataaaatttgtaagcagccataaaagatttgaaagaaaaatgttgttcgtccaaaaattgatatagcttttcaataaatgatggtgaatataattggatgaattctgcttctatatattcttgtttgatcaagtaattgattttttccataatagatggaaaagtcatcgtatttggtttgacattttcttcaaaaaaggcagccaaagcttctttatccttattcaaagggatttgaccattgactggtcgattgatttcattattcagcttgaaataactgacatcttgtaaatttttaagactcatacgtacgcccaaccttcatttcgtatttgatgatgcttgattgcaaatcattgcattgtttttaagctttaaaaaaggatttggaagtttgcgacaaaaactggtgctgtctcaagcccttcaaatccatgtatcttgttttgattcttttagtcatgttagctggcaagtttacgcaactgatcaggacggaatccgataactgtttctgcatcggaagtaatgacaggaacactttggaatccttgtgctttcaaccagtctactgcttccggttgttcatcgatattgacttcttcaaaagcaatttgattttctgttaaaaaacgtttgaccatcttgcattgcatgcaattatttttagaaaagatttttacgttcatgatgagtgcctcctctaaacacattcttattatctataatagatagtataaaactcttagtaaaaaagtcaaacaacaaacactacatattgtgttgtggaaactgtggaatactaagttttgtgtttttgaaaaaaagagctgaaaacaagtatcgtgtgggaaaatagcaaatctaatagagaaaaaattgtggaaaactatgaagaaatatttttttctcatttttatctatcaataataaagaatcgctcataatatcacaagtgtaattgacattctcaattaccgagagtattctatgtgagaatgattctcatttatttgcgtaatacgtgagaaaactagaacatagaatgaaagatttcaatacatgatttatttcacaagagaggaatcaatatgcagaccttagctcaggcaaagcaaaacttcgtttatcaagtcgaacgaatcgaaacagaagaaaaaacaaaacgccatttgcaaaatattggggtcgttgccggaagtaaaatcgtcgtcgtcaatttatcaggcaacaatgccattttactggtaaaaagtcatcgagtggcagtaagtcgggaaatactaagtcagatctttgtcaataaaaagattgcttcctctgaaagctggacctctcttgatcaattaaaagcaggagagactgggatcgtcgtagccatccacggacaaggcgcagtgaagcggcggttgatggatatgggattgacgcgaaatgtaaaaatagtcatccgaaaactagcccctctaggagatccaatcgaactgacagtgcgaggatatgaattgacattacgaaagtcagaggctgaattagtcttggtacaaagggaggaaaacgaatgaatatcgcgttagtcggaaatccaaacagcggaaaaacgagcttgtttaatctcttgactggttcgaatcaatatgtagggaattggccgggcgtaacagtagaaaaaaaagaaggatcgttgaaaaaaaatccgaacattcatattcaagacctacctggcatctattctttgtctccttatacacccgaagaagtgattgcaagagattatttggttcatgaacagcctgaactgatcatcaacattattgatgctaccaatttagagcggaatctatatttaactacgcagttattggatttaggcattcctatgatcattggtctgaatatgatggatatcatcaaaaaagaaggaaaaaaaatcaacctagaaaagctttcctatggtcttggtgtaccagttttaccaatcagcgtattgaaaaagcaaggaatcgaaaaattaatcgaaaagattcaggagtctgcaaaaaaacggctttctattcctgttccctgtacatacgatccgcgtttagaagcagctttacatgaaattgaagatgtactaggagaaaaaagtagcaagaaacgctggtatgcaatgaaatattttgaaagagatcagaaggtgaatgaggatgatgagataacaaattctcagcaaaaagaaatcgaacaactgatccagttgacagagaaactattggatgacgatagtgaaacgattctagtcaatgaacgttatgaatttattacccaattatgtgcactatctgtcgtgtcaaatgattctttccaattatcgatgagtgacaaaatcgatcagattgcaacgaatcgttggttagccttgccaatctttgcatttgtgatgtggctgatttattacttggctattcaaacagtaggaacaatggggacagattggatcaatgatacattgtttggaacgtggctaccagaacatgttggcagactgttagctgaatggcaagtagcggaatggatgcaggagctgatcttgaacggcatcatcgcaggcgtgggagcagtattaggatttttaccgcaattgatcgtattgtttttatgcttgagctttctagaagactgcggatatatggcgaggatcgcttttgtcatggatcgacttttccggaaattcgggctttcaggaaaatcctttattcctatgctgattgccacgggatgtggcgtaccaggggtcatggctactcgcacgattgaaaacgagcaagatcgtcgtttgacgatcatggtcacgacattcatgccttgttctgcaaagttgccgattattgccttagtagcaggggccttttttcctcaccaatcttgggtagccccttctgcctattttcttgggatgactgcaattattttctctggaatcagcttgaaaaaaacgcgtttgtttgctggagaaacagctccgtttatcatggaattacccacatatcattttcctcaatggtcaacgatcctaagacaaacctatgaccgcagcaagtcttttgttaaaaaagcaggaacgattatctttgtttctagtatcgtgatctggtttagctcttcttataatttttatgctcaacctgttcctgaagaccaaagtatcctagcctttttcggacgaatcctggctgttgtttttcagccgcttggttgggggaattggcaaggaactgtcgcagcgattacaggattagttgctaaagaaaatattattggcacatttggtattttgtttggacatgcggaagtatccgaaaatggtagagaaatctggcaagtgctacaacacacatatactcccgcagcagcttattcattgttagccttcaatttactttgtgcgccttgttttgcggcaattggggctatccatcgggaaatgaatgccaagaaatggacttggatcgccataggctatcaatgcggtttagcttatttagttagttttgtgatctatcagttgggacacttattggagggtggacaggtagcgtcagggacgtatcttgctattttactgatgataggactcgtttatgttttgttccgccagccaaaatccaagaaccagttttatactatattgtcattagaaggagaggaataggatggcgacattcttattaagtgtattaatctttggaagtgcaggagcgattgtctatactcgtttaaaatccggaaagaattgtgatgactgtcaaacagcctgcccagtaaaaaaggaacagatcaagcgatgatcagtcgttgcaagaggctgttctccccttttttgcttattttgctagagcatagtaagatgagggaaagtaaaaaaagaaagaggaaagaaaatgtctggaaagaaaaaaatcgtccgcccgcgctatcagcagattgctgttgatttagccgaacgtatcgttgaaaaccgatataaagtgggtgagaagatccatgctcgctcaacgcttgccagtacgtacaatgcttctcctgagactacccgaaaggctatcaatgtgctggtagatcttgggatcatggaagtacggcatgggagtggggcatttgttgcctcgaaagaaaaagcaaaagatttcctattgcagtatcaagatgtacaatctatccaagatacaaaagcagaaatcatggcgagtgtggagaagcaacaagatgagctgaatcatttttctcaattattggatcagctggtcaatcaaacgaagcgaatacataagatgaaccctttacttccgtttgaattgtctttatcagaaaaagcaatgcatctggaccgttcgattagcgagttgaatatctggcaggcgactggtgctacagttatcgcaatttctcataacgaagaactacttgtttcacctggaccttatgctaaatttacggcaggggatatcgttcattttattggaaatgagtatacgctacagcgtatgacaaactttttttacccggaacatcagcttgcagaatgattgtgtgaaatattataaaaatattaacttggctaaaccttttatttataaagatttaaccaagtttttttctgtttagacaagcaaatttctttcatttttgacaaagtgactacatgatgttaacatagtgtggtcacttttttcagaaagaaaaatgaatttacataaaaaaggagaatttgtttggtaaaagtagaagtaaaacatttaacaaagatatttggtaaaaagacacaagccgctttagatatgatgaatgatcaccagccgaaaacggagattttaaagaaaaccggtgcgacggttggtgtgtatgacgtgaattttgacgtaaaagaaggagaaatcttcgtgatcatggggctttccgggagtgggaaatccacattgatccgtctattgaatcgtctgatcgaaccaacttcgggcagtatctatattgatggagaagatgtatcgaagttaagtaaagaagaattgcgagaagtccgtcgtcataaaatcaatatggttttccaaaacttcggtctgtttccacaccgaacgatcttggaaaatacagaatacgggttagaagtccgtggtatacctaaagaagaacgacaagaaaaagcagaaaaagcattagaaaattctagtctgctttcatttaaagaccaatatcctaatcagttatctggtgggatgcagcaacgggtcggcttagccagagctttagcgaacgatcctgagatcttgctgatggacgaagcgttctcggctcttgatccgctgatccgacgagaaatgcaagacgaattactggacttgcaagccaatgttcaaaaaacgattattttcattacccatgatttgaatgaagctttacggatcggggacagaatcgcgttaatgaaagacggcgaaatcatgcagatcggaacaggtgaagaaatattgaccaatccagcaaatgattacgtacgtgaatttgtggaagaagtcgatcgttccaaagtgcttactgctcaaaacatcatggtacctgcattgacgacgaatatcgaatctgatggaccaaatgtcgcattgacaaggatgcgtaatgaagaagtcagcatgctgatggctgttgaccgaaagagacacctgaaaggaatcattactgcagatcaggcgttagaagctaggaagcaaaaacgtccattgatcgacttcttagatgaaaatgtgacggtgatcggaaaagacatggttgtaagtgatattttcaatattatttatgattcaccgactccgcttgcagttgtagaggatggaaaattaaaaggtgtcgtcatccgaggtagtgtgattgaagcattagcagaaacaagcgaggtgagtgaacatgaataatctattaaactatcaattaccagtggcaaactgggtagaaaatatcacagaatggtttacgacaactttttctggcctattttcatttttacaaacgatcggacaggcagtgatgacggggattacaaatttactgttagtgattccagcgcctttgtttatcttgttattgacgatagcagctttctttatctctaagaaacgtccaggacttacgttgttcacgttgattggtctatggtttatttataaccaaggtctatggaatgacttgatgaatactgtcacacttgttcttttatctagtgtgatctcaatcatcataggtgtaccgttagggatcttgatggcaaaaagcagtaaagctcaaagcatcatcaagccgatccttgactttatgcagacgatgccaggattcgtttatttgattccagcagttgcatttttcggtatcgggatggtgccaggggtatttgcctcagtcatctttgctttgccaccaaccgttcgctttacgaatttagggattcgacaagtaccgaaagagttggtagaagcttctgattcattcgggagcacaagtcgtcaaaaactattcaaactagaattgcctttagctaaaagtacgatcatggcagggatcaatcaaacaacgatgctgtcactttcaatggtcgttattgcctctatgatcggtgcacccggcttaggacggggagtattgtccgctttacaaagagcacaagtcgggaatggatttgtcaacggggttgcattagttatcttagcaatcatcattgaccgttttacgcagcatttgaatcagccaaacaataagaaagttgcaggagctgcaacacaaaaaagtaaaaaacgtcaaggattgatcattggtgctgtagtagtagtgatcttaggtgcgattggtataggaagtttttcttctgccaaagaaacaaaacgtatcaacttgtcttatgtcgaatgggatacagaagttgcttcaacaaatgtagtcggtgaagtattgaaacaaatgggctatgatgtaacgatgacaccgctagataattcaatcatgtggaaatctgtttcaaatggcgagtcagatgccatggtttcagcttggctacctaaaactcacggttcacagtatgcacaatataaagatcaagtcgaagacctaggtgccaatttgacaggagcaaaagtcggtttagcagtaccagcctacatggatgtaaattcgatcgatgagttaaccgatcaggcaggtaagaaaattataggaattgagccaggagctggggtagttacggctgctgaaaacacaatcaaaaaatatgacaacttgaaagactggaaagtcgagacatcttcttcaggagcaatgaccgttgcactaggacaagcaatcaaaaaacacgaaccaattgtagttacaggatggacacctcattggatgtttgccaaatatgatctgaaatacttggaagatcctgaaaacggaatgggaagcgaagagcagatccatacgatggttcgaaaaggattgaaagaagaccagccagaagcttataaagtattagacaatttccattggtcagaaaaagatatggaaaaagtcatgttggaaatcaacaatggaaaagatccacagcaagcagcaaaagactggatcaaagagaaccaagaattagtcgaaagctggaaaaaataaaaaaggcggaaacaaaataaatggagcttccaaaattggatcaaaaatccagttttggaagctccatattcgtctgtctctttttttgtctataaaaaagagaatgcgcagttcatcttcgaaacgtccgaagacgccgacaaactaccattctcgtgggtttggcacccaatgggccgtgaggggctcgaacccgcgacccgctgattaagagtcagctgctctaccaactgagctaacggcccatacaaaaagtacttaataatagtagcactaagaattttaaaatgcaagactacatttaaagaaaatcagaaaaatctttacttccttataggaaatcattcatagattattcacatttgctcgttactatataagcataccaacaaacaaagttcttgcaagagaacaaaccctaacacttttttcattttttactcctttcccgccgtctccccggcgggtctcctgttcttaacgataaaagacaagaaggcttggccttcttgtttttttgcttttataaaattccattaattaaatcatctagttaaaacaactagattgaatgtttatgataactctggtatcatgttaatgaaatgaaaaaggagcggttacgatggaaaaaatgcgtcagcaattaatggagtggggaaaagaactggaaacattccgtctgcctcactgggaagagctccccgacctagaactttatatggatcaagtcagaacgttagttgatcgttatctttcacctgtgatacaaggagaaaagcatccattgctgacctcctctatggtaaacaactacgttaaactgggattgataccagcaccagttaaaaaaagatacaacaaagaacatgtagcatttttacttgcaatcactacattgaaacaagtattgactattcctgaaatcaaagaaggaatattgttccaaggaaaaacagtggggattcgtgaagcttataatctattctgtgatgaacaagaagcagctgtatggatggtcagccaattagcacaaggcaaatcccatcccaaaaaattcgaccaagcgacccctgtagaatatattgctgtaagagcagcaactttatcgtttgcaatgaaacttcttgcggaaaaaacgattgttctagaatccgaatacttaaaagaggagaaaacaaatgaaaaatgataaaatcgcgattttagtagattctggtacggacgtgccagaagaattgataaaaaaatatgagatgtacatgattcctttgaaaattatatataaagatcaggtatatacagataaaatagatattacacctgaagaaatctatcaacgtttgccagaggaaattccaggtacatctttgcctgacggcgagtcgatcgcagaaatctttgagcaaatcaaaaaagatggttatgaaaaagtacttgcggtaacgatttccagcggattgagcgggacgtataacgtagttcgtttgattgcagaacagcaagaagaattggaagcgtatgtactagatacgaaaaatatcggtattggtgcgggtttttctgcaatacaagcagcgaaatggttagaagaaggtgtcgagtggaatcagctgatcagtaatttgaatgaattagtcgaaagaacaaaagttttctttaatgttgcgacattggaatatctccaaaaaggtggacggattggtttggttgcttctattttaggaaccgctttaaagcttaacccaatcatctcctgtaatgatgaaggaatctattacacagtaggaaaagctagaggacgtaaaaaaagtttggataagacggttgcttacgtcaaagaaaaaatcggcaatgccaaggtttttaacttagccgttgcccacggtgatgcgaaagaagaagcgattgaaatggaagcgaggctcaaaagagagttcccgcaagcaaaccaaatctactttggtcaaatttctccggcattagtagtccatactggtccgggattattaggtgtcggcgtacaagttttagaaggataaatcaaaaaaggaaaacagtgaggtgaaaatcagtgttttccttttttattgaagttagaacaaaaaaagaaagtattttgcacgcccatgttaattttctcttttgttttataggcaaagatgaaacaaaaccagaaatacggtataatgaaaaggtgtgacaataatatataagaggtggctctttatgaaaaaagttttagttgtcgatgatgagaagccgatttcggatatcgtcaaattcaatttagccaaagaaggctatgatgtttatactgcatatgatggggaagaagccttggaaaaagttgctgaggtagaacctgatttgattttacttgatttgatgctacctaaaatggacggcttagaagtggctcgtgaggtacgcaaaacttatgatatgccgatcattatggtaacagccaaagattctgaaattgataaagtcctaggcttagagttaggcgccgatgattacgtgaccaagccattttccaaccgagaattagttgcacgtgtcaaagcaaatcttcgtcgtggtgccacggctgcgaaggaaccagaagaggcagcacctgctgaattgacgattggtgatttgacgatccatccagaagcttacatggtgacgaaacgaggagaaacaatcgagttaacacatcgcgaattcgaactactcttttacttggcgaagcaccttggacaagtgatgacaagagaacatttattacaaacggtttggggttatgattattttggagatgtacgaacagtggatgtaactgtacgtcgtttacgtgaaaagatcgaagataatccaagccatccaaattatttagtgacacgtcgtggtgtcggttactatttgcgtaacccagaacaggagtaattggatgaaaagaaaagtccgcttttttcgatcagtcaattttaagatcgctattacctttattctgattttattgatctcgatcgaaattattggtgcctactttatacgtggtttagaacgttccacgatcaatacatttattaaagatatgaatcaaacggtggaatcattagcaacaacaatcagtccggaattgaatcgaaaagataatgcagatgatgaagaggtaaatgcgaatatcaagagatttattgaaaacagtgcgactagcgatatcatcgaaatacgggtcgttgacgaaaaagggatcatccgaggaacaaccgatgtcaatgaacaaagcgctgtgggaaagaaaaatgattatgtcgatatcaatgatttcacaactaaacggtatgttgctttagataacgacgataaacgggtgaatatcaatgttcaaccgatcctgtccccgaccggcgatgccgttatcggggctctttacgtcaaaagtaatatcgaacaaaaatattcggaaatcaataatacagcagtcattttctttactgcctcactgattgctgcgtttatttcaatgatcgtctccgttttagtggctcgttcgattactcagccaatcggtgaaatgagagaacaagccattcgaatcgctagaggagactacagccggaaagtcaaagtgcatggacaagatgaactagggcagttggctgataccttcaatcagttagctgaacgtatcgaagaagctcaagatacaatggaggctgaacgcaatcggttggatagtgtgctgtctcatatgacagacggcgtcatcgcgacagatcgcagggggaaagtcattacaattaatgatatggctgtttccttgctagatgtcaaaaatgaggaagcaattggacaatcgattttgacacttttggatatcgaagaagaatataccttgcgtaaattattagaagatccaaacgaaatggtacttgaccgttcaaccagtacattggagagcgatcagatgatcttacgagtagacttttccatgatccgtcgtgaatcaggttttatcagcggattagtagctgtcttgcatgatgtgacagaacaagaaaaaacagaacgggaacgccgtgaattcgtttctaatgtttcccatgagcttcgtacaccactgacaagcatgcgcagttatatcgaagcattgagcgaaggtgcatggaaagatgaagaagtagcgccaaattttttgaaagtaacattggatgaaacagatcggatgattcgaatgatcaatgatctcctgaatctatctcgcatggatacaggaaatacccagcttcaattagagtatgtcaattttaacgagttagtgaattttgttcttgaccgttttgatatgatggtgggaaaccaagaaaaaaattataagatccgtcgtgaattcacgcaaagagatctttgggtcgaagtagatacagataaaatcatccaagtagtcgataatatcatgaataacgcgatcaagtattcaccagatgggggaacaatcacttgtcgcttattagaaacgcataataacgtgattttaagtattaccgaccaaggattggggattcctaaaaaagatctgaaccgtgtgttcgaacgattttatcgagtagataaagcacgtgcaagagcacaaggtgggacaggacttggattagctatttctagagaagtaatcaaggcgcaccgaggcgctatttgggcagagagcaaggaaggaaaaggatcgactttttatatctcgctgccatacgaaccttatgaggaggaatggtgggaatgagaatttctgaaaaagtcgttcgcgtaggacttattttgatggttgcattaagtttatatttctcttatgccatctggctgagtccagcagggaaaagttcgatcagcgtcgatgagacaaacactcaaatgatcgagtctcaaagcaatcggaaaacttctgaagtttttcttccgcttcatgtcacatggcaccattcgggaatgattcaagaaaccaacagtgaaaatctcgtgtaccgattgcaattgatcatcgataaagcaagattcgggaagctttctgaagtcgtttcgggagatgaatcacaattcgaacaagtgaaaaatctgtcatctggtttcgagttggcctataatgcgccttttttgctaagagaatataaggaagcatttgatttagatgtagacgtctcgaatttggcaaaagaaagcgaaaatatgtattttactagaatacaattcgatcaaggaaacaaaaaaatccgatttttgaattattcgaaccaccttgtatatgaagcgaatatttcattaaattgggaggatatcaacaaagaattaacagcaaacgacacgaaatggacagaaatgtcaacagaaccgtcgacgatcgacacccaatatgctacgaaacattcaatcaagttgaaaaagtatagctatatcctttcgcagcaaccctatacactttttagaaatgcttttttccagaaaccagatagcgtgaagaataatgatgaaagcaatgaattgattttttacggtgggaatgaaacgatgtctatccattcggaaacgcaagtagttgattttcgaggagagctgccagagaaaaaagaaaatgctagtgtattttctgaaagttttccctatattagcaaattaggcagttctttagggaatctcagatattttgaccgcagtgacaataccatcgattaccggatcttcgtggaaggcttcccggtttttgggacggacagcagaggacaaattggtgtggaagttggcggtgaaacgaacggttcggtgcaagtgaatatccaaaccagtttgaatacgattcaagtaccgataccttcagatgaagaagtagaacttgcaagtacgaatgaaatcatccagcagctggaagctaagggagcagatagcaacaagattggttcagtaatcgttggctatacatggcaaaatgttaaagaaacgaatcgcgtcgttgatctcttacctgaatggtatgtgaagtataaagataactggtattcagctaacgaccttctggaaaaattacctggattggaggcgaattaattggattttaaaaaaatcgaatggatatttttcgtcgcttttttagggttgaatgtgtttttattcagcagttatcatgatgcggtataccaagaaaacaatgttattcgttctgatcagactgaatcaatccaaaaacgtctggctagtgacgatatcacttatacggggaagatttcttctgagagcaagcaaggctattatcttagcgcggaacagaccaatcttagcacttcattagcaaattatcgcaaggctggtaaaagcggattgttggaaagtggcgtgtttttagacggcgatgttttgacaaaatccttatccagctcagaagctgaaaagaacgtgattgatccagataagatccgcagttctttggaagattttttagctaacaaagacaatattttgttcggtaatgagtatgtgtatacgaaaaacttttctcatttagaagaagaaccactagaaatccaagcaagccaagagtatgaaggtattccgttcaatgatgatacagcaaaaatcgttctttctttagaaaaaaacgataacgattatagtatcacgaaatacatgcagacgcatttatctgatatcgaacagctgcgtgaaaagacggaactgtatacagaagaggaagcaatcaatacattgtacatcaataacaaaataccaagaggatcaaaaatcttatggcgtcaactagcttattcctgtattctgaaagtccgggaaaaaaatgtgtatgttcctgtttggcatgtagcgattgaaacaagtgataaagtggttcaaatcgagagcgtcaacgctttcagcaatacgatcgtgacaaacaacactgtaccaaaagtggaagatcaataaaaaagcgagtataatgaaaaaagtttacaaagtaagaagggaagtaggagtcaaatggctgaagaaaaaccagcttttaaaatcagtatcctagcaagtggaagttcgggtaattcactttatatcgaaagtgaaaaaaaacggcttttggtcgatgcaggacttagcggtaaaaaaatcacttccttgatggctcaaattgatcggacaccggaccaattagatggaatacttgtgacgcatgaacatcgagaccatatacatggtgtaggtgtcttagctcgtaagtatcatttggatgtttttgccaatcagcagacttgggaagcgatggagccactgattgggaatgtaccagtggaacaaaaacatctatttgagatgggaaaagtaagaacattcggcgatatcgatattgagagtttcggcgtctcccatgacgcagcagctccgcaattttatcgtttccataaagaaaaccattcattcgtcatgttgacggataccggatactgcagtgattacatgcgaggtgtcattgaaaatgccgatggttatttgatggaaagtaaccatgatcttgagatgttacgcatgggaccttatccgtggaatctaaaacagcgtattttaggagatagagggcatctttccaacgaagatggtgcacttgtcatgactgatgtgatcggtaatcggaccaaacgaatctatcttggtcatcttagcaaggaaaacaatatgaaagaacttgctcatttaacgatggaaactgttttgaaagaaaaagattttggtgttggacatgattttgaaatctatgatacagatccagatgaagcaactgagctattttcgatttaaacagtgtagtcaataaaaaataaaaacagaagataaaatcaatcagtgttggttttatcttctgtttttattttttcagatcattgacaaaacaatcgtattatcggctgactacactgatgtgctgtttttcatgttgtttatccagtatctcatctactaatgcaatcgcgtaatctgccatgctgatcgtactgtcgccagcagcgtttttttttaaataatcatcacttaataaataagtgcctgtacgcttgccgtgtggatcaaataaagaagctggactgatataagtccactgtagatttttagattgtttcaattttaacaatccttcgtacatattgaaagctgttggatagaagggtgcatttttaggtacttggtcaatcatacgagtcgtcttttctgtatctaagaataacgaagaggcacccccaacgacaattaagcgtgtatcggttccttcaagtatctcaatcaaatgggacaaagaagtttgatgcatttcttcttttcctttaggagcgttgaaagcatcaacgacaacatcaaaagatgcaaggtcagtagctgtcaactcaaataaatccttttgtataaacggaacatctgatggtaatttttctggatgacgcacaattgccgtcacatctaaatctctggataatgcttcgtctaaaataaatgaacctgcatgaccagtagcgccaatgattgcgattttcataaaaaaacctccttttttattcctgtccattgtaagaggttactggatattcgtcaaagcgtccgttttttgaaaagcttagtgcgcattcctttcatggttcgtgatcattgggtatagttaaattaagaaaactagttgatcaaatagaagatgaaggagataagaaatgaaagagtggttagatcgtgcctttttaccaatggtaacatctgttgtgaatcttagacccttaactgctttacgtaatggaatgacttatacgatcccgataattatagttggctcactgtttttcttatttgctcattttcctgtagattacatcgctcggtggatagataaaacaggattttctatgtattttacacaagtataccaggctacatttgacgtgatagccttttggatcgtttttgctattgcgtatgcttatgcaaaagaagaaaacatcgatcgcttgccagtcgggatgacagccttgtctgcttacctactacttattcagccacttaatgttcaggtagagatagataatatttggacaggcggtgaagggatactaggagcagttgctactgggctcctcattggatggggctatgcacgtttagcaagatttgcgaaagggtggaggcaaaatgggaagattcctgaaaatgtttggcagtcttttacttcattgattccaatacttgctatagtcacttttacgcttataggttcagcggtttttcaacagttgttcgggatgactgtcattcaaggaatatggacgtacgtccaacttccgatccaatcgttgatagacacgttagtcggtgtgcttttattaggtttttttgtcccgtttttatggctatttggtcttcatggatctgcgatggtcaatgggttggttagtccgatcttacaagcaaactcattagcaaatgcagaaatcttagcctctggaaaagaattgactgtggcaaatggcgggcatatcgttactcagcaatttcttgatcaattcatgactgttaccggagcaggtttgacgttaggggctgtattttttatgacgttttttgcgaaatccaggaaataccgagaattaggaaaactttcacttttaccagcctttttcaatatcaatgaatcgattattttttccacaccgatcgtgatgaacccgatgatggctgctccttttattttcgcgccgatcctctcaggattgattacctattccgctttatattttggattcgttcctttatttacagcggtccaagttccttggacaacaccgccgatcctctcgggttttttagtaggcggagtgcctgcagcgattttacaaggtatcgtgctggcaattagttttttcatttatttcccatttttgaaaaaaatagattctgcaaacttcaaaaaggaaagacagacaaaaaatgatggaacagcagaaaagattatcgactaaaaaaacaaaaatactcctgtcgctttagattggaaaaatcaccaatctaggatgacaggagtatttctaatcatgtttataccagtcctttttggacagctaattgaacaagaacaactaatgtgttcattcctacgtgtgtgatcatcgatgtccagatccgaccagtcgctttgtactctaggctgaagaagaaacctaagaaaaagtaaattagcaaatgaccgtcattatgagcaaacgcaaacagcaaagagctgaccactgccccaacccaaaaatttgaataccgactgatgatccctagtatgctgcggcggaatacgaattcttccatgattggtccggcaacagttgtcgccaaaataaaagcaggtgcttccatgatcatctggatgatattttgtgtattctcagaaggggttgcttcgccaaacaatatagattccaacatgacagcgatgctttgcagaatcaatgcgacaaagattccaactaatccataaataacgatctttggaacagaagctttttttactgctgattcgattgctaacggttcacgttgcttaaaataaaaaatagctaggataactgcgcccagtatatacatgactgcagttgctgtgatcaattcagacgtagattttacaagtcctatcgaagctaagatcaagggtgagataaaaattagaccatagcaaaaaatgctgaggaaactatatttttttaaagacatgtaattcctcctttaagggataacaagcatgcaaggcaagcttttatcggttgattttaattatatcataatttcaataaacaactgtcagaataaaatttcttttctttgatttaaaagcttgcaaaaaagagggagaatgagtattattaaaaatgtaggttagcactcgaaggttaagagtgctaacggattaaaaaaagagttatcggagggatttatcgtgttaaaaccattaggtgatcgcgtcattatcgaagtcgcaaaagaagaagaaaaaactgtcggaggaatcgttttagcttctgcagctaaagagaaaccccaaactgggacagttgttgcagtcggtgagggccgtttgttggaaaacggtgaaaaagttcctgccgctgtgaaagcaggcgaccaagttatgttcgaaaaatacgccggtacagaagtaaaatacgaaggaaaagaatatctgatcgtcgcaggaaaagatatcatggcgattgttgagtaaattttgaagatagaaaaaataatcaaaaataatcgatgaggtgaatcaatcatggcaaaagaattaaaatttgcagaagacgcacgcgcagctatgttacgcggggtagataaattagcagatacagtgaaagtaacattaggacctaaaggccgaaatgtcgtactagaaaaatcttacggctctccattgatcacaaatgatggtgtgacgatcgcaaaagaaatcgagttagaagatcattttgaaaacatgggtgcaaaacttgtatcagaagtagcatcaaaaacaaatgatattgccggtgacggaacaacgacagcaactgttttgacacaagcaatcgttcgcgaaggtttaaaaaatgtaactgcaggtgctaatcctctaggcattcgccgcgggatcgaattggcaacaaaagccgcagtggaagagttgcataatatctcaactgttgttgattcaaaagaagccattgcacaagtagcagctgtttcttcaggttctgataaagttggacatttgattgctgatgcaatggaaaaagttggaaacgacggtgtcatcacaattgaagaatcaaaaggaatcgaaacagaactagatgttgtagaaggtatgcaatttgatcgtggttacttatcacaatatatggtaacagataacgacaaaatggaagctgttctagaaaacccatatatcttgattacagacaaaaaaatctctaacatccaagacattctgccattgttagaacaaatcttgcaacaatcacgtccattattgatcattgctgacgatgtagatggcgaagcattaccaacgcttgttttgaacaagatccgcggaacattcaatgtagtagctgtaaaagctcctggcttcggtgatcgtcgtaaagcaatgcttgaagatatcgctattttgacaggtggtacagtaattactgacgatctaggtctagaattaaaagatgcaacaatcgaaaacttaggaaatgcgtctaaagttgttgtagataaagacaatacaacgatcgtagaaggttcaggagaaaaagaagccatcgaagcgcgtgtgcaattaatcaaaaaccaaattgctgaaacaacttctgattttgatcgcgaaaaattacaagaacgcttagctaaattagcaggcggtgtagctgttgttaaagtcggtgcagctactgaaacagaattaaaagaattgaaattacgtattgaagatgcattgaatgctacacgtgccgcagtagaagaaggaatggtctcaggcggtggtacagctctagtgaatgttatcagcaaagtttctgctgtagaagcagaaggagacgtggcaacaggtatcaagattgttgttcgtgccttggaagaaccaattcgtcaaatcgctgaaaacgctggttatgaaggatcagtgattgttgataaattgaagaacgtagaactaggtactggattcaacgctgctactggagaatgggtaaacatggttgaagcaggtatcgtagacccaactaaagtaacacgttctgccttgcaaaatgccgcttccgtttctgccttgttattaacaacagaagcagtcgttgcagataaaccagaaccagcagcaccagcagctcctgcaatggatccatcaatgatgggcggtatgatgtaagaaaagcaccttgcttatctagcgtagcccattatttgaggaagatagataaaaaagtagaaaaggaagcaaaatatttccttttctactttttttgtatatccattcataataattgttatttaaagggtatcatttgcttttgcgagtagttggaaactatactatttataaaggatcatgcatattttttgaatttgcatagttatttattttatctgctaaaaacagatagccagataggaataactatgctatatttataatatcattataatgtatgcgtattcaaaacggagcttcggtaacaataaaaacaggaggagaaaaaatgaatggattaatgagttggatggagaagtatattttgccagttgcaacgaaaatcgggtcggagaaacacttggttgcattgagggatgcttttattggtacgatgccagctacgatggcaggagcaattgctgctttactgaacgcatttatgcgggattttccgaatacgtatctaggtgaagggaatgcgatcacgacattttttaccccagtcattggcgtaaatggattgatctggaatggtactttagctattatggcagtggtctttgccttatcactaggagcgaatctagcgaaagcctatgaggtcgatcctgtctcaggaagtattgtttctctggttgcgtttattattggcttacccgatgcagcaacagcggtgttgacattgcccgagaagctttcgcaagacgcagcagatttgattacttctgcaggtggtgtgattgctggaacgccagacggaggacaaacgttatcagtaggcgcatggggctattttaattttggtaaatatatgggtgggtctggtttgttcactgctatgatctttggatttatttctgtcattatttttgcgattctgatcaagaaaaagatcatcatacggatgccggatgctgtgccacctgctgtagcaagagcttttgcggcgattattcctgcattagtttctttatacgtcgttggtgtgattaattatatctttagacaaacagctggtgagccgctgattgactggatttctgaagccatacaatctcctttgatgaacttgtcacaaggttatggagcggtctttatcattgttcttcttgtgcatgttctttggttttttggtcttcacggcacaaatatcatgtcacctgttttgcagaccttatatggtaccgcgatggtcgaaaacacgaatgcctttcaaaataatgagcccatccctttcaaatgggtggcaggttcttttgaagcttttgtctggccgggaggagctggagtcacgctggtgttgatagttatgattttatttttatctaaacgggcagattataaaacggtaggaaagttagggattgcaccaggaatcttcaatatcaatgaaccagtgatgtttggtcttcctgttgtgttgaatccgctgttgatgattccgttcatcttggcacctcttgcgactgcaacgatcgcctattttgccacgatggccgggcttgttcgtccggttgtagtaaatgtgatttgggtcatgccaacgattatcagtggatttttagctactgcgggagattggcgagccatcgttttaacaatcgttaatttaatagtagctgctttaatctgggcgccatttattttagcagcaaaccgcttagatccaaatttaggtgaaccagaggaatagaatttttctattgcaaaacaaactccttgatatgagacgcgtttcatacactatactcaaagtatcaaaaggagggcttgcaatgaatacctatgtagagataacagatggcacaacgaacaaatatttttatgcgtttgtcgagtttaagggatccatattaacgttgtacagttttcaagggctgaataagaatatagtaaaagaaataccaatgaatgaaatcgaaacgttgacaaaagatatatattggggtggacagcggatcagtttttctcatgatggaaaaatgtatcagttttttgaatgcggtccagctgtggtagactatttacaagaaaatctttttgtataggtggcgaagcagcagtggcaaatattcgagatatcgcaaagctcacaggttattcagtttctactatttcacgtgtgatcaatggacatccatatgtagatgaggaaaaaaggaaagaaatacttgcggtcatgaaagaagtcgattatatccctaatgcaaaagccagacagttgagttatggaaaaacgaaaagtatcggagtaatcttgccttataccaaccatccgtactttgatcagctgatcagtgggatcattgaagaggcgtttgactatgattacaaagtgacgcttttaccgacgggttatcagaaagaaaaagagcgaagctatcttgaagaatttgcagctaaagcgtttgatggattgatcatcacatctcgtgccaatacactagaagatttgctagattatcaaaaatatggtcctctagttttttgtgaagaaatcaaggaaaaacaggcaagttgcgtctttattgatcgagaacaatcgattacagaaggtctttcttatttgaagcagcaaggggtaaaacgattgggcatcacattggggcgaagtggcaggctgagttataattcaaagattactttgcaactatgtcgtcgactttttccgttttttgatgagtcacttgttttttgggattgcatagatgcagagaaaggaaaacaagcaggtatcttttttaaagaccatagagttgatggggtctttacaaattcggatatggtcgcagcaggcatcttgcaaagctatctgcaagataaggtaccagtggtgattggacgcgataatttgctgatcagcgagcttcttggctttccaacgattgatcaccatctggaagcttgcggagaaatggcttttcaattgtttcttacagaaaaaaaggataaagtgaaaataccttacacgtttattcagcgctgaattttggcaaaacacttgtaaaaaatgaatcagacaccaaatgttagtataaaaaatctaactttggtgtctgatgttttgttgttcggtcgtttttgtcggatcatgtaaactgttatgcctttttttggatgatttcatttaatgcttttgctgcaccatgaccacttcgttcgtcataatatgcagtgaatcgttcatcggcttcgtacatcatccctaatcctttatgcgcttccggctgatattcagaccagctgtaagataaccacttcttatgagcttgaaagatgcgatctgctaagttttcatctgtaggagcttgtaaataaagagtgagatcagctaaaatctgcttttcaacagtttgcatttcttcatacgtttctttatccatattcatccatttttcgttggatgctgtaaccttttcttccccgtatttttgtcgaatctcttgtccataagtttcttcattttctttcaatttttgttgtttgaacccttcaaatttttctttatcactcatttttcttcctccttcgtatctatcaagtgtttgttggacagttgccaagaggatgtcgatttgtgcccgtttttctagaagcatctgctgatgttcgattaaagctttctggtggtcaaaatgcggattatctaagatttcttgaatatcctccaacttgaatgccaacattcgataaaataagatatgttgcagacgatcgacttcttttttgccataaatccgataacctgaggaattgatcctagctggctttagcagtccaatctcatcataaaagcgcaaggttctcggactgactcctgatatctctgacattttctttatcgtgtattccattatttttcctcctgacaaatgtaagcataatcctttacgtaacgagaaggtcaagaaaaaagtgtatttttttctcataaaattatgttatactattaagtgataaaaggtaaatccttttgtttttaaaggttcaattgtaaccgattccttaatgttgggaacaacggggaatatatgggattgaatctaaatcgactatatagaaaagaggaatgagatgaagctaatcgaaacacctgtgaatagtaatttaaatattaagacattttatcctaaagtagtagaattcttttttgggaatacggccattaattattacaaattattttcgttagatcggacacagttgctgctagtggacacatatgacaaaaagcaagttgtgatgatcaatacgaagaaaaaaatcacaaggcaagaaatcgactatgcgattcatcacgttttaaaaatgacacgggaagatgtcaaagtccatataggagtgaaacaggagctggaacgtgccggaatacaattcaaacgtccaaataaagatattgtagttgttgaacaaaaaaatacgatggattgatgtcctaacgactaatcatctttatgctaaatcgctccatctttatgatgtatacagtaaaaaagaggttgcgaaaaagctgttctgcatcaagtaataagaacagccaaacaaaaatagttcgtcatattttttgtttggttgggcttattaccacagatgcaagcttttgagcaccgtttaaggaagaggttgtgaaaacagcgttttgacctgtgtattagagaaacaaacggaaaaatagttcctcatattgtgccgtttgttgagctaataccgaggagttggcaggagaacaccgtttatttgggaaaagggactgtgacagacttttgtcgcagcccttttttgcaatccaattatacgaacaattgtggtttaattgacggcagcttttttctttcagttttttttaaaagcaagtgaaacttcttattttcatgagcttttttcaattcaaggtacaacttgacataatctgtctttccttccaaaaaattcactacataataacttctatccgtttctttgggcataagatgtacagaagagacaatcagaaaatcaatgggttgtatttcttcataggataattccttcagttcgataaaggacaagtcttttaaaaaattcttgatatcttgggtaaaaaaataattcgtttccatcactaaagaaacttgtaacttagttgaattttcattgtcctcgcaacattgcaaagtcagccatgcaaatatttcagctaaatcgttgcagcaaatagaaagccattgataattatgtcgccgccccatcttattcaagaagaaggtaaaatgctcttttaaatagtaataacttgatgacttctttttatgaaaataattcattagaaagaagagtgtcggaacacgctttggaaaaagataataacaaaaaagaatattaaataaatgaaggtgaacaatttgattgtgttgaaaaacacggtcatcaggaaaaatctcagtttgccaataattgtcaagttctttcaataatgaagaaagcaactgtccttttttgtcgaatatgtctaaagcttcattaagagtaggattctcatattgaaaggtcggtgcataaaacaccataaattgtgcaaaacgaaattcactatcttgatgagaggagggaatagaaaaatgttcaccaaaaaggcattttattcgatgatcattactaaaaactgcttcgctatagcgagggtcatcctctacatagtgaccttgtgcaatccgctgagtggtaatcccagcaaaaagacaaacttctttttttcctacgaaactccaatttaaagatgtatgcttagtaagttcagccaatttttttaataactcagattttgagacgtaaaaagcataatcttcatttccacgagaagctgcccaaagaatattgaataatatcaagcgaatcaagcgttcgtctcctttgaaagataattgactgcgattaaaaatgacatcgaattcctgtacataatcggctaatgactgcagatgccgcatagcagaagcacgactaatgaaattttcttggcagaattccatcagatttttctctggatagaaaagagaagatttgattgcgcgataagggaggctctgctggataagataggaataataataatcatagtttaaatcagttggcaggttctggttgatcttgttttttgacaataatttgaatccagaaaagcaaaagtcatcaaattcattctccatttcattcaatatattttttacgacactagaagataaatcaagttttttactgatttctttgatagttaattcatgttgctccttcaatagatgaaaaattgctaacttgcggcgttctttctgggtaaacacaatattgaaaaacataggacctcctttttgattgcttatttctttaattaattaaaaatacaaatattttataaactattattcaactccagatcatttctagatacctcttcatttttctttatatccgcttaaattatatttttctcattttttttggttttatttcctttttattgtctcaaatttgaacgataaatacaatttatttgagaaaacacttccattgttcatagattaatgtttttttattaagtttattgctaccttttattatgtatttaatggatgtttacggtattttttttgttattatattttttagcaccctctttctaatgtgtttgcaatcttattttaattaagttaaattttagttatcggataaaagatgagaacgactatatcggagctttttgaaaaaatctcactaatattcaagaaggggaagagaggaaatgaaaaaaacgaaaactgtctcgcattatggcagtgtagtttttatggttgctgtcctatttttatcgcaacttgcgggactgtcgcagatcacttttgccaagactgagtctgaaaaagtagtagctgatgaacatgcgaatattgtgatcgattacgaaatggatgaggaactgaagcagatacaatggagtatgacatatgagaagcatgcaaaagatgaagctgaatatcaaatgcaatttaagctggaaatagttgaacacgaaggattattacttagagaaagcattcaggaaatcgaacgtacctttggaaaagtaggaccagttgatgaggaatggtactacgcaggtgatttttcttcggagaatgagagaattgaaatcgtttttaaaagccacatagtagaagagtataatcaatatcatctaaaaatcacgccaaggctaatgaaacaaacagaggatgaattagtagaagtcttgatcggagaccaagaagaatatactgtcgtggtaactttaccagaaaatatcacagcatctgaaacacaagaaacaagtgagccttctccagagatttctaaagaagtagaatcagcagaaatcccaatagacgattcaatagaagaatcaaaagcagaagcggaagaagtcggagtctatgcagctcctaatatgtcagatcctactctaaatggggcctacgatgatgcgattccgctaaatagtttgtttacgatccctgactatttaacgattgtacgaaatgttccaaattttgtggacaataacaaaagtatccagatgacgccaaatcatattttaactgcactttacaatcgaggacatatggtttcaaagagtcaaaatacgatcagattttcaaacttgacaagagatatccggttcactagctatatgtattttgatacggacacagaagggatctcctttttcttacatgatgggaatcctacgagtttgttatacagccgacgaggaatccacaacaaatatgatcccactgtggttatgaaccatgacgcaaaagcactgggtgcctataaacataaagatcctattggtctatttgacattgatcggcacatggcaaatgcaatggtccttgagttcgataatcaagtatctacaggtccattaggaaatcgagataaatttggagatcaaggtctttctggtgcacatattgcagtggctccttccgatagtcctgctaccaaaactcttataaaagattttgaaacaaataatgcctttgtgacaggtagttggtggcaattggatgtcaacattactccaacagggatccttcgctttttgatgacagatttacgagacggcggatatggaacaacaacaggcgagatcaatatcaatgactatttttccaatctccaatcaaaaaatctttattggggatttgctgcgacggcaacttatactaaagataattacacgacattgtttatgacagagccaaattttgatattcaaggtgaactagtccatgagataacgatgcaaggacaagggggagcagaaaatgcgagtggtcagacagttgctgcggatacagagttggaacatacggttactttttacaacgaagagggagacggtagtatattccttactcctagtaatgataatggtctctcgattttaacttctgatctggaagaaagtaaatcgaaccctttcaaatttacggatatggtcccgataagtgagtatcagccttattttacttatcaaactataagtaataatgacgagatcatagagcatcgagtaaatgcgatgtatgatgactctctacaacgcttttatccaatagaaactatcgagatagaagtaggtacagtattgaagttgaattataaaacaaaagtagaagcagaattccctgggtatgaggatcatgatgtctatgaacgagtatccttcaggggaagaagtctttctccaacaggcagttactatgatacacaggtggaacaagccgttcaatatgcgatccagcgtaagcccaataccccaccggaattagcgaatctaagaacggtagatggacaaatggctgagaaaactacgtttactgatttcaaagagcgatttcgttttgcttttgattatggtgacggtgatttggaccgtttgtattatagtgtgtggatcaatggagaagttcttaccgaaaatcaaatgctcctcaatgcacgagaagaacttcaaacacttagatcagcagcattcacgatcgacataaaagatctagagggggtctttcaacgaggtgaaaatacgattactgtaacgctcactgataatcgtattgatgaaccgcttattttggaagagagttttcaggtggaaggttatctgggatttgaattcgtgacagaagaatacagctggaagtatgctcgatcacaattgccaatgaacagacaagcacaagcacgtgaagaaaggatgcgtgttgttactagaaacacattgaatacatcggattcatataaagtaaccgtatctgctgaagaactaaatcatgtggatatgcaacatgcgattagtgaaggatatcttgtgttcaaaaatgaaatgggagaaatcgcactttctgctttaacactggaaattgataaggtttatgaattttcacaagaagaaggcttgttactgcgcctaaacagtcaagatagaacaggagtatattctggaacgatcacgtggaaaattgaagatgtgttatagcaagaagctagctttgaaagggggggatcgtatggctggctagatactagaaaaaaagtggaaaggagaaaacaatgaaatcaaaaaaccgatactggatgatttctgttcttcttctactcctgttctcgttatcgatgccagtggtgaatgctgctacccaagctggtgaaacgcatgcagtcatagaaatcaatgaacgggagataggaaagcagactgaaaagggagaagaaaaacagaaaagcagttttccagaggcaaatgaagcaaaggcaggattgatttcatttgttgggacgctgttgattatcggcgttattttagtctatcgtcatcaaatacgtggaggcgaaaaacatgaaaaatagattttcgctagcgttatggagtgcattattcataggaatgtttagctgttcttctgctgttcacggacagaccgagggtgcgacttctctgaaaatcgttcctttgaatgaacaatttccacggatgttatacattgatgatttactgttcgtatcgcgctatacagatgaacacaatcaaatccatcgagagagcaacgatttatcgattacctttcttgattctcgaaaagagagcacagaatggcaactacaactgaaaacagaagacttccgttgtaaaaaagatggccatcttttgactgccgattatcaattaggcagaggaatgttcagcggaaagaacgaagaagctgtcaaaggattggaagctttcgaatatgatcaccaagatgcaggaaaagagtatcgtacgatcatccagtcaacaggaaacaaagaacgtggaatcgttacatatacgattcctggcgagcagtcaacactcacttttcctgaggggacatctagtggtcattactactcgaaacattattggcgatttgtgaatgcagaattttgatgagaaaaaaaggaggacaaaaaatgaaaaaattagtaggggttttaagtacaagtgcgatgttatttacatgttttgcaccaacagtcatggcagcagaatttggtgaaccaatggatggaacgactagagtggagattactgactttttagtagtggatgatcttccaacttacccagggatttttacactcgatgatgttcctgatatcgattttggtgaacatacggtggcgcaaatcagcgcaaatacaactgtcaatggtacttttgatggcgcattgcaagcttccgattttcgtccgctagaagccagcaaaacagaagctttagaattgatcagcgaatacactggtgttgaagatacaacagagctgacagcagcttgggagaatgctgtagttgcgggagactgggtattgacagtcagtgcaacaaacttaacagatgatattgcttctgctcttacgatcaatggagaaaatgtattagaatctgcaacaactcttccgatatcttatgtttccggtacatttgatcatataaatgagctcacatcagaagcgccaacactaacagtcaaagcgaatacaccggttggagagtatactggtacagttacttacacagcagtggattcgatctaacagcagtatttcaagtaaaataatttgttttacttgtaaacaaccgcaaaaggatggagcggataagctaactccatcctttttacataaaatggagggatgaaaagtgagacgacatttagtattggttttgataactttattaatacagctagtttttcctggaatcgtcgtttttgctgatgaaaatcatggagcagactatagtgtccatcctattttaccggacaatcagcgagaaggacgttcattctttgatttacgagtagaacctggaacaaaacagacattacagatccagatcaataatttttctgatcaggagcaaacgtattttatcaatgtcaatacagctcagacaaacggaaacatagtgattgactacggacaaaatgaattaccagaggagtcaatcgttcagcaacccatctgcacattggtcgattatccaaaagaagcagtgatcccagggaataaagcaggagtcgttactttagaagtacaagcacctgatacttcctttgatggaatcttattaggcgggatccaagtgaaaaaagatttttcagctgaaaaagaagaaagtaatcagcctttttttagcaaatacgcttatgtggttgggttgatgatgagcgcaaatgacaaggaagttgtgccggatctgaagttgaatgaggtacgttccgaagtgatcaccaacaatgctggtgtggttgctgtgctagaaaatcctcaaccaatcaatatcaagggagtgaccgttgaagcaactgttcattcaaaaggacaggaagaaccgataatgacacgaaaaatcgaaaatggtggtattgctcctgaatcagtttttgctatgcctatttatcatggggaagctggaaatacgaaacctttagaatcgggggattatcaacttttagtcgaagcacaagatgagacagggcaaaagtggttgctgacaaaagactttacgattacgaaagaacaagcaaactcagtcaatcatgaggtttttactgtagaaaataatacaaattctttgttgtatatcattatcggggccctagcagcggttcttttagtcggtggtttctatgtatatcgcagaggaaagaaattccgcagaaggtgattcatatcgaatattaagtgaaatctggtttataagaagtagcaaaattaagagtaggggctgtgacaaaagtcttgtcgcagcccttttttccggataaacggtgctcaaaagcttgcatctgcggtaataagcccaaccaaacgaaaaataggaggagctatttttgtttggctgttcttattacttgatgcaggacagctttttcacaacctctttttcagaaaataatgaagatttcttttcctatcaattttttttgttataatgggtaggaaatgaaaacttgccaagaggagtaatacaacatgaataatacttacccagacgacagtttgacgctgcatacggatctatatcaaatcaatatgatgcagacatactgggaattaggtcgagctgatttacatgctgtttttgaatgttattttcgagaaatgccttttagccacgggtacgcggtttttgcaggattggaacggttagtcaattatttagagaatctgacgtttagtgattccgatattgcttacttacgtggcttagaagtctatcctgagggttttttggagtatttacaaaattttgaatttaaagcaacggttcgttctgctcgtgaaggtgaattagtttttgcaaatgaaccattgatccaagtggaaggtcctttggcacattgtcagttagtagaaacagcactgttgaatatggtcaatttccaaacgttgatcgcgacaaaagcagctcgcatcaaatctgtgatcggagaagatccgctcttggaatttgggactagacgagcgcaagaattggatgcggcagtttggggaactagagcggcatatatcggcggagcagatgcaacaagcaatgtacgtgctggaaagatatttgggataccagctagtgggactcatgcgcattcgttagtccaatcttatggaaatgattatgaagcatttatggcgtatgctaaaacccataaagactgtgtgttcttagtcgatacttatgatacgttgaaatcaggtgtgccaagtgcaatccgcgtagcaaaagaattaggtgataaaatcaacttccaaggcgtacgtatcgacagtggagatatggcctatatatctaagcgtgttcgggaacaattagatgcagctggatttacggaagcaaaaatttatgcttcgaatgacttagatgaagcaacgattttgaatttaaagatgcaaaaagctaaaattgatgtatggggtgtcggaacaaaactgatcaccgcttatgatcagccagcccttggtgcagtattcaaactagtatcaatcgaagatagcgaaggaaatatggtggatacgatcaagttatcaagcaatgcggaaaaagtgacaactccaggaaaaaaacaagtatggcgtattactcgaaactctgatgggaaatctgaaggagactatgtcacattatgggatgaggatcctcgagaagaagaagctatctttatgtttcatccagtgcatacgtttatcaataaaactgttcgggattttaccgctcgccccgttttacaagatatctttatcgaaggaaaaagagtatacgaactacccgtgctaaacgaaatcaaagaatatacaaaagaaaatctagattcactgtgggaagagtacaaacgagacttgaatccgcaaaaatatccggtcgatctatctactgaatgctggaaccataaaatggctacgatggaacgaatgaaaaaaagtgtagcagaacttcatacagaagcataggaggagaataaatgagcctgcaaacagaaatcatccatgaattaggtgtcaaaccaacaattgatccaacagaagaaattcgtaaaagtattgattttatgaaagcttatttgaaaaaatatccgtttcttaaaacctttgtattaggtattagcggtggtcaagattctactttagcaggtcgtttggcgcaactaacgatggaagaaatgcgtgaagaaacgaaagatgaaagctatcaatttatcgctgttcgtcttccttatggtgaacaagcagatgaagaagatgcaaaagctgctcttgactttatccagcccgatgttagtctgcgagtaaatatcaaacctgctgttgatgcacaagtacaagtattaagtgaagtaggtgtggaaatcagcgattttaacaaaggaaatatcaaagcacgacaacgaatgattacacaatatgccgtagccggagaaagagcaggagctgtattagggacagatcatgctgcagaaaacatcactggttttttcacgaaatttggtgatggaggagccgatatcttaccattgttccgtttgaacaaacggcaagggaaacaattgcttcaagcattgaatgcaccggaaaagctatacacaaaaattccgactgcagatcttgaagatggaaaaccaatgattgcggatgaagtcgcactaggtgttacgtataacgaaatcgatgattatctagaaggaaaagaagttcccgctcaagcacaagaaaaaatcgaagcgtggtggaacaagacgcagcataaacgtcatttgccaatttctgttttggatgatttttggaaataacaataaaataaaaaaacagccgtcccttcatagggattggctgtttttgctttataaaatagaaaagaaaactatcagctgtagtaaacttttaatttgatatcttggtcgtaattaccgaatcctttaccaaataaagtacagccacctacatgttcggcatcttctttcacttcgattcgcaaatgccaagtatcttgatctttagggatgtcgttgatcgtgatgtctgacaaaggttccccattcatatttgtcaaatgtttggtgattcggatcgtcttcagcaagccgtattgattaagattatctggataccaatcaggcgtatatttcccgcggatatcagcaaaatctccagggctcgtccatgttcctagctctacgccatttaggctgaaagtgatatcggaaggccaattgtcatttgaaaaaggaaattcagaagaaatttccacagaaacttccaacatttctaatgtatcctctgcattcaaaaaattaggtgactgatactcgacaaacccgctggtaaaccagaggatacgagcatccatccttcgaggatccacaaaatagcgtggttcatccacttttccgataaagtcatggatcgtcgctaaaccacatgtcggttcaattgcataattcgtatagtgaccaataggtatcgatgtttctttcgtgtcaaaagcattgaatattttttctgggaaactgatatctattttatcgacacgaaggctcgaaattttttgttgtcctattttctctgttttgatgatgttcgcttcttctaactttttcacgtgcatcgtcgtgatcgcgctgcttactccaagttcttttgccaaatctttgacattcatcttctttttggaaagcaactgaatgatcctgattcttgtcttgctagctaatgcttcatataccggtaaggattcctcgtttatttgtagttgcatatatatcaccgcttaaaaggtttttcttctatattaacatatttattaatgaaagctatattgaattatttgatttaatcatgattaatatttacattaattataatgggtaaaaataaatagatttaacatttttattattgacaacgctttcaacagggtgtattattcatgtataaattaaaggaggtcagttatggaagccacaatgttgattagtagtgtcaagcgtgtaggcaaagttgatccgcggttgtatagttcatttattgaacatatgggacgagcggtatatgaagggatttatcagccagatcatccatcagctaatgaaagtggatttcgccaagacgtcattcacttagtaaaagaattgaacattcccatgattagatatcctggtggaaattttgtgtcaggatttcgttgggaagacagtattggtcccatagcaagtagacccaaaaggttggatttagcttggcggacaattgaaacgaatgaagttgggattcatgaattttataactggtgtcagcatgtaggggccgaaatcaatatggctgtcaatctgggtactcgtggggtagatgcagctcgtaatttagtcgaatattgtaattttcctaaaggaacttattggagtgatttaaggtgttcgaatggtcaagagagcccttttggaattaagacatggtgtttagggaatgaaatggacggtccttggcagattggtcataaaacagcagaagaatatggacggttagcagcggaaacggctaaggcgatgaaactcgtagatgattcaattgaggtggttttatgcggaagttctaatcggcaaatgcctacatttggtgattgggagttaacagtccttgatcaagcatatgatcaaatagattatttgtctcttcatcaatattatggcaaccaaaaaaatgatctttctcattatcttgcacgttccttggacatggatcggttcatttctgaagtgacagcgatgtgcgatacaatcaaggcgaagaaacatagtaagaagcagatcaacctgtcctttgatgaatggaatatttggtatcattcagcggaacaagatgagcaagcagcgccttggcagattgctcctcctttactagaagataactataattttgaagatgcattactattaggctgtctattaatcactttattgaaacatgcagacagagtaaagatagcttgtcttgctcaattggtaaatgttattgcaccaatcaggacagaaacaaacggagaagcttggagacagacgatttattatccatttatgcaagctgctatgtatggacaaggagaggtgttaagcccacaaattcattcagcaaactatgcgacggaagattttgaagaagtgccgtatttagaaagtgtagcagtaataaatgacaaagaacttgtcatatttgcagttaaccgtggagaagaagaaatgaatctaactgttcgcttgtctgaattatcagtagcaggagtgattgatttttctgaaatgagtgggtttgatacgaaagcaaccaatcttcctaaaagtgaacaagtaaaaccaagtcattcaacgaatgtaaaagctgaagatgggaaaatcaattgtttgttgaaaccgctatcttggaatgtagtcagatgttatttatcagatgaaggaggaacaaaaaatgaaaggtaaaaaatggttaattggctctttattggtagttgcaacaggtattttaggtgcttgtggtggcggaagttcagcagaatctgattctgataaagaagtgactttgactttttggaatgggtttactgcatctgatggggaaatattgcaagaaatcgttaatgaatttaataaaacaaatgataaaaacatcaaaattgaaatggatatcatgacttgggccaatttgaatgaaaaacttcctacagcgatttcttctaaaaaggcacctgactttattgcattaaattatccagattttgcacagtatgtagaaaacggagcggtacaaccattagacgatttctgggaatatgatggagtagataaatctgattttaaagaaacggctgttgaattaggtcaagtagaaggtaaacagtattttgtccccatgcaggtacaaggaatgtatatgtattggaataatgatttgtttaaacaagctggtttagacactgaacaaccacctactacttgggaagaattgacagaaatggcaccacaattaactgatagtagtaaaaatgtatcaggttttgtcttcaataaggatggaactgcaccattatataactggatgttagcaaatggcggtaaattagtgaacgatgattatactaagtctgaatttgcctctcctgagaaccttaaaacgttaaaagcgatccaaaaaatgattcatgtagacaagactggcccagaatcgatttctggcgccgaaatggacaatttaatgaatgctggtcaactagccattgaaatcaatgggccatggttaaataacggattgaaagcaaacgagattgattataatgtgactaccttaccacaagggagtgactcggacaaaaaaacagctattttagatggcgtaggatatgccattccggcaagtacagataataataaaaaagaagctatctatgagtttttgaaatattggaatacaactgaaattggtaaaaaatggagtatcgaaaatgggtttcctgcctacttggattcagtagcaaaagatgaagaagtcaaaaatgatcctattgtttctgaattatcgaaacaaatggactatgcagagccatatttaccaggttttacccaaatctctgcgattaataacgatatcatcaacccattgattgaaaaattattagcgggagaagaccctgagaaactcatgaacgatgcagatgatgccatcaatcaattattgcaaaaatagtacagacctttatataggatagactgttaacaagatacagatatctgaatgatcgacgtagtgtttgcagataggtgttattgcagaaatcacagcgatcgttcggatatcttattcagattcgattaaaccaagctcgtatattttatcaaaatgaaagatgaggtggactatatgaacggattcaccaaatattggaatcgccctgaacgtgctgcgtatttgtttttgactccatcttttttagttttattattatttactgtcataccgcttttaggaacatttgctattagttttacagatttgaatattttctttacatcaagaaattttgtaagttttgaaaatttcacacgtatatttagtgatgaacgagcagttaattcgttgattcattctttatattttaccgtacttgaaacgccaacacaaattattgttggtttattagcagcagtagcattatctaaaaataccagattcaatcggttttgtcgttcaacgttttacattccagttatttgttcattgacgtcaattgcgattattttttctatgttacttgatccgaatgtaggggcgattccttacttgttttcacaagtcggcttgccgattcctcaattttttcgcgatccaactcttgccatgccaactgtagccatcatgactgtttggaagaattttggtgttactatgacgattctcttgactgctattcagggaatctctccctctttgtatgaatctgctcaaatggatggtgcaacaaatcggcagcagttttttaacattacactacctcagatcgttccctccttaggtttttgtgttttaacgaatctgattggttcgatgcaagtgtttgaccaagtatatgttgcaaccgctggtggcccacaatttaagacagaaacagctgttcaatatatttacagtcgaggatttacagcaccttatgaattgggctatgcatcagcattgtcttcggttttgtttatcattgttgcaactatagctatctccactaatgtgtacatgtcacggaaagaaaaacaaatgaaataggagggaactctgtatggcaccagaaagctcgattacagttactgtgaataagaggaaagcagttagtggtaaaaaaatcattcgaacgattagtatgctaattatattgtttgttattgcttttccttttttgtggctgattatttcttcttttaaacacgaaaaagacattatctcatttccgcctagaatatttgcagacagctataccctagataactatattaaggtttggacaacgatccctttattagattacatcaaaaatacagtaatttttgctggagggacagtgattacttctgtattctttgattctcttgcggggtacgcatttgctcgtatgcgtttcaaagggaaatcagttttgttctatttcgttttactgacaatgatgatcccattccaagtcttcatgattcctctatttattgaagtcaatttgcttggcatgcttgatacttatgcaggtttaatcattcctcgtatgacaactgcatttggtatcttcatgatgcgctccttttttatcactttaccagattctttggaagaggcagcacgcattgatggactaagtgagtttaatatttttttgaaaatcatgttgccattgagcaaacctactcttttatcattagggattttcacgctgatgaatagttggaatgacttgctttatccattgatattgacaagtagttcaaaaatgagaactttaccagcagggctagctttatttacggggcagaacatttctttctatggacctgtaatggctggaacggttatttcaatgttgccattactagtggtttatatttttgcacagaaatattttgttcaaggaacagctatgtctggaatgaaagagtgaggaagatgaaaatagttgagacaaaattttatggacagttgattgtggtttctgattacatcttattaggaattctctgggtaatcgtgtgtttgccggttattactatcgtgcctgctacatgtgctgttttttatgtaatggcgcaatggaaaggtaaggaatcaggacacatcatttattttttctttcaaggaatgaagcaacattttggtaagaacttgttccttagtatgttaacgaccgttatttattttcttgttaatcaattattagaagaacagacaatcggactttcaattagtggatatgtagtttcacttatttattccatgtttcttttatcctgggtatatgtgatttctgaaaataaagatacttcgtttctacaaatttttgaacaaagtacatggaaagtattttttgattttttgagaaatattctttgttgcgctttgttattaggttttgtactactcatatttctttttcctccgtttatttttatctttgctggtggcgtttggaaacttgtatctattatcttgactataggaaatgaaaggtagggaaagctgttggacgaagaagtaaaagtaaaaatcagagaggattttacagtaggagagatcagttctcggctgtttggctcatttgttgaacatatgggaagtgtcgtctatacagggatttatgaaccgagccatgaaacagctgatggtgacgggtttagacaagatgtcctctcttatgtaaaggaattggaattaggtgttattcgctatcctggagggaactttacatctggttatgattggttggatactataggtaggaaagaacggcgaccaaaaaagattgatttagcatggcgaggtatagaaccaaattcttttggaatccacgaattttttaaatggatcagtcatgtacaagcggaaccgatattcacagtgaatttaggaacaaaaggaatcgatgaagcaaaaaatttagtagaatattgtaattttccaaaaggaaccttctggagtgatttgagaataaaaaacgggcaaaaaaaaccttttggcgttaaattatggtgtttagggaatgagctagatgggccatggcaagtgggtgctaagagtgcttatgaatatggtaggttagcaaatgaagcctcgaaagtcatgaagttagtagatgattcaattgaaacaatcttagttggaagctctacgccacgtttaccatcgtaccctgaatgggatcgtatcgcattagaagaagcatatgagaacgtagattatttagctttgcataactatattgacaagtatgatgaagaagacttgactaaacctcctaaaaatgagcgtgatgatacagcgacatacctggcaaaagcttatcgattcgatcgtcaaattgaagagatcgttgctacttgtgattatgtaaaaggatatttgagaagtgagaaaacaatgtatctagcgttcgatgaatggaacgtacatgcccaaccggaaaaaagacacagggattttgaaatcggtagtcccattgattggtgttactttactatggaggatacattattatttggttcattaggattggctattttacgacatgcagatcgcgtaaagattagttgtcaatcattgttagtaaacacaatacctttaatactaacagatgctaaaggccaagcatggaagaatccaacttactatgtgatgcaacacttatcgaaatatgctaaaggtcaagtattggaacaacaaatcatttgccctgtttatgattgtgaaaagataaaaaaagttccttatgtagacagtgtggtcgtagataacggcaatcaactgactattttcttgattaatcgcactaatgaacaacaaaatgtaacgattgaacatgattttaatttgctagatcaaggagagcactacacattgaccagtagtgatctattggacaaaaatacacgtgaagaaccagaaaagataaaacctgaaataaactatttttcaatagaaaaacatgacgagttaaatgtagggatagaaaaatactcttggaatgtaattagaataaagaaaatgtgaggaaatttgttatgatgaagacactttataataatcctatcgttcagcaacgggcagatccttgggtatataaacatacagatggttattattattttacaggatcggttcccggctaccaagtgattgaattaagaagggcaaagtcactgaatgaattagaacatgctgaaagcctgattgtatggcaggctcatgaagaaggaccgatgagtgaattgatctgggcacctgaagtccattatatcaatggaaaatggtacatttactttgctgcaagcaatcataaaaccatacgtgatgaatcccatcatcaccgcatgttcgtacttgaaaatcagcatatggatccaatgaatacagattggatagaaaagggacaaataaaaacgaaaagggaaactttcagtttagatggaacaactttctcttctcagggaaagctatattacgtgtgggctcaacaagatcctgaaattgctgggaattctaatctttatctatccgaaatggctaatccttggacgttaaagggagagcaactcctcctttctatacctgagtatgaatgggaaaaacggggtttttcagtaaatgaaggtccagcagtccttactcgtaatgggaaaatattcattacgtattctggtagtgcaacggatgaaaactatgccatgggtctgctgtgggctgatgagcacaagaatcttttattaaatgaatcatggcataaattatcggagccagtattcgtttcttctgaaaaaaataagcaatttgggcctggtcacaactcgtttacgatttcagaagatggatgctttgatattttgatttatcatgctcgaccagagaagaaccaaaaaggggatccattagacaatcccaatcggcacgcgaacgcgcaatgctttacgtggaatgagcaaggatttccagaatttggtgaacctgtaccgtatgacttatgagaacaagaaaccttgatttttgcttgaataaaccttgcagactcgttatgatatatgtacgtacaaataaaaaggagcaaggtaaatggcaaaatatcaagacattgcagatgagataaaacaaaagatccttcatgaggaatacgaagtaaatacaaccattccttcagaattcaagctgcaagaaatatatgccgtcagcagacatacgattcggcaagcaatcgctgtgttggtaaatgagggctatctgcgtaaagaaaaaggatcgggcacatatgtagatgacagctataagaaagaaaaaacaccattgaacagaacaaaaacgatcggtgtcatcaccacatatctctctgattatatttttccgtcgattatccgaggaatcgaaaacgaattacgagaatctgggtattcattgcttttagccagtacgaataacgatcacgaattggagaaagagtgtttgaagaaaatgattgcttatggagtagatggtttaatcgttgagcctacgaaaagtaatcagtataacccaaacttagcactttatgttgctttgagagaaaaaggcattccgatggtgatgatcaatgctgcttatgaagagttaaatgcctcttatatttgtttagatgatgtgaaagtcggttttatggcagcagaatatttgataaaaaaaggacatcaacgtctgttgttcatcacaaaaatcgacgatcttcaaggaaaatacaggatgaaaggttttatcagcgcgtgtgaacagtataatgtgcgatttttgacaaaagatatcattactttcaccacggaaacacgagaaacaattgctgaaaaaacagtacaacggttgaaagaagaacaagctttagatggcatcatttgctataacgatcaaatagctagtttattgctagataagttgacagaaaatggctatcatattccagatgacctatcgatcgtaggaacagacgattcttctttaagccatttaggaaataaaaaattgacaacattgactcatccaaaagaaaagttgggacaagatgccgcacggtggatcgtcacaacgattgaaaaaggacaggcacagccgaatattctttatgagcctgtactagttgaacgggaaacagtaaaagaaaacgaaaaataagagacgggtttttaccgcctcttattttttatatcaatttggggctgtgacaaaaatcatcaaacatgagaaactgttttttgaacttggtccttgtgactcgaaactaagcggttccttcttatttcttgaagctgaccacttctgtcacgatcactttaagaatgatggatagaaatacgtttaggataagtttttttagatgcactttgttcgattccctctaaagatttcccacgagtctccggtacgatctcttgaataaataaaactcctaaaaagcagatgatcccaaaaataccaaaaacgatttcttgagacatagaagcagtcatcacaggaaaaaacaagccgactaggaaagaaccaatccaattaaaagaagaggctaggccagatgctcgcccgcggacagctaatgggaatatttcgcctacgattacccatgtcagtggagcccatgtgcaagaataaaatgcgacataaatacataaaaacaagagaattaacaacgaatttgtatgagcatccagtacagttcctaaaacagctggtaggatgaaagaaagtcccatcacgctaccgcctattttcaataaagttcgccgattgaacttgtctgcaataaccaaaaagagcaaagaaccagcaactaaaatgattccttggatgatcggccacatcaatgcatcgctcgctgcatgcccagtcgctttttctacgatcagcggaatatagtaaaaaatagcattagctccttgaaattgctggaatactgctacaccaataccggcaataactaacgaacgatacttttctaaaaacaaagtatgccaagaagttacggttgtcttttcttgtttgacattcagctggatttgttcgaattcctgttcagcttcgtattctctccttctagaatttcgagaaggcggctgatcagattttgtaagcaatctcattctataacttatgtacgtacaaaacaagcgttttttattatattcttgaaaataaccacttgacatgtacgtacaaaagtatacaataatcattgtaagcgctactaaaaaagacggtttgatcaggtttgacgagaaggagggagttaaatcattatgaaggaagtaaatgcgcaaagtatgttagatgtcatagatggtcgtacatctttaggaattgagtttggatcaactagaatcaaagctgtattgattgattcatcttttactcctattgccgctggtagttatgagtgggaaaacaaactagaaaatggtatctggacctattcattagaagatatttggaaaggactgcgcgtcagttaccgaaaaatggcagcagaagtattcgaaatctatggcgagaatcttacaacgatcgggtcgattgggttcagtgcaatgatgcacggttatctagcttttgatagcaaggaacagttactagtaccatttcgtacttggcggaatacaattactgaagaagcagaacgaatattaacggaaaaattccaatacaatattccgcagagatggagtatcgctcatttgtatcaagctatcttgaataaagaagaacatgtgagagaaattaattttttgacaacgcttgcaggatatgttcattggcagcttactggtgagaaagtactaggcgtaggagatgcatcaggcatgtttcctatcgatccttcaacgaaaacctatcatcaagaaatgaaaaatatttttggtcagttagtcgaaaaagagcatgtagcgattgatttggatcacattttgcctaaagttctagtagcaggaaaagaagctggcaagttaagcgaatcaggggcttatctgattgaccctacgggaaacctgaagccaggaatcccgatttgtccgccagaaggagatgcaggaaccggtatggtcgctacgaatagtgtagccaaacgcacagggaacatttcggctggtacttccgccttcgctatgatcgtattagaaaaagaactagaaaatgtccatccggaaatcgacatggtcactacaccttcaggagaactagtaggcatggttcatacgaataactgctcttcggatatcaatgcttgggtcagtatttttgaagaatttaccaattctttgggtatggagataagcagagataaattattcacggtattattcaataaagcgctagaaggcgatacggattgcgggggattactttcttatggttatttttccggtgaaaacattacaggagtaaatgaaggaaggccattatttgtacgtacaccaggtagccgttttgatttagcgaatttcatgcgaatccatttagccagtgcttttggcgcaatgagaatcggaatggatatattgaaatctgaggatgtccaaattgatcgtttagtggggcatggggggatttttaaaacaccagaagctggacagcggattctagcatctgctatggaggcaccagttacagtgatggacacagccggagaaggtggagcgtgggggatcgcgttattagcagcctatatgatagatcagcatgggaaatctttagaaaacttcttggcagaagacgtgtttggacaagaccaaggaatcaccatcacaccttcagcagaagaaatagcaggctatcagatatttatgagtcgttaccgtgaggggatcgacattgaaaaaacagcgattcatcaattgcaagaaaaaggagtgatagaaaatgctggaacaactgaaagaagaagtataccaagcaaatcttgacttgcctaaacacggacttgtcaaatatacatggggaaatgtgagcgcttttgatcctgaaacacgatatttcgttatcaaacctagcggggtcagttatgaagagatgacagcagacgacatggtcgttgtggacttggacaatcatatcattgaaggtaaactcaatccctcttcggatacgcctactcatgctgttttatatcgttcatttcctcaaatcggaggaatcgtccatactcactcgacatgggcgacgatctgggcacaagcaggattggatgttcctgcgatggggacgacgcatgcagatactttttatggatcggtaccttgtgctcgatttttgacacaacaggaaatcgacagcgggtacgaatatgaaacaggaaaagttatcatagaaacattcaaagaacgcaaaattgatcccttagcaattccaggggtacttttacacggacacggtccatttacttgggggaaagatgcgcaaagtgcagtaatgaacgcagtcgtactagatgaagtatgcaagatgaatttatttaccagacagcttaattcattttcagaagagctgcctcaacggattttagataaacattatttacgaaaacacggaaaaaatgcgtattacggacaacacaaataaaaggagtggctaattatgttgaatattggagaaaaagaattttggtttgttgtaggatcacagcatttatatggggaagaagcactgcgagaagtaaagaaacatgcacaagaaatggttgatgaattgaatgaaaacggccaattgccttatcctatccgccttcaagaattagcagttaccgctgacacgatcacaaaaatcatgaaagaggtcaattatcgagaagaagtagcaggtgtgatcacttggatgcatactttctcaccagcaaaaatgtggatccgtgggacaaagcttctacaaaaaccattgcttcatttagctacgcaatataacgaaagcattccttggaaaacgatcgatatggatttcatgaatttaaatcaatccgctcatggtgaccgcgaatatgggttcatcaatgctcgattaaataaacaaaataaaatcgtcgttggctactggaaacgacctgagattcaaaaagagattgctgattggatggatgttgcagtagcctataatgaaagttttggaataaaagtggctcgttttggtgacaacatgagaaacgtgggtgtcacagaaggagacaaagtggaagcacagattcaatttggttggactgttgattattttggtatcggagatcttgtacaagtaatcgatcgcgtatcagacgaagaagtcgaacaattatttgaagagtacaaggaattgtataccttcgactatggtgattatgaagaaaagacatgggaagaacatgtaaaagtacaagctcagcaggaaatcggtattcgccgtttcttagaagaaggaggctataacgcttttacgactaattttgaagacctttatggaatgaaacaactgcctggactagctgtacaacgtttgatggcagaaggatacggttttgctggggaaggcgactggaaaactgcagcgattgatcggttgctgaaaatcatggctcgaggaaaagatacaggattcatggaagattatacttacgagctagctagtggccaagaagcaatcttggaatcccatatgatggaagtagatccgacgcttgctgcgacgaaaccaagaatcgttgtttctcctttatcaatgggagatagagaagatccggcgcgtcttgtatttgatgggaaagcaggagaaggggtagtcgtatcgatggcagacttcggtacgcattataaactgctgatcaatgaagtagaagcctttgaacccacaactgaagcacctaatttgcctgttgcacgtgtgctatggaaaactaaaccgaatttccatgaaggtgtccattcatggattcaggcaggtggcggtcatcataccgttgtctcgctaaatctaacaacagatcaaattgaaacatgggcaaaattagttgagttggaaaccgttgttattagataaaaagaggttgtgaaaaagccgcttagttttaagaaaaaagaagagattgacgaaatttgcttttcaacttttttgaaattttgtcttattatcaatgttagctaactgaacaccatttatcaagaaatctcacccacaatattttgctctcaaaaataaggcttatggcagtaacttgccatggccttatttttatcgctaagcctactctgctctagctgctatttttgcttctaggaagtcaaatggtaaacagttgtctaattgcagtaatttcgagatacttgttagtaaggagggggttttatgtatcacgttcatttgattgatgctattccagaacaagagatagaaaagttacaaggggaatatttcaaaataatagatgatttgccagccgaaggaatagtcattcgtagtacgaaagtgaaagatgaatggcttacaccagatttgctagcaatttcaagagctggtgttggggtgaacacgatcaacgttgaaaaagcttctgaaaacgggacgatcgtcatgaatacaccaggcgtaaatgctaatgcagtaaaagagcttgttttgtgctgtttgctcttatcttcccgtccgataatcgaagcaagtcgtatggtacaaacactaacaggtcctaatattttagaacaggcagaaaacaaaagaagtacttatgtgggacgagaattgcaaggcaaaaccatcggtcttcttggtcttggcgcgataggcacaaaagtagcgctaagttgctatggcttagggatggatgtcttgggttattctatccgcgatgcccagttggattatgttcggcaagcagatttagaaacagttctttctacctcggattacatcgtagtcatgctgccgttgacagaagatacaaaaggattgatcaatcaggcgaatatagaaaaaatgaaaaaagatgctgtacttatcaatgtaggaagaagtgaaatcgttgataaatatgctgttatgcaagcattggaaaaacaacatctggccaaatacgtgactgatttcccagaagaagagttcttagaaaatgaccgtatacttatgttgcctcatctagggggatcgactcaggaagctttggcagacagcggacgtttggcagttgaagccttaaaagattatcttttgttcggtacggttagagaagcggtcaattatccatccgcacgaatgtttttccaagcgccgtttcgattcactatattttatcaaaagaaaaccaatatattagcagagatattttctctgctgaataagaacgagctagtgatcgcagatatatcgcgtaatcataagaatgagcatgtctacatattgattgacatagacagtactgattttgaacagctcaatcaagtgaaacaacagctagaaaaaatttctggagtacgaaaagtccgcttattaaagaaaccagaaaggtcataaagaaagagaatatttggatttcattaattcttcttttcgttctttactttcgaatttcgtacaactaaaataagagaaacaacattcttttgttgatagaaatgaaggagcaagcatttgaaaagatatataagcagactttcaaccaaacagaaaaagattttaaaaggaacagtagcgatcatcagtatcttttttcttgttgtttttagtaatttatttttgcagtggtgtcaaaatgatctatccgtagaccttgcgttgaaatttgctttttcttggcatacggaaaaattctttttagcctgtttcgtcttgctgattattcttatttttctgattgcactagcaggatctgtccctttaggttcccttacgtatgtcgtagccatcggtgtattaggttttgctaattatatgaaaatgagttatcggcaagaaccgatttatccagacgatttgaagatgatcactgaaatcggattgctgaaagatatgaccggcactatgctgtttacagtgatcttagctgccgcaggaaccgtgctaggattgttctgctggtacatgtttcgaagcctgaaaaaaggaaggcgattccaattgatccgattaacgacactgcttgtggcaattggactgctagggtatatcagtaatttcaacaatcccgataatttgttgcgaaaagcatataataaaacggcactatggataccttacagccagaaaatgaactactataacactggttttatcggtgggtttttgtacaatctgaaggtagaaccaatggatgaacctgaaggatattcgaaagcaaagatcaaagaaatcactgaaaaataccagaagatagccgatgaaaaaaataaagctgtagaggaagagtcgccgaacatcgtgttcgtaatgagtgaaagtttctcagatcctagtcgattaaacggcgtagaagtatctggtgagccattggcagattattatgaagtagctgatcaaacatatagtggcaatatgctttctcaaaactatggcggtggaacagcaaatatcgaattcgaagcattgactggtttttctatggcgttgtttaatgcgcaactcaccactccttacacgatgctagtgccaaaaatggatcagcttccttctatcgtttcagcgttaaacgcacaatcataccagacgacagcgatccatccatacaatacttcgatgtataaaagagaggatgtttatcagacattaggatttgaccagttcatcagcgagcgtacgatgacctacacggatacgatagagaataatccatatatttctgatgagtcagcttacaaagaagtaatgacacttctcaaggaagaaaaaacacctcagttcattcatttagtcacgatgcagacacatatgccttacaatggaaagtatgatagactgggctattctgcagagatttcagatggaagtgggacgcttgacttagagaattatctgcaagatatttcctatagcagcacggcactgaagcaattcacggaagaactgaagaatctttctagaaggactctagttgttttttggggggatcatctgccagggatctattcagataccatccaagccaaaaatgataaacaaacattgcatgaaacacaattcttgatgtttgacagtaaaggaaaattagaaaagaaaacgactcaagatgcaataaccagtcctttttattttgtagcgaatctaatggaacagacgaatcagacaacgaatggtttttatcagctgcttttatcattagaacaagaacttccggcgtttgaacgagaactgtactatcaaaacggacagtggtataaagaagcgcaattcaatcgctcgcaacaagagatttacgacgaatatcaattgatccaatatgacattgtcgcagggaaacaatatagtttagcagatggtttctttgagcacgaataagaatggcgagctgtatagaaaccattaaattttttcaagtacttgtcatttgaggataaaaacaagtagaataaataataacaacaatggagaaagtaggaaaacaaatatgttaccgaatattggctattatgtgcagtccatcgatcaaatcgtcaaggaaaccgaagcaatcggagaaggaatgcatccgaaatatgaagtgatcagaaacgcaatcgatgaaggaaaaacaagtgaactggacagatcgactcttgaagagaccgtccagttatttgaagaaggaacaaaaaaatatcgggcaatgcttaagaaagtcagtacattgcgcccaccagcaaaagcaatgggcattcataaaaattttgaaaaagcttatctttcatatgtagcaggctgtgaagaaatgattcaaagtattgatcttgagtcaggggtagataaagatttattcaatacatctgaagcaaaacaagaccaagcgactgaccaattgacagctgccatccaaaaaatgactaatttgttattgaaaaaataaaagaaaaatttgatgacaataaaaactagagttatctaatataaatgtaatattgtctttatgatagagtgaacaaaatcctttatgataagaacatacctataaccaacaaccttgtacttactcaaaattgagtaaatactccttttccgcagagtctaaccaactcggcggtttttttatttatagaaaaggacatcagaacagacgaaaaagtcttgcgctgatgtccttttcagatagtatggaaggttgattagttttctacattccgtacatattgttcaaagtagttctgtaaatcggctttgagtttctgatattcctcttcgctatactctttatcttcgattttcccatcaaagaaaggaatattcagttcttcccgcaacctgtctaatacgtcttgctgattcattttattctccttttcttgctaacgatcaaaataaacacagacacattctggtgcatagacatctttttgcaataattccagtaatcctgtttcaggatgacggcggtataatgtcagattatcggtattctgattagcacatacgacaaaaccattgcttggatctagtgcgaaatcgcgagggaaatcgccttctgttgagatgatttgtttattttggatgtgagaaccatcttcggaaactgcgaatacggcaatcgagttgtgtccccgattagaagcgtaaaggaacttgccatcattggaaatgcgaatagcagcccctccattttcaccgtcgaattcttctggcaaggtcgatattttctgtaattcttcaaaatcacctgtttctttatcataagaaagcactcggactgtgctgtctaattcaccaaataaataggcgaattgtccattcggatgaaagacgagatggcgagggcctgttcctggctctgcagtgaaggtagttacaagattcaatttgccgttttcggacacatcataagtatacacacgatctgtaccaagatcacacacgactaatcgttggtcaggagtcagatccgtataatggacatgcgcatgatcttggtttttatgagggcctgtcgcttcttgatggaatactgaatccgctgctttcagctcgccatctcctaataggtgatagacatttacttcgcctttatggtagttggccccatagagcaattgccgtgtttcatcaaccgctacataacataaaggagccccagactctgttaccgcattcaaaaaatgaaaatccttgtcgtacgcaccggcaccacctaatccgtctacactggtaaccgtgtaaagattgccagctttgctttttgctaggtaagtagggctgttctcttcaacagccaatgaaagactggataattcttctttttctgtatcaagatcgatcgtatagattcctttgctttcgcggcgtgtataggttcctaaaattatcttttcgatcatatgagctgattcctcctaatggtaatgaaatagttttcgtttttattctatcacataattattccccacggctaaagaatgagaatgtgttatactgtttttgaaagcaagtaaaggagagagtgcgatgattcaggcaacgattacagaaattggaacagaagcaataaacaaggaagaaccgatgctgattttgttcgataaaacagcaacagctgccttgcgaaaatattcggtgattcaagaggtgtcgaaagacgaacctttttctttgaaagcaggcggaacgattacttttgatgatcagtcgtatacgatcgattatgtcggtccgatggccaatggaaatttagagacggtagctcacgtatcattgatttttgatacctgtccagaagaaggacaaattgcaaacggaatctatctccatccgcatgaactgcctgctattggtttgggaagccaaattatttataactaacaggaggacttatggaagggaaaaataagaagaacagaccggtgtcttggttttggcgctggtttttaaataatcaagtggtcacagctttacttgttgtattgttaatattgctgatcgtctttttatttacaaaagtttcttatttgtttgcaccgatctggcaatttttagcaatcgtaggactacctattattctggcaggcatcttgtattacttgatgaatccggtagttgattactttgagaagcgaaaagtaccaaggctctatagtatcattgggctgtttgttttggtcgttgcattaatcgtatggggaagcgtagtgatcatacctaagatccaggaacaaacagtcagctttatcagtaactttcctcaatacgttgatacgatcgataacaaattgaccgagatcttgagagacccgctgttcaaccaatttcgtgaacagttagaaacagcaggtgataagttcatgaattcagcaggtgatatgatccaagacatatctaagagtacagttcagagtcttgggagttttgttggtgcggtagcgactattttagtagctttgctgacgatgccgtttatcttattttatttattgaaagatggtaagcgattagccccttatttcgtcaagtttttaccaacgcgcatgcaaaaaccgacgttgaatgtgctgagtgaaatgaatagtcaagtttcttcatatataagagggcaactaactgtggcttttgctgtggcaatcatgtttatgattggttttgcaatcattggtctagaatatgctgtcacgttggggatcattgcagggttcttaaatctgatcccatacttaggttcatttttagcaatgattccagccatctttttagctattgtggcaggtccattcatgatcatcaaggtactaatcgtttttgcagtagaacagacaatagaaggacgcttgatctctccgttagtattgggaaatcagttagcaatccatccagtaacgatcttattagttctgctgacgtcagggaaattgtttgggatcgttggtgtgatcttagggattcctgtttatgcagcagctaaagtagtgattactcatgtttttgaatggtacacaacgatttcttctctttatgaagaaaatccgttgaaaaagcagaaagaataacaaaaagagacagaggaaaatttccaaagcacaaatgttgctttgaagatttttccctctgtctcttttatatacatttacctcaattttaaaatgatttacctaaagcagcagctttatctaatgcattttgcatcaactcatctgcacggtcagggtcataatcgattccttcgatgaatagttgatctacttgattgatgcctacaaagttcaaaataccttttacatattgagaggcaaagtcttgtccgttgtatacaccgccgttagattggatgtgcagcgcttttttacctgtcactaatccttctggcccgttttctgtatagcggaacgtttttccagctacattgacagtatcgaaccaagcttttaattttgttgggatatttagattccataaggcgtttgcgataacgattttatcagcagcaaggaactgctctgtcaattcattgaaacgagcgattttttgttgttgactttctgataaggaagtgaattctgcaccagcacgtaatgcttcccaacctgataataattcttcatcgatttctggaatatcatcgcgataaagttccaaaacagtcacttcatcatctggatgagtttctttataacttgttaaaaaagacgtcaacgccttaactgtacgtgattcttctgcagttaggggatgacctttgactactaaaacagatgccatatgcttaccttctccttttattgctatgattgttataactatgactaacaaaatcagtttactcgaaaaagaaaaggctatcaagtcatattgataaggttgaagaataaataactaaaaaagacaggatataaaagaggttgtgacacgatttttgtcacagcctctaataaccataaaatcctattccttcatatctccagcccattggcgttagccaatctctttctttcgcacttaaggtatagtgatgggtaccagttttttcatttggattgaatagtcgatagattggcttggaaccaccagaataaaaacttagaccttcatagcgccaaccgatttttgttaaagagttgatctcagattgcgccattgtgtaatgatggtctccgctgtaaggattgtataaacggtagacaggctgtccactgtttggtgcttgccaagcaattccttcatattcccagcctacagttggcagataatttttttcgccggcattcaatgtatacaaatgctctcctgtatgacgattatataaacgatacattggagaagttgaagttggtgctgtatcatactgcgtcagattgtaagtctcgattacattgtttagtgtagcaccataattaggcgcagtggcataacgaccggtcaaccaagctgtagcatccttgtaagagttcgtattgcttttccatgcaccagaatagtaatacacgcccggctggaaagaagtcgtcttcaataccgtcacattatcttgtaatgattctttgtacgaaggatattttctaaaagcagcatttaccgtgatccattgtccatttacatattccgaagtaggcatcgtaacagattggccattatagcttcctttgattccaaatagattgtaattaggagcagaagccaaggcactgttcccccagccgctttcaacgattgcttgtgcaatcatgactgatgcgtataagtcattggcacttgccaagctttgtgcagtggacgcaatactatcaatgaatgcttgttgagaattagcagatgagcgggcagaaaaagcgtagccagtatagttttcgaattcagacaaatctgcttgatgggtatgtgtcaatgtttgtccatctgtcaattggttcgtgatttcttccgcattctctggatttttctgagcttctgctgatgtgctttcttccgtttgcggttgttctgttgtccctgttgttgattcttcagttgaaaccgtattttcggagacagtagctgactgcaacgtactttctgtatcgttttcaattcctatttctgaagaacccgttgtctgagctgtgactgttcctgtcgtttcttcagctagcacggttgtgttggcaactgctagatttcctaaaagaataacgctaaataataaatttcttgctttcattctttttctcctttaaatatgaaacttttcctaaataacagtgtaactaaaaaagtaaaagtaagtcaatgctcataattaaataacatacgtttctttattttgcgctctcaatgttcctcatatattccattaaattactataattataaaaaaagaattgacaaaacataactgtctatataaaatgattacgttaacaataattcgtttcatgtgactagatcatactaggcatgaaaaatctctgaggaacatggtttccctaggaggtttttcgtgtctatttttgtttggccgcaatcaactggtctagcaaacatgaaaaccaaatcttcaaaaagggtgcgcgcatgaaaatcaaaaagatctttaatcaaaatgcagtattggtagatgacggtgggcaggaaaaagtagctattggaaaaggaattggatttgacagaaaaagaaatgatttgatctttgatcgtgatattgaacggatattcgtcatggagccagaaggacaaatcaaattgcaaaatctactcaatcagatcgatgaacgctttttgtttgcagcagaaacaatcatcgatcatgcggaaactgtcttgatggagaaactgaatgaacatgtgttgatcgctttgaccgaccacattgctttttctgcggagaacatcaataacggtatcgtcatccgcaacaagcttttgagagaaatcgaagtgctttacagtgatgaattcagtattgctcaatgggcagtagaatatctgacaaaagagcttgggattccatacacttatgacgaagcaggatatatcgcaatccacatccacagcggacgaagcggtcgaaataataaccatcgcagtatccgtgaagtgacgattgtatctgatatcatccatttagtggaatcagaattggaaacagatatccattcagaaccattttcactgaattattcaagactggtgaatcatttacgactgcttctacaacgaacccatgcgcaacaatatgctgtcttagatacggaaatcgtagaaatggtcaaacgaaaatacccagaaagctataagatttctaaaaaaatccgtgtgttgctgaccaaagaataccagctcgcgatcacgaaagaagaactgggttacttggccatccatatcgagcgtttaagaagcgcaatcgtacaaacaaatgttaacaatcatgaggaggaaaaaaattgaaagcatatctacaacgaatgggacgttcccttcaactcccagttgcggtcttacctgctgctgctttactagtagggatcggaaactggtgggcatcttatagtaacgacattgtcgctcattttttacaagctggcggtaacgcagttttaggtcaattacctttgctgtttgccgttgggttagcactagggatgtcagtggacaaatcaggtgctgctgccttggcaggtttggttgcatttgaagttccagtaaatgttttaaaaactgattcagtagctactttattgaatatcaaaccagaatcagttgatccatcttttgctcagatcagtaacgtatttattggtattattgccggattgattgcggcagctctttataatcgtttccacgaagcaaaattaccgatggctttatctttctttagcggcaagcgtttagtgccaatcttggctgccttcgtcatgctgctgatcagtgcagtgctactgctcgtatggcctccggtttactctgctttagtttcttttgctaaattcattttgagtttaggttgggttggtgcaggtctttatggcttcttcaaccgtttactgatccctacaggattgcatcaagcaatgaactccgtgttctggtttgacgtagctggaatcaatgatatcggtaaattcttggcttctgaaggaacaaaaggcgtaacaggaatgtatcaagctggatttttcccaatcatgatgttcgggcttccagcaggagcatatgctatttacagaaatgcccgtccagaaaacaaagcaaaaacagcttcattgatgttagcagcagcttttgcttcattctttactggtgtaacagaaccacttgaattctcatttatgttcgttgcttggccattatatgtcttgcatgcaattttcactgggatttctttagcagtgagtgcattcttccattggacagcaggatttgcctttagtgccggatttgtcgattacttcctatctttgaaaaatccgattgcgaatcagcctttgatgttgatcgtccaagggttagtaacagcagtgatctactactttggctttaactttgctatcaaaaaattccatctgatgactcctggccgcgaggaagcagatctttcagatgacgatactgcaacgactgattcagacaataaatatgctgcacaagcaaacaaaatctacgctgcattaggcggagctgacaatgtaacttcaatcgacaactgtactacacgtcttcgtttgcaagtcaaagatacaggcctgatcgatcaaaacaaaatcaaagccactggcgtacctggaatgaaaatcattgatgggaaaaacgcacaagttattgtaggaacagaagtacaattcgtcgcagatgagatggcaaaactacatggtggtgctgcagcaagacctgcacaaacaaacaccgtggttaaaacagaaacatttgccggtggaacgatcgaacaagatatttacgctatcgcaaatgggaaactgattccaatcactgaagtttcagatgatgtattcgcagaaaaaatgatgggtgacggctatgctgtattaccagaaaatggagaaatcttctctccaatcgctggtacgatcacaaacattttcccaacgaaacatgccgttggtatccaaactgattctggtatcgaagtcttacttcatatggggatcaacaccgttgacttaaaaggcgaaccattcactttatatgtagaagaaggtcaaaaagttgcaagaggtcaattgattgctttagttgatcttgctgctattcaatctgcaggcaaaaacacggatatggtcgttgtattcacaaatggcgacaaagtccaaaacctagaaattaaacccgcacgtgatgtaaaagcaaatgataaaatcggctctgtttccaacaaagcctgatccatcgtcttccccagacttttttatcgataaacaaaagcagctgagacaaaaatcttgtctcagctgctttttccgaataaaaacggtgttcttctaccaacttcgcggtaataagtccagccaaacgaaacatatgaagaactattttttatttgactcttcttattgcttgatgcagaacagcttttttacaacctcttttatcatccattattcctgatccaatatttctttcaatgctgcttcaagagagactaatggtttttccaaaactttttctaaatcatcagaagaaacagctaactgaccctttttgatatcatgttggatcgctaaaaacatgtcagctgcttcttgagggaatccggcttcttttagattttcgacaaacgctgcatcacttgcttcaataatttctaactctttacctgtcgcacgcgctaatgccttggctaattcttcatagtcagttagatggccggataattctaagatttctggggagtcattctctactagtacttttgctgcggcttctgcatattcacgtttcaatgcccaacctgtttttccatttcctgcagcataaacgaattgaccagtttttaaagcttgcccaatgataggtaattcattctctacataccaattgttccgtaaaaatgtatggggaatacctgaatccttaatcgttttttcagtgaattggtgatctggcgctaatacactgattgagtgatcggcatctgcaaaacttgtataagcgatataagataccccagctgcttgtgctgctttcactacattctcatgttcggcttggcgatttcctggaacgccagaaacaaaaagcaatcgatctattccttccaatgcttctttcagtgaatctaaatcaccataatcaccaatacgtatattaaatccagcttcttttagtgcttctcctttttcttcactacgtactagtgcataaatttcattttgtggaaccatcttttttaagaattccagcgcataaccaccaaaacctccagttgctcctgttactaaataatgcatatttcccactccttattctttttatttgttaagatttatagctgtacatttataaattacacctttatcataaagagtgtggtaagataagtcaagcaaaaaaaatgaaaggatgacaattgatgaagtattctctgcaatttagtgatgcaatccatgtacttgcctatattgaaatgtttcaagatacccgattgctttctagtgagatgattgccagtagtatcgaaacaaatgcagcaaatgtacgtaaaatcatgagtcagctcaaaaaatccggcttgatccttacaaaaaccggaaaaccgcaaccttcccttgccaaaagaccagatcagatttctttattagatgtctatcgtagcattgaaggtaatacacagcttatccaagtcgatccaaaaacaaacccaaattgcgtcgttggtgcaaatatccaagaagctttagaagaaagctacgctcggctgcagaaaaaagcagaagaagaaatggctaagatcacacttgatagtctgatacataaaatagccgttttggaaaaagaaaaaagaccagaaaacacaggcctcgtagagagatttttataattctctctattgggcctgcatttttctgatcagaatcgtctacataaattcttttattctctgggggacaaaagccttgtcatgcctcttttcctctctaatgctcaggtcaaagcgctgaagtcatgacgtcttgataaacggtgttcaagtagctgaccctcggcattagttctgaaaaatacaaaatatggaaagctattttccatttttcctctctaatgctcaggtcaaaacgctactttcacgacctctatattatcatggtttgttgactaccggtatccagatttctccaatgtatttcccatcggaaacacccatttcgacgacagcattcggtcccccaacataggcgtaatcttctacttctcttaaaacatgtccaaaggccgtattcgtcaaatcattccttagttcttcaggcgactcagatgaatcgcttacaacgagataggttccttttggaaatgggatgattctcgtagtgttaggaacatcttggctcgtttgaacaccgacatagtacatcattttcccgtcatagggttcgttgactgtaaagaaataatgattttcagcagcttttttcaaggtgtctattgttccgtcactgatgactttttgctcaaaggcttgcttctctgctgccaaaccgacaaaatctgtattgctacttttcaattccacaccaatacctgtcactgcaaactctggtttttcttcaatcttatactttgccatttctcccaccctttctattatgttaagttcatcttacataaaattaaagagaaatgacacgattacgctcttcttgtagggatactttcattttttaactatttttttgctttcactgcaatccaaatctcgctgtaaacatgactgaagtcctctccccattttgtaaaagagatctcgggagcttcaactaactcataatctgaagaaggaagccattctgcatagattttcccccaagtgtcttgtaaagtttgaggaaatggtcctttattaggaaaaatggcccaagtatgttcttctatagcaagcatttctaaatcggcgtacggattttcttttgttgtagcaaagccgatcatgtgcattaaactacccttttcttccaagcggtctccatcaaatccataagaaacgttgattacttgatgtggatataaatctcctaacttgtgcatctcttccctttgagtctccgtaatcgtctgcactaacttttgtatttcttgattgactcctttaaattggacagggacttttttcgccacacctaccacataaaactgttctttcttttcgatacgaaattccatcgattttcctcctctgacatcaataaaaaatgtcaagcgtggaaaagatttttgtatgccatatctgctgatttctgaaggcagataacctgaccaatcacgaaaagctcttgaaaaaccctcgactgtttcatatccatatctaaacgccgtttctgttactttttccccacctagaagatcgcgattagccaaagccaatctacggtttttgatatagtccatcagagacatccctgcaataaacgtaaagatgcgctttaactgatattcagagattcctgtattttcggctatttttttataggtaagactttctgtcaaatgttcttcgatgtaatcaatcaattggttcagatctttaagcatgtttatcttcctccttgcttgcatttttatcatattatcaaagaaagtcaattacttgatgaatcaggaaccaatttagtcgggtatagaaaaatttgtatggatttaaagaaaaatctcaagcagcgttttgtaacggataattggtagtatctgcctacttatgttttacctttagaaaaaatgaattttggggaagacacattctaagttaacaaagcagggaaaatatcttttatccccttcgttaaaccgcttactatctactgtacaaagcaagtggcgattcggactgttgatacgaacgctgcttgaatctttctttgcgttacatcatacctcttttatcaattggaacaattatttatttccaacaaaattccttcatttttgccagataaataaaaaaacaaaaagttccatttttaaaatacgctatttttttactttttctcccattatctaagaaaaggaacgcagaattaatttttgacaattcgagaaaaagttgcttcacagatatagtaaaatcagctacttttttctttgacgattctttatactaaatataaacaagtgtttcatgaaaggagaactatatgaataattggcttgagctttttcctgaaaacattttggaacgcgggtatagctatcatctgcacgggtttgtcagtcatttgaactatacgagcaaacacttgactgcaacagtttctggcacggaagattataaggtagtgatcacatgggatgaaaagatgaatatgacttgcgattgtttatatgccatagaaggaaaaaactgcaagcacatggccgctgtcttattcgcttacgaagaacaacccataaaaaaatccaactactcgctttccgaactctcttcccttgtttcttccgctagttcctctcttgtacgggaacttttaacagagattcttatagaacatccgcaatttatcgaacgcttcaaagagaaaatcccgctccatgcaataaactacacagataaattagcaacgatcgcccacaaatacgatcatcctatcggaaaaaataaaaacaggaaaacagcgaagttcatcatggagatgcgaaagttcatccaagaagctgttgagtcgcttatacagcaaaatgcctatcttcccgcattcgaattgatcaatgaagtgattgctactcttgaaacatgctatttggagcctgcggacgaacgatcacttcttctgatagaggactgttattatttatggaaagaattattagcagaagtaccccgtgcagaaaaaaggcaaatgttctcttggttcgtctgccaagtcgatcatactgacgcctcttattcaaaaaactactccataaaaatcctgaaagaagaatttcaggaaaaagagtttgctagccaaaagaaaaaaatagccaaaaaacgaaaagaatctgtaaaaaaaggcgagctccacaaaaaagaacaaacacacgcggacaagcagtctaaatccatcaaaaaaacaactggctctactttaaaaaatacagatgatacaagtaaaatagaaaatttgaaaaaacgtttattagcatctgacagtatccacttccctacattggaaaaactaaaaaacgcatgtccacctgaaacatggccgatcatacgtaatgaactgttttcagctcttaaatatcataaaaatgtggatcgtttttatgcagcagaaggttgttatgatttattgtgggattatgtaaaaagtacagacagattgatcatggtcgatcagtactttgatatcttgaaaaactattgtcctaaacagttattacaaaaacatgaatttgaattacgtcaaaacgtagctaattttgcgacaaaattggaataccaaaaacttggcaaccaaatagaaaaaatggctagcttgccaaacggacttgtgacagctaaattgttgaccaaagaacttcgagaaaaatatccgcgcagaaaagcattgattgctgagatgaaaagaatcgaaccaaggttgaaataaagaagatggaagaggttgtgacagaagtggtcagattcaagaaagaagaagagactgtgacaaaacttttgtcacagcccttctgttttataaattataagttatgacagatttccttcgttgctggatagatttttcggtattgttgatagattttacgatacttttctacattttgtgagagaggttccactgcatctgtatattggataaaagtctgacaacagctttcaggtgtatcgaaccaccctaatcctagtgcagcaatcattgttgcgcctaatgcaggtccttcctccacacttaaacaatagaccgttgcatcaaaaatatctgcttggatttgtagccatgcaagattttttgcgcctcctcccaccgaaacaatacgtgtaaatctgcgactcgctagttcttccatcaactgttgcgaatctttcaatgaaaaggtgattccttccaacaccgctcgggtaaaatggctaagtgtatgtcgagtatccataccaatgaaactcccccgtatctgactatcggcgtacggtgttcgttctcctgagagatagggtgtgaacaataatccatttgaacctggctcgatcttttcaattccttgcagcagttcgtcaaaagaaagtcctttggcaaaagtctttttgaaccaattgagactgtgtcccgcagctaatgtcactcccatagaataataagcatcatttattgcatgatggaataaatggagtttgccttcataagacttttggttatttttctcataagacaaaaatactcctgaggttccaatactgaccatagctgcgccatcttggatgatcccagcacctaaagcagcacatgcattatctgctccgccagcaaatacctttacttctttgtgaaaaccaaattgttctgctagttctttgcgtaccgatccaatgcaagtagtagaagatacaagcggaggcagtattttaggagagatatggaaagtctgtaagagatcctcagaccatgtttttctttccatatcaagtaataacgtacctgcagcatctgaataatccatctgctggtttcctgtcagccaaaatccaaggtaatctttcggcaataaaacatgacgaacatttgaccataattccggctcattttcttgaagccatagcattttaggcaacgtaaaaccttctaatgcgcgattattggtaatctcaagtaatcgatcaccaaagttttccattatttcttcacactctttggttgtacgcacatcattccataaaatcgcatttcttaacggttggtttgcttcatctagtacgactaaactgtgcatttgaccagaaaaactgattccttctaatttttgagtaaaatcaggcactttttcagctaattcttcgatcacttgaccacaagcttggatccagtctttaggatcttgttcactaaatccagcttctggttgtagcaacggatagtcttcgctcgccgcaccctggatcgtcccattcctatccattactaatcccttcaatgaactagttcctagatcaatacctaaaatatacatttaaccacctgccttgtttttattataaatatcaaaagcgactgctgacaatgtctgtttttcctattctttgatcccacctgcagtcacgccacctataatgtacttcgataaaaacagataaatcagcagaagcggtgcgatactgagagaaatccctagatacatactgccgaattctgtacgatagacatcggtttttaacagcttgatcaacatcggcaaggtaaatttgtcagtatcgttgatcaagatcagcggcatcaaaaaattgttccaagtagtcacgaatgaaaatatagccatcgtcgctaatcccggtttcatcaaaggaagcatcactttatggaaaatcttcagctctcctgcaccatctaaacgcgctgaatctgccaaatcggaatgatagacagtctccagatattgtttcaaaaagaagacagtcgtaggcgatgcaatcgctggaaagatcaatggaatatagctattcagcaaatccaaccgattcataaattgataaaaaccaatcatgctgatctgctgaggaatcatgatcaatccaagaataacggcaaaagcaagtctttttcctttgaagcgataagcaatcaatccgtacgcagtcaaggcagagaaataaacattcaataacgtagcaccagctgagatcaccaaactattttggaatccgttgaacacatcgaatcctttattcctcaaaacatgccaattcgctgctaactgtgttcccggaagtaaggatagcccttgttgtatttgctctgctgaacgtgtggaattcatcagaacgacccaaaagggaaaaatactcaaaaacgtcagtaacaacatgaatccataaatcagcagacgttgcaaccgatagtgtttatccatttcttcccctcactttgctcttttcttggaaaaaccggaaaagcaatgtactcaaaagaatcgacatccctaacaaaatgacagaggctgtcgcagcaatctgaaaattccgactaccagtaaacgcttgtttgtagatgaacatcgtgatcgtattgacactattgtcaggatttccgttagtcaataaaaacgggatatcgaacatctgcagacccccaatcaatgacgtcactaaagtatacagcatgataggtttcaataacggcaacgtaatctttcgaaaaatctgagcatcacttgcaccatcaaccatagcagattcgaaaagcgactgatcgatacttaatatccctgaaacaagcacgatcgttgtctgtccataccacatccaaaactgaataaaagagacaatcaagcgtgtacttgccacacttcggaaaaaatcaaacggtcgctccaacacgcctaaatgagtcaggaccaaattcatcggccccatcggaaagctgaacaacgcaaaaaatagaacggctacagacgctgctgtaataatgtttggcaaatagaaaatgattttaaagaaaccagtccctttcaacttcaatttgagatttgtaaaccaagcagccaaaaggagcgccaacgtaatctgagggacaaaattcacaccccaaagaatcaacgtgtttctgattgattgaaggaacaatgcattgttcaaaagattgacatagttttcgaaaccgacgatcgaggcttctgtactccatcctttcaaatctgtgaagcttaaaaaaatagtatagaagattggataaagctgaaatactagaaatgctaagaaaaatggggcaatgaataataaaccataacgattgtagcgctcaaatctagcttttttcactcgaatctcctttcttgtaccttttagacaactgtcccagctaatcgatttctaaatcaggataagcatttgctacggcatctttgaaattttggatagccgattctttgtccgtctctcctttagaataaggtgtcaagcaatggtcgataaacaacgtttcgattgtttgatcatattcagtcagaatttttgcattgattgattggaccatttcagaaaactcattataatggttttgcccgcccagaaagtcttcttggtaagacgatttgattgcttctactacccgttcattcgatacgaagtctcccgtatcttttgcccattgttccaaaaattctgggtcagtagttagatattggatcagcgctgccgcttcttctttcatttctgaggtgtccgtggcaccgatccatgtaccaccccaaaaccaagaagaaggtccttggatcatccgccaatccccttctgttgttctagagccgtctgcagaagtagcattttgtttcaaccaataatgtaatccccatgtaggcagactatatccaaagtctgtctcgccattcattccagcaaaccatgcttctgattgaccttctgtatctttcgtcaaatcttcttcaacaaatcgccgtgaaatatccattaattcatgaagtttatcatcgatgattagcttttcatcttccacccatcctgattcccgcataccaaaaaatggttttgctaagtcttggacactggagatcatctggacagtcccgccactgttttctttgacttcttttgccacttcataaaatttctcgtaatcagctatttgctcttgcatctggtctgcatctgtaatccctaaaagtgattctgctagagaagcacgataataaaatccgccaggcgctgcttgccaagctaaagcatgtaaagtcccttctctgctagttccgacatccttgacatataagtaggtatcacttgctgcttcttccagaccgtattctcctagatcagccatcaatcctgattcgacatatttttttacgaacgcagattctaaggcaatgacatcaggtgcatttcttgttcctaacactggatctaattttgtctcaaactgatcagaaggaatctctacgatctttatctcgtaatccaaagattcatgagctggcaaataatactcattgatcatcgtcgaaagttcgtctgtgaacgtccacacagtcaattctaaattgtcttctgaagaacgttcagatcccgttccacaagcagttagtacgcctatcagactgactcctaatagagcgacactcagcttcttccattgtttcatggcttccctcctttttcttcttacgaaaagaaatcaaaatctgcagccagtcttgtgccggaagtatcgatggcaaacataccaacaaatgctcccgtgaaaaatccttcttgggtttcagcagtataatcatcggaaagttttaagctatcaaaagtatgaccaacgtctatccatactttcccgtcgaatgaataagaataacgatatgtctcataagaaacaatagtttttaaatatatagcgcttacattatcaggtgtggggatgattccgactggttcacataattgtccattgacacaatctaaaagagcgatgacccttcccttctcttcatcatgtgtaagatggatgcttgaccagttcttagtattgtaataattcgtcattcctgctagttgcataaaattctcaggtgaacattctactttcgtcacggcttcaaatgaaaaattctgccatcgtctagcaactaaagatttggtgaacagcgaatggaatgattctcgaccaaacagtctcaaataaccttttcgctcagtcaaactaccgatttcttcggtaaagggaatccttaatgtttgaaaatgcagagggagctgttcttgatcgaatgattctttgataggtgttttttcccacatctgttctggtatggacgggctttccactctattttttggaaaattccctccagttatatacggccatccccctttccactctattttctggatcgcagtttcccttcctaaggggcaataccctctgttttctaaaagcggtgtttctttgtattttagtggtctagctgtcaaatggacaaaataccattcatctgtatgtgtctgaacgaatgacccatgacctgctttttgcaaaggcagttcgggagatgaccaagaagtaatcaacggattctctggatggatttcgtacggaccctcgattttctttgatcgggcaatggttgccgcatgttcatacttcgttccaccttctgcagtcagcaaatagtaatagccgttgattttataaagatgaggtgcttctgtcaattttcgattcgtccctttaaagatgatctttgatggaccaatcaattttctttcttctggtgaatattcttgaagagcgattccatagaaagaatgacgagtaggacgataatcccaaaccatattgaccaagtactttttcccatcttcctcgtggaacaaggaaggatcgaatcctgagctattcaaatagattggatctgtccattttccgtcgatggtatcacatgtaatcaaataattgttcacgtctttccaactaccactcaattccttgacatcggaatagatcagccagaatttcccatcgtgataactcaaagcaggagcccagacacctccagaatccgggttccctaacatattcagctgacttgttcggttgacaggcgtacttaccaagtgccaatgttttaaatcctttgaatgatagatcatgacacctggaaaccattcaaaagtagaaacagcgatataataatctttcccaacacgacaaacactaggatctggatggaatccagttaaaatcgggttatttatcataaagaattcctttctatactaggtaatcgttcaaacgcgacttgatccattctaagtgacttgattcattctttatttggtcatgtgctaaagcatactccgtcagtgtttcaagatcttcctgatccatgacgatccgttctcccacacctgatttatagcttgcataacgtttttctttgattgtttcgaaaaactcctcttctatcaatcgtgcggcagctttcaaccctcgtgcaaaggtatccattccagcaatatgcgcaagtaatagatcttccatctcaaaggaagaacgtcgtactttcgaatcgaagttgattcctcctggtgcgatcccgccatttttcaaaatttcgtacatggctagcgtcgtgtcataaatattggttggaaattcatctgtatcccaccctagaagaagatctccttgattggcatcgattgatcccaaagcatcatagcatcgggcaacagtcaattcatgttcaaaggtgtggcctgccaaagtcgcatgatttgcttcaagattgagtttgaagtctcctgataaatcatatttctggataaatgccattgtcgtagcagcgtcaaagtcatattgatgtttcgaaggttctttgggcttaggttcgatcaaaaattgcggtttatgttcgattttttcaccatatgccaccgccattttgaataaccgcgcaatattgtccagttcgaatctcatatccgtgttcagcaaagactcataaccttctcgtccgccccagaagacgtagttctttccatttagctttttactgacatctaatcctttctttacttgagctgcagcgtaggcaaaaacttctgcgttgcttgacgaagctgctccatggacaaaacgcggatgagaaaataaattggcggtattccaaagcaacttgatcccagtctgttccattttttctttgatcaaatctgtgatggtatctatgttttggaaaaattcttctaaagaatccccagctggagcaatgtctacatcatggaaacagaaatattcgatatgcaatttttcaagaagttcaaaaaatgcttctactcggttcttcgctgtttctaatggattttcgccttcccaagagcgaatattcacagggttgccgaatggatcagatccgtcttgcgtcatcgtgtgccagtaagcagctgcaaatcgtaaatgttctttcattggtttccccaagatttcttgttcaggatcataatgtcgataagcaaatggattttctgttcttggcccttcatactttacttctttgatcatcggaaaataactcatcttgttcctccttgtttttagttgattagtacactaaactaatttacaattgcatcataagcgactttctttatctttgtcaagcgctttcaaaaaattcatttgtcatttaattgattctaattttataacaaatgtttcattgtcgaatggaataagacacgctatactttaacatataacgttggttttactagcagaggaccaagaaaggaacttctatgatctcaagtaaatacacgattcgcgaattgaatcaagcaacgcttttaaaaacgattattgaaaaaaaagaagtatttcgcgcagaattagccgctgcaacagggttgaacaaagcatctgtgtcagacatcactaaaaaacttcttgatgatcagctgattgttgaaacccgggtcggagatgcctccactgcaggaggaagaaagccgatcatgttgactttcaatccccaatctgccacagctctttcttttgatattggctataattatttagaaggaatgctttcttatattgacggcactgtcctatcttcgatctctaagcgtcggatctcgattgatgccacaaacgtgtttgatcacattcaagagtcaatccatcaattgataagagacttgccagaaacgccacatggaattgtcgggatgacgattggtatacacggcgtagttttcgaagaccacccaatttttacgccctattatgatctgcacaaaatcgatttacaaaaagaattagctgatcattatgactttcctatttacctacataacgaagcaaacttggcggctttgggagaatataccttctcttcccattatcaaaaccttgtaagtattagtatacacagtggtattggttgcgggattgtagcatctgggaaattgcaagtcggcaaacatggaaaggctggggaacttggtcactcgattttataccctgatggtcgaccttgtccttgtgggaattcaggatgcttggaacaatatgcttccagcaaagctgtttatgaagaatttgcccggttaaaagggttagactatgtcaactcagatatcttgactgattatgtcaaaaagggagacacagatgccacagctctactcaaaaaaaatgctgccctgttaagcattgggatcaataatatcatcatgatgtatgacccagatgtgatcgtcatcaatagtaagctttacgaaaaaaatccgcaaatgatcgaacaaatccatgcgaacttgacaagccagtttacgaaagacattttggtacgcaacacccgtttgaaaggcaatgcgattttatacggtgccttggcagtcactgctcagcacttcttgaatatacggaagttgaagttgggaaaagaaaaataacttttctataatcaaaaaaagggcagtcttgctttaataagtactgacctttttttgattgaatattatttttctattaaccaattagctatctcctaattcctcatcgaatggcattattttacgtaccaaatgatcataatggatgttctcgcggtataattgtttttcatttgaacagctagtaatttgttctaatgtttgaagtcctactatgtacttctaaaaagaggaaaccttcctctttttagaaagaattgcagtactgttttctttaaaacattttgcaaaacaattagaaaccaaatgtttcagtcgcttggctttctttttttgcagaagaatcaaggtcgtttttccattcttggtatatctctaaaaatcgttcctcttcttcatccgaatatcctttgaatactactttatcgatgttttcatgattaaagaaaatagtcgtttctggattcaagcccgttggatataaggcagccatataatctgcaaaggtatcttttccagtcacttgatctgtgtataccacacctcgccctactactactaatttctgtaatccttcttccaataacacgatacttcctaatggtaataattcttgttttttagtcatcttctctctcctctttttctgtaccttttatatgcttattaaaatacttctctccgtaccattccaattgtgttttgccttcccattcacgatattcttcaggatatttatatttgtaataaccgtgtaaaagatatgggaagaataagtaggcttctgctacaatgaatcctatatctgcgactatccacatacctaataagcttataaatccaataatatctgttcgtacctcattactgtttgggaaaatcagcttccatagcgcaactataattacaactagccagccatatttcatcactagttttaatactttttctaccaatttatctattttatctttcttagtctttgtttcatataagacattttctaatgatcgttttttagttccaaatactacataccctgtgaacattaaaattcctatcaacacccctatccctattactgtgagtgattttaagaaaaaagttataaacataagattcaatgttattaataacataatgagcatatttaccgtgtttatatatgaaaaatatagcttgagttctttatacctttttaacaaagtaactgtccatattactaaatacatgctcaacataattataaatacagatattggtaaaaaattaaatgtaggtgttggtaagaagctatttttatcaggatgttttattccatattcagtaaattttacaaatccgtactgtaaagatactagcaagattgctaatatctttactaatattggcttttcttttcttccaggttgttctacgtcttttttcatatacttgattaacttatcatcttgtaagttcaaactttgttcaaaagttgcattgaatattttactgttcttcattcacttctttctccgtaccttttatatgcttattaaaatacttctctccgtaccattccaattgtgttttgccttcccattcgcgatattcttcaggatatttatatttgtaataaccgtgtaatagatatgggaagaataagtaggcttctgctgctataaatcctatatctagcgctatccacaagcctactacactaatgaaaccaactacatctgttcgaggagtaccattactaggaaaaaatattttccaaccagcccacacaacaattacaatccatccatattttagtattatttgtaaaatcttttctataaaagcatctattgtatttgtattttttctcatctcaagtaatgctacgttgaaaaattttattttactttttaaaataataaaacctattatagaaactcctattaataatactattgttcctaacactgttaaaggctttagaaatgccgtaataaacataagattaatttctactattaaccataaagtaaagttattaacagaacacattgtaacaaaaacattcacacttttattcccatcattttttaaattcatatatatccaacaaactatataacttccaaaaaatagccaaaaaataggctttgacaaaaaatttatgtctgattttggtacaaagctatcactatctggattatctattatatattgagtgagtaaaactaaactatattgaatcagtatgaaagttatggataatacgagtaataaatatttttttccccgttatataatgatcttttttcagtatcttttatcatatacataactagttgatcgtctaataagttcaagctttgttcaaacgatgcattgaataattttttcatgttcgtcaccaactaaattgaatctcaggtatttcaaccgaagatagtgcctttccaattgtttttcctacatgttgtacatccttataaacctgtttcactgtagtaacgctttgttttactccttctcctattttttttgttaaatcttctgaagcctctgatactttatcatataatttataggttccctctttaatatcatcatataaatcaggcttccaaaattgtaccaatttattagctagtcctatgcctccaccaataattgctccaaatggacctgccacagctcctcctatcgtcatcccttccagcggtccgatacttttcacggtatcaatcgctccgccaatcactcctttaccaatactccctgttttcccatattcattgacactactcgagacaaatgtcaccccaagttgcgcataggtcgctatttgggctactgaacctaatcctttcgccactccccaatttttggctccttgtataaattgagaatttttcaaactttcattgacataagtttttataggattcgtcattttgttgaaccattgataccctttaccaagggtatctattttaggaatccattttccttgggttatagcttgtccaaatgattcatatttagctaaaccattgattaacttggtttgtgctttcgaaggcaacttatccgcaagcatccaaaattcgtcatttttcattaacttatctaccaatgcctttggatatagtgctaataattgatctaatcgtttcatattttctgtttttccacttttcaatggattcattagttcttctacttgctgatataattccaggaaagcattactgctgtatgcatcgatctgttcttttgcatttggttttatttgctcaaaccaacttctatcaaaccctttcggcaatacatacgtaccatcacgattgactgtggtgttgttcaacaccaataccgcttgcatcgcaagttcaaattcttctaagctgcttgtaaacaaatgcttcgtttttgcatcgaattcttttaactggttcaatttcttttgtatccgtatgatatctcgctgatagctttcggctcttctcaagaaatcttgttgctggtttcttaacatttccgcgattgtcgggagcgggatattggccaaggctcctgctgtgtgagctgcgttttccagtgaagctttcgaatgttgtaagatggtcaattgctgctgcagattctcttcatccaaatagccttcactagcaataaaactgttggctgctgaaaattggttcagctcctgttggatcgtgtcgatggcactagacacacgtttgatcgtcggcaggatcaagtccgaaaacagcccttttcctgcgttgtaagcagctccggacaaggtatgaccatcaatggcagcgatcagttgctggctccctgcattcagttgcctgatagtcgttcgagcgatagataaattggcagacagcgaactttttaaagttgaagcgtcttttctggagtagattagtcccatggaagcttattcctttcctcttgaaattgtattcgttcttcgtttaactgttctatcatattaaagcattcttggttgaactcttgattcttttgttgtaaatattgtttcaatttcctttgcctatcagtcaaatcttcttgaaaccagctagcttctctattgccaccgctaactagttcttgattcaagttttgtaagttacgcaagtctcgcactaagtcaccttctagcaactcagataaatcttgtaattgtctttttgtatgggtcaatacgtctatttgttgttctgtttctataattttttgattatattcggttcttaacttagaattatttgtttgttccatattaataacctcttatttaaattttgtctggctatctcgtgatgcaatagcagctgctaattttggaaatttatttgcttgtatattgatacagtcgacaagtttcgataaattcgttagcatctggttgctcacttgcgctccttttttcattccagaaagattacttttttctaatgtgcattggtacccactgctaacagatactttatttatccccgaagctgctgcttgagctgctccttggtttgaagcgatttttaccataaactatccctcttgctttctaaatttgtagaatggatcttcttttagcttctcatcttcatactcatcttggatttcttctgctttttgaggttctggagtcatcttctctacagaagaagcttgatttgccattgcgttagtcattcgcctaatcaactcttctaaaaactgagaatctgtttcatttgaatacccttcaaaaacaacgtctaaaatatctccaaattcaatagaaaagatctcctcactgggtatatctccaaaaggatgtggtgctactttgtatcttgagatgatctttccctgttcatttttagcaatagctcgtgccacaactagataaagccttgttccgtatatttcttcgttgtctaaacgtaccatactccctaatggtaaaaatgctgtacttaattgttccatcaatcttttacctccgttggaatcacgatttgtgctaaactatcttcttctaaacgatgtaaaacatttcttggtacaggtaaattttgttggttatacgggatgtttcccacaaaagactgcttttgcaaaatacctccaaaaagtatttgagatatattttctttgagtaaggtgacaaaactaccataagttgcatcgatttttgttaaattatcaaaaacgattacttgtaactgctctttcccgttggctaatacctgcgcaacttcttcagcgtccaaagataatttatctgtaaaattcactaacccattcacaaccaccaagcgcttcttcacgttactttctaacatagcgtctatcgcttctttcaattcgacattttgatgactgatttgtgttcgatcaatgtaaactgctaccttgtcagctattttctctaaagtacctgaaacatcaatgatgacaatatctgcttctgattgaaaccctgtgacttgttggataaaccaaggagtcaatagttggaattgtctattggattctgtgaaaatccccaatgtttttccttgaaataaatggaaagactcaggtattgatgataacttattcaatcctaaataaaacgcatctctttcttttttcggtacaaatccattaaatgtttcatacgtcaattcacttggaaccatcggaattttttctggtcttacgccattccatgcttgttccatcgaagatacttctttttctaaatgttcaagaattgctgcattattttctcctgccactggtaaataaatttggatagctgcgggttcatcgagtacaacttggccacgcccattaattgattgaggaacaaggcttgcacgacctactaagctggtgatttccgtttcatcattcaaatatagagctattttggtagaaatattactcagcatattcatacgaacgctacctactcgattagcagtaaaaataagatagcatcctaaactcgcaccatcacgaagtagctgcaggagtagtccatcgattttttccttacgcgtatcatccgtgcttagaccatcataactatcaaggactgtaacaacgattggtaatgttatttgccttttcgtttcatattgttcaagatttgctacgccgcattttttgaataactgttttctttctattaatacaagagaaatcctatccaacattttttgcagcttttcgtcttcctccaaagtgacaatgtctgctgtgtgaggcaaattttttaatggcaatagaccattattcccaaagtccaataaatgaaagtgaatctgttccggcgtgttctgacgtgaaagattcatcgtaatcgtttgtaatattgttgattttccgtaccccggacttgcaaatatagcagtgtggctagcttttaccaaatcatagttatagatttcttgcgtttgtctggacggtatgtctactactccaagcgggatatccatttttctttctttcgtttctttcacagacggcgtcacgatctggacttccagattgggtaaccaaggcttctcggggaggatataatccgactgttgaaaaatttgatcgatcttgtcaatcactgcctctagttgcgttggtaattcgctagtatcttttccttgaatcacttcctcaccaggatcatagagcacctctgattgccctaaatcattgatcataaaaatccgttcgtccacattctcttcgattattttatctggatcatatgaaacaccggcataaccgctttggaataattcatatacttcattttcgccaactttaagataaccacgaccaggatttatgatttgagcagcatctggggtttttagtaattcattcgaatcttggacactagccattttaagtgcgattttacttgtactatttgcttcaatctgatcatttaccacaccagatggcttttgtgtagctagaatcaaatggactcctagcgatcggccgattcgtgctactgaggtcaattcttctaagaattcaggaacatttgcttttaattcagcaaattcatctgaaactaaaatcaaatgtggtaatggtttactaggataagtgatagctggattagggtttagacgttgtttatataaactcatgtatccattgatattgtttactccatatttagcaaactctctttgtcttttgttcagttctgctttgatacttgccaatgcacgagccgtccctgcaccatctagattagtaattgcccccatgaaatgaggtaatttttctaatgtatttgcaattcctccacctttccaatcaataatcaacattccgatatcttctggagaaaaattaatcgccaaacctagcaaataggtggtcaaaaactccgattttcctgaaccagtcgttcctccaacgagtgcatgtggaccatgaacccgctcatgcagatcccaatagacatactccgattttcctctccagccaatcaaagaacgaattgatttgtttggttcagctttcaaccagcgagtccgaatagaaagttcttctatttttttcacttcgtattgatctaataaactaagactttccggcaccgcattcttctccacttccacgtgctgcaagttcgctaaacgctggatggcttgctccagtggatagctagttggcagatggtttggcaagaaggtctgattgatgtattcgctgttttgattgatcagggtagcagattcactactttgatattcgatgagcgttgtcgttgtctccggcagcatgttcaaggcttcttttccccaaatgactgtcacaccgtaaagactcatgtcttcagccagaaattcattcaatccatgacctgaaagccagctttcatcaaggatcgaaaaaatgtaatgcggctgaaaaacaactgtttcatttccggcttctttgacttgctggcgtcgctttgtcagcatttgataaaaggaattcaggaccatgtcccgtgactgtgcgtgatggacgattccccgaagattcaaatgtcggatcttcgtatggggcagccagcgccaggcactccactccttttgataatccgcttccggaaccaacgtgatgaattcgacatctcggtacgaatgaagaaccgataattggaaaagaatggtttggacggcggttcgcagtacagcagatggtcctgctaatcctagcgtctgatcctttagcggaacgacgattggcgcttcgtccaactgtttataaggccagacgagctgttcttctgcttctttgctcaaatcatcttcttctgctggctggtagttcgtcttgaaactagagatgatctctcctgtgcccactcgaatattcaaaaaatcttcattgcggctcatacgctcatagatccgcgcatgatattctttagccatcacagccaaatcatctatagaaggattcatatacgctaacgcttctttttgtttttgctgcagcttgttcagttctgattttttttgaagcatatactggcggtaggtggtttcccgttcctcgtttgttcgtttcgtttcttttttattggtcagataactggaaactgaaaaaccagctgtcaatagactcgcaccacccatgctcagcatcatgatcgggtttcctccgctaagaaaacttgtggcaccgcttaaaacgaccataccaagtggtggcacgattgttttcaataagtcatttctgccttctgtttcttttggtttcggtgcaaggatctcgatttcattcgctggttctttcaaatggatacgcgggcttcttctaaaaaatgggaaatcatccggatattcgggaataaatgtttcttctactagtttccatggatccagctgataatttgtgcccagactggtgaaacgcagctgcttttcccgaacttcgatcactaaacgatcgaccatcaaccgatctcctacgccaaaggaaaatgtaccttcttgtataagctgatcgttatagtaaacacgttccttactcggatagatcttcagctgatattctttggttttaggatctataggaattgagatcaatgcatctgtttctaaaaaaactgccgattttttcgctccggagatcagaaaatctttttttggcttattcgtaaacacagtttctagctcttcatgtcttaaaatcagcaagtgctcatctgacttgattggttttccgtcacacaataacttctggtcttcataagtgaagctttgaccgttaagtacgacttgacgctgtttctcggtgagttgttcatggacgaacgtttcaccaaaataaaaaatatcaaagaggatctttacagatgtccggatttgatcacttaatgggacgaaccgatcagttggcttcatttccatcttctcctcctaacaacttcatgtatttattgatctcttcttcatactttgtgagcaattcttgttttttctcacctttcatcttgttgttggtctttgttgcatcgtataacttggtataagcgtgtaagatatattgattgtcaccaagattcttagcgacatccagtgccttatcgaagttcccttttccggcatagatccagtaaagcaatgtgttgtcgctcgatttcagggacaagttatttaaaatagctgccttttgttcattggacaaattgtccagttgtacggcactgactgcggcaacatatttagcaccagtgggcagtttttcaggttcgtcttctttcaacgtattcaaaacaccagcataatcattggcgatatattgtgtctcagcggaactgatacgctcttgtgccggtagtttatccagagcatagatccctgtcgcaacagcaaatccgattgtcgatacccccaataccaagctgctccacttaaaaatctgatgatttcttttactgaccacttgtgtttctttggctcgtttttgcttttgcttcagaatctccgttgctaacaactgatcgatgatttcgatcgtatctgcttcgtttattttttttgtaaaggcatctttcagcgtaccgctgccttcaatcagcagttcatagtttaatctaggatgcaggatataaaggaccaatgcccgatattgcttgataaaatcatcttcttcattgatataagggacgatcgtttccataaatcctcggtgcccgataactagttcttctccacgaacgaatagattagcaggatggaggaaaggctgagctggacggtgtagaaaatccgttaagaaatggattttttgtgccagcagcaaacgttggaaaagttcttcttttttgacgacttgttcaagcggcaaggtagccgattcttttttatagcgaataaccagcttttcttctgttgcttctataatctctcctgacagcattcggataccatgtgctaaaaagtgctgatactgtgtcagtttgtccagcctatactgattggcctgcagagtcacctctacagcgttagtctcattcataaatccaatggtttggtcgatattctgtatttctctcacagtgggttttcctccctgtttttttgtctttcgatcacttgtaactgatcgccattgcctaaagaataatcagctaagatggcctcatttctcaaatggatgggtttattcaaaagagccaattcaaaattttcgggaagtcggatatgaatgattggaaacgactcttgtaaaattgttttcagtcgtgccacagtgacttggcttgggactttcagatcgatgatccgatcagctgtatgcagactgatactgattgttgtacctttttccatgctacacgccactcctgctccttttatttttgtgataagctaattgtttccctaaaaatagaccgattcctatgcataggcttccgccaagaacataaccgctaaaggtaaccagctgatttactttcctttgctgcatagtcgaagaagaagtactttggactgaagcaacagtgtctccttctttgaagagataaggcattactttttggtcaagagcttctggctcagtcgttttctcaaaaaatactttttcctgtgcagttgagaccagttctttttgttttgctttcaattgctgatctttcgcttctttctccgccaaaaacaagtcgttgatggcaaatgagacctcgtttccgcctgcttccgtttgctgatcctcatagattacctgattgttgattataagagacccttgttcagcatgcacacgtgttccgtcgaagctaataggaaaaagaacactcaaaataccgatgatccaacagattttcctttttttattcatgattcacgctcttttctatcttgttcttcaggaagaacaatgagattcagaaacagtcctaaaacaagaagaatgacgatcacaagataactgatccaactgatacgtccgccattcagcaggactgtaaaaccattttggatattttggagcggtgacagccgatagagaaactcggtgaatgaacctattttgaccgtcactcctaataatggtgtgagtatgaaatacaatcctagaacgctgccgtaaccatataaggtaagtttcttgaattgccgtaaacagcctgtgacaagcagctgcatgctggcaaaggtcaaaaaggcatagctgaaccacaacaagcgattcgctgtgccagcacttgcactggtagcaccagcataaaaaccggcaagtaagatcgtcacaaacgaaagaaggaagacattaggaacgttcagccatatccttgtcggctgaaccagcagattggcttctgtcactttacgttttttcataaatcctagtaatgaaagccctgcgaccataagcagaatcgcgccagttaatgttgcgtaataaggaactaatgagatttgtcttgtttgtccgaatacgccttttccttggatcggccgtgacaaaaaatgaaaaacttgtgtattgtctgctccgccgtttttcgtgttggacaacactttttcaaaggtctttgcatattcttcgttttctttcgttatttgcttcgattgttgaatcgattgatccagattggtgaggatcgttgtcgcatttgactgaacatcagctgtcgttgtttttaattcttcgattaccggcgcgatatctttgacttctgcagcagatttctcggtgctagcagccgtttctttggatgatcgcatcagttcctgcatcgtttggactaaagactctgtttgggtggcaatttgtttcgtctcgttttcttcaggatgcggattttcttcattaatcactgatgtggcttcgatttttgctgtttcgccccatgcattgtatgaatccttgatttgccggttggcatctgtgaaccattgattcaatttatctgcttcctgtagcagtttttctgggatggtcatcagattcaatgtgccgtaaagcgtagggctgacttcttctttattctgatctgtttcatgcccaatgaccgcttgcagtcgattgatctgagtctcggtgtccttgtagatcctgtctcctgatttcttgtattcttcatataatttatcggtaatgaccgtttgtttctcagcattcgtaatattgtcataccgacgataaatcgattggtctttagctaattccagaactgttttcccttgattttctgacgcacggatcatggcagcataagactggactgataacgactggttcggattaccgaaaagagtcgcgatttgctgcgcagcagtatccagtgcttgtaaatgtgtcagaattttaggcacatcatcgatcagcggctgatccaccgggagataaacggcatagtgatgatcgctttggaccgtttcgttcctgcaccatgaatagtgaagttcattataagatgtcgcttgttctattgagttcaaatgccagatgatcggcaggttgaccctgaatgtcacctgtttcggcaattctttttcttgcaggtcatctgttgaatcttgcgtactttcttccgtttcttcgattttttcaggtgctgcgaatgtaaattgatgatctgaatggtcgatgatcgtagtttgatagcgataaggatgcagttcatcattcactaactgttcgatttcttgcagcttgggaccatctagcatcacactgacttgttcttgcgaatcagctggtaattggatcgaataagtattctcttttgtcgggtccatggaaagcgtgactgtttgctgcggaatggtgatcatttcagaatgtccttgtctaggatctaaatacgtgaaatggacctcttttcccaatggcttgttcaaatcatgggcgtattttcggacgattgccagttcatccaagtaaagggaagcttgatcaggtgtgatcacttgctgttttgctaattcgtccactaactgttccaagctcttgtctgggatctgagccaatgaggtctctagtgttccttgatactcagcgttcaatttgggtgtgttccctcccaaatcggaaatcagctggaggatagctgttttcacttgctcggtggttgctgtatcaggagtagctgcaggatcattgtaataagtcgctgcaatctggcttttcaactgggtcaactgttctgtctgggcttgtagctcagcgatttctgcctgaagttccgtgattctttttatttgtgtcacttggaaaagaaccgattctgataaaaaaccggcgtacacacctgtgctttcttgttcattgttggtataaaaatcacccaactgggacaagattgtttcattcaattgatcatgctgctttttatagtctgccgtatctgtttcccattgttcgttgagctgctttttttgcatcgctacttgatcattgaattgtctgatcgattctttcagtttttcatttgcctgcttcgtgtagtcctcgaccgattctttgactgtttcagtcgattggctgcctccttctaatccttggttgtttctgtctagcaactctttgaccgactggacaaaggcttgctgctgggcactaaatgactgattgtctgtgtctaaaatactggctgtttccaacacattcgtataattgccggggatttctttgaatggactgtaaatagatgattccaaattcgtctgatagtttacttgtgttccggcgatttgattcacgttttgctgtgcttcaaataaattcccgacgatactggaaaaatacatttggataattcgctgattgaagtccgttaagatcatgttgacattgtcttgaatcatttgattcgtgatttcattttgtccatctcgaacttgatattcgatcaatgctttttccggattgatactttgcagcgatagcaatttttcagaaaaatcttggggaatgatgatctgcgcatcaaattgcccgctttctacaccagctgtagcgatgtttcgagtggtggtttcccagcgatttttactatctttattgatcaatgtcacaaaatccgaacctaatgaataatttttgccttcaaacactgctcctttatcttcgttgactagtgcatattgcattttccctgtaggatcagttgtactgatcgtgacattatcatctttgaaacctagatagatgaagaaaagcaatagacatagactggcaatgattgtcaggaataaagaaacctttctttttaaatttattttcatatcaaaaacgtccactccttcccaatgaatgacgaaacttttttgcttcaagtaataaggcaaatttttgtgaaaacttattgaaaaatttgtacaaaaattggtcctaatacctgtgttgaacaagcccctattgaaaggaagaggcgatgagggttctcactgcctcttccatttgcttaaaatccaaatgagctagcgtcttgacgatcccgctctgccacagtgtcagcatacttgttcaactgttgattgatgctttccaataactgctccatctgtttgacatttccttccagctgattgtattgctctaaatatgcttggaaggcttgccctttccattgttgagcgatttgttggttcatggaattgacctttctgatcgcatcttggatttgagatgctgcctgttggtagacctttgcctgtgatttaagctgttcgggtgtgactgcaattgctcctgccatgtttgttcctcctaataaaaagttattttttgttacgcgtacatcataaactattttttgtctatgtggtcaaaatgtagcattcacgcacatcatgtgtcgtatacgatgtgttattttacctctttcttcctccttttttgactggtcaaaaatccaagaaaaataactatacaaattatttctaatctcacatatttttctaagtatgacctttttaaatttattacaaatcactttgaaataattcttaaaaactggctgatattttaatgttttatgttctttctcaaaaaaatataaaaaaacagctaatatttacctgacaatactcctctatcctccttttttttctatccggaacgaatcatcttgtaaatgcagatgatcctccttcgttttatatgtggtgaatattctcccatttattaagtacgtaaatatttgaaaaaatttttttgatttggtttttattgtctcattatccttttgatatttttcatgcaaaaaaatagccaaggtatttgatgtaacacctcggctgtctctctttttatttgtctactactagtaattcgtctaattgaaaatcgatttcatagattctttctacatttctcaaaagatcatgattcattttatgatatttcgttgcaccaagttgctgacaaatctgcaacgcttggtttactttttgtcttcctttttcatttcctttgatcatctcccagattccagtgagtagggaatactgatttcgttcaaagaacatatcttcttctaaaaagactgcttcaagttttgagatatatttccaaattagtccgcgttgttgctgctggataaagtggataatcgcgtttgccagcatccgaaagctctcattctttcgatccttgctgttttgataagcggaaatactgactaatgctttatctaacactaaatcgataaagaatggatcaaaagcatacatacaatgattgaataacaccaactcatagttcgtccatgtctgtgcataaatcagatactgataaacttctgaatcagcaacagcaattggctcatctactatacgagcaatcagtaatttacataaactagctagatgtctctccttttgagtgatgtctcctttttcttcgcacaggctgatcaaatgttgtaattcttctttatcttgattcataaatgctaaaaccatttctttcatcatccggtccatgtttgccacttccggcggataatcgaatatcctcagttcatcataaccaagattgagtttttgtaaaaaatatgaaaatttgctaactgtcgtgtctgcttgattttttacaaaccgttcgtaaacggatcggctgacttcctttccgcataattctgctacggagatacctttttgctttcgaacaaattcgatgatctcccatacttccattttgccaactcctttataaatatggctctccttcagttgaaaacaatcgcaacatgattttgtatgaaataacatataccaatccatctgatcttcatttttcatttctaaaaatcattttttcgtaagacgttccttgtttttcatgatatcatcgctgttaaaaccaattgttcatttaccagtatttttaaaaaaacttaatcataatagttgttttataattttaaaatccattaagggataaagaataagcagtaaaattatacatataatacgttattttatttttgctatatgaaatatactcatttttattttttctagtagaattttatcttctaagtattccccccgtatgaactatttaccattgacaaacgttgaacaaaaatttagaatattcaaaagtttgacgacaattatgaaaattcatgtcgtgctaaaggagttttgttattggatgaaaaattagatataaaaactgcgatcaaagacacgttacctaccgtttttggttatatcggtattggacttgcatttggtatcgttgggaaagctgccgggtttcatccgctagtcgtcacgttgatgtccctgctgatctatgctggttccgcccaatttatcacagtcagcatgcttgctagccatagtccactgctttccatcgttctctcgacctttctagtcaattcccgaatgattttgatgagtatgacgattgccccttatttcaagaaaaatcggctacttcaaaatctgctgattggcacattgctgacagatgaaagtttcgcactgggaatgaataaattgaactatactggacaaaagttaaactttcgttggatgaatacagctaattggatttcttatttgacgtgggtgggttcttctcttgttggcgcatttttaggtaattttattactgatccgaaacagtttggtttggatttcgccatcgtcgctatgtttatcggcttactttatcttcaagtcatttctgatagaaacacctctaaacgattacagttgatcctgattggtctcactttgattctggtatatgtcggactgatttttatcccaagcaacttagtgatcgtagttgtaacattgattgggtgcggattgggggtgtggatcaaacatgccttcttttgaatttacattgctgactattttaggttgtactctagcgacttggctttctagggtcctaccgtttgtcttactgaaaaaattcgacttaccgcgaccgttgcttgagtatttaagttttgtcccaatcgtcattatgtctgctttatggttcagcagtctatttacccaaaacatcggacatctgccgcagattaatctcgaaaatgctttggcttcagttcctacgcttttagctgctattctttcaaaaagcttattggtgatcgtcttggtaggtattctttccctttcattgattcgcttattataaataaaaaaacaggagcttatggcaaattactgtcatgcgctcttgttttttatttatgataagaagaaaatcggcgtattcctacttatccgttgaacggaccactaacaacgacttttcctaacatatgtcctgtttctacgtctttggttgcttgtttcaagttcttcgcattgatcccatctgaatagaccttgctcaatgtactacggataatcccttcgtttgctaaagcagcaatgtgcgctaaagcttctccttgcgtttcgatttcatagttatagtctgttttagcgaacatgtactcccagtcgaaactgatagattggtttttccaaacacctatgtctaacggctctttgattcctacgatcgttcccacatgtccaaatggtcggacaaggtgcttgatctgatcaaagtagcgggtaatatcaaataatacagcgatatactctacttgatcgattcctaattcacgaaaacttttacttaagtcttgatgataatcaattggatagtctacacctgtttttttcagccattcaaaattcttcggacttgcagtcgcatagacttctagaccagcccaatgcgctagttgattcaaaatcgaaccgacgcccccagctccgttgatcactaagatttttttcccgcggttggcattttcttctggaatcagaccaaatttttcaaataacaattcataagcggtcaatgaagtcaatggcaacgctgcggcttcttcatctgacagatttttcggtgcaagagcggcaatacgttcgtcaaccagttggtattcttgattgcttcctgctcttgttgttgtacctgcataaaacacgcgatccccgacagaaaatttttgcacttcatcgcctacagcaacgactttcccgaccccatcaaaccctaagatacgcaaagcatttcttatcccattatcttggcgaagtttcgtatcgacaggattgacagatactgcgttgacttttaccagaagatcctgtggactaggtacaggtacctgttctttttcatccataaagcttttgggatcatcgatcggcaacccttcataaaaaccgactaccttcattaattccttttctgacatacgaattcctccttagcttcatcaagttggagcatccatacagtgttcatttcaatatatatagtatgttatttgttccaccttttttatccatcataattattctcttacttaaagtaaactatttgcacttttttggttaaaaaagaggttgcgacaagacttttgtcacaacctcttataaacggtgttctcctaccaactcttcggtcacaagttacaatattcataaaatatgaggagctattttttgaaattgctccttgtaactcagagttaaacggcaggctcacaacctctgataaacggtgctcaaaagcttgcatctgcggtaataagtccaaccaattcaaaaacattaggagctatttttgtttggctgttcttatgacttgatgcaggacagctttttcacaacctctgattcacggtgttcaagcaagaaatcattgtccactgaaaagcgttggatgttctttttcaaaggtgtctaagatctctcgtacttcatcggtagatttcgtattcatcaactgaacacgcaagtcatttgctccaggaaatcctttgatatagattttaaagaaacgatgcagtcctgtgatcgaacgcgggatgatttctgaataatgatcttgcagatctagttgcagacgaagtaggccaatcagttctttttctgtatgttccctcggttctttttcaaatgcataaggattcttgaaaatcccccggccaatcatgatgccatctacgccatatttttcagccaattcttctcctgtccggcgatcggggatatctccattgatcgtgattagtgtttgcggagcgatttggtcacgtaaagcaatgattttaggaatgacttcccaatgtgcatctactttactcatctctttacgcgtacgcaaatggacagaaagattggctatatcttgatgaagcaggtgactgatccattcttccatctcagacatttccgtatagccgatacgcgtcttgacgctgacaggcaaaccaccagttttagccgcttcaatcaattgtgccgctacttctggacgaaggatcaagccactgccttttccacgttctgctacattaggaactgggcagcccatgttgatatcgattccttggaagcccatttctgccatagcaatgctcatttctctaaaaaattctggcttgtctccccaaatatgggcaaccatcggctgttcatcttctgtaaaggtcaatcttcctcgtacactgtcttttccatctggatgacagaaactgtctgagtttgtaaactcagtaaagaagacatccggtgctgctgcatgctttacgacatggcgaaatacaacatctgttacatcttccattggtgctaaaacaaaaaaaggctttggcagctctttccaaaaattagtagtcatttatttgttactctccattctatcaagcagtgaagtcgcaatctttctcaaaaacattgtcattatactaggaaacaaaaaaagaagcaaagtgaacagcttaaaagatgtttctgattgaacaaaaaagactgtgacaaaaatcttatcacagtccattttccggaataaatggtgttctcctgccaactcctcggtcacaagtcacaatattcaacaaacatgagaaactgttttttgaaattgttccttgtgactcggagctgaacggcaggcttacgacctctttcttaaatggtgttcaaaagcttgcatctgcggtaataagtccaaccaaacgaaaaataggaggagctatttacccgtttatttctctaatactcagatcaaaacgctgatttcacaacctctttctaacttctcaatcctcttcctttattgatcaaataccaagtaacagcgtacaaaacaacgatgaataacacaagtacgatcatcgatgttgctactggcacatcgatcgttccaaggaatccgtaacggaaaccggagatcatataaacaatcggattgactttcgatacagcttgccaaaatggcggcaacatagagatggcatagaaaacgccacctagataagttaacggctgcaagacaaatgtaggcacgattgatacatcatcataagactgagcaaaaatcccgttgagcagtcctgctaacgaaaacaagattgccgtcatcaataatgtaatgatgaccatgaaccatgaatacacatgaagtggtacaaagaacaaggaaatgatcgttacgagagagccgacgagaatactgcgacccactccgccaatcacaaagccccaaataatcacatgcgtaggaacaggtgctaccaagatttcttcgatatttttctggaatttttgagagaagaaggacgaagaaacgttggcatacgaactagtgatagcagacatcataatcaaaccaggcacgatgaattccatatatgaaaaaccacccatgtcaccgatccgaccaccgatcatttttccgaaaataacaaaatacaaggatgtcgtgatcactggtggaaccagtgtttggacccatatacgcaaatagcggttcgtttccttgatagctaaactttttaatgcagtaaaataaagattaaacatttttctcctccgtatgatcattttcttctgtgattttcaagaacagttcttctaaacgattcgacttattcctcatagaaagaactttgattccttgtcttgtcagctgatcgaagattccgttcaccccttgatttcgttcaacttcgacagcgattgtctgttcatcttcaaatgtacaagcgtatccttcaatcacaggtttggtctcatatggcgctaaatcaaagataaatgtttcaaattgaagtttggatagaagctctttcatactagtattctcgattagttcacctgattggatgatcccgatgttacgacaaagcatttcagcttcttctaaataatgcgtcgtcaaaatgatcgttgtaccattttcgttcaattctcgtagaaactcccacatctcgcgtctcaattcaatatcgactcctgctgttggttcatccaagatcagcaaacgtggttcatgcatcaatgccctagcaatcatcagtcttcgcttcattcccccggaaagcatacgtgcacggacatttctcttttcccagagattggactgcttcaaatatttttcgctacgtttcatcgcttctttgcgagagacaccgtagtaacctgcttgattcacgacgatttgctggaccgtttcaaagggattgaaattgaactcttgcgggactaatccaatctgttgctttgctcggactagatccgtatccagatcataaccgaagaccttcacttttccagatgttttattgactaaagaagtaatgattccgatcgttgtagactttccagctccatttggtcctaatagcgcatagaaatctccttctttcacggaaagatcgattcctcgcaatgcttcgaccccacttccataaacctttttcaaattatttatttcaagcgcatttgccatttatttcctatctccttatagacatgattctttattgtatcatggaatacagcagatgaaaaaacaacttggttccagagaaaaatcaggttgctgggctcaggaaaatctcctaatgaaagacatcaatcggacgaagtcagacaaccttttcagaaaaaacaaatcgaagataaaggattactattcatatatgcaacaaaaggagcgtgagacaaaagtaaagaacacttttgtctcacgctctaaacacgtataaacggcagaagcaaaagccatgatttttgatccaataaatactttcgatcacttcgcctatcccaatacatgccactgccgcttttcatcaaatgacgcggcttccgtttttgcggtttctactaaagtctctgggtaatccaaaactttcagcaaagcaatcgcatttcgggtccttgaaggtccttcttttaatttgaaatcaaaactgattccttttccttctgttacttgttcttcaaagtggacattctcacaataattctttaaaatctctgtcaattcgatatcatgtgtggcgacaaatgctaaagatggatactccgcaagccaccgaacgactgaagcggaagaagcaatccgttcaatcgtatttgtcccttttaaaatctcatctacgaagcagtagcagcgttctttggaagccacttgatccaacaaacgtttgatcgatttgatttctgaaacaaaataactgtcgccttcaaataaatcatcttcgattgccatggaagtcaacacatgtccagattgcagggtaaactgttctgcaatcgctgtttggatcgtctgtgctagaatacagctgatagctatacttttgacatacgtagattttcctgatgcattggaacccgtgactaatgtattcttctgccagttgactggattcactaccgcttcttttaacaatggatgatagatatctttcgctgtcacaccgccctcagtaaattccggacggtaagtgatgggcatataagtacggtaattcaatattgcagcggctacttccagttctcccagcaattcccacagcttgatggcttcagttgaatgcttttctaatttagtgagaacgaaatgataggagataaatggcagcatgaacatgatgttgacatattcaaaaatcaactctgcttcactcccgctcttcatacgaaatgaaaaacctaatttagggatgtctcttaatggtttagtttgctgtttcagctcttcttgaagtggtgtcggcagttttgctaactgattggcggctgaaatcgttgaaaccaaataactcatgctattcagctctgtttctagtgtttgtttcttcactagataatagaccgtattgaatactaacccaccgattgccaaatagattcctagtacttgacctaaaagaagcaaacctacacccaccagcggaagcaagccaagaaaaataaataaacctacgcgtccaatctttttactttttccatccgctagatattgttttgcaaaattatgatctttttttcctaaacgagcgaattgatattggattttttctctcagttgaggattttcctgataaaaagcaatcagtttttctaactgctgatcttcgccaaaatcaaagctgcgtaaacgttgatacaacgcttctgaacctacactagaataggtactgttgattccttcgaatacttcgaacatatctaggtcataccaagtaagatcatcgatttcgctatcccatgaacggaacttcttctccgtgagccatgcttccttcaagctttcttctttatcaaatctcggttgataaggaatttttccccatttgctacgaactgtttcctttaatttcaaacgtgaaaaaatgtctaaagcaactaataaaataacagctgcaataataattaaaacgataaattctctttgattcatatccctctccgttcctttatttgttagctttagtatagcactgttgcgctatttgaaaagggggtacaaaaataactgtcttcgttacctaattcgaatcaatcacaccaaaataaaaacaccttccaaaaaagaagatgtctttaaaacgagatacaatttttttgtcattcacttcaggtaaattagagccaattaaaccctccgcaacttgacggagatggagaagatgcccctgtctaatttagcggtcatctctcctcccattccttccaccaatttttttgacaggtaaagcccgattccgctagattccgtatttgtgcggctggtattttctgtataaaaacgctggaagactttttcaacagaggtttgcgctcctgctttgataggattggccactgttaatcgaatgaatggatcctcttttgaaaatgtcacctttgcttgtccatctgcatagcgcaataaattctgtatgatattttgcagcactcgcaacaacatgagcggatctgctaataccgttgtatttatcgagtgttcagcgaacgctacctcgatattttttacagaaaattgttcataaaaagagaaaaatacttcttccacctctttagaaaaagaaagcgtatggagatccatttctttttgcttcgtctctattcgagcaagatcataaaactgatccgtcatactgagtaatcttgcaacagattgtttgatgatcgttagatacttctcccgtttctccgtatcctctacctgttccagtaattgtacataaccgttaatagcagtcagaggagttctgagatcatgagaaaggccgacgatctatagtctgatgttttcttccatttcttgaaatacttgtcctttttgttcattttcatccacccatgtattcagtgcatctactaggtccattagattcttttctcgaaattcgactgaaagacgaccaccatattcttgtcgttcagaaagagtggcgattttcttagtcaatcgcttgatttccctttgcaggaagaaaataaaacttcccataaagataacaacgagaagcaatagccacttaatcaaatctaaaccccactccccacaccgtatgaatatacacagcatatgcctttgctagtttccctcgaagattggaaatacgcatattcactgttttctcactatcaaaatatggttcttgccaaactgtttcataaaggtttgctcgcgaaaatacttttttcggatgttctaaaaaaagcttcagcagatcgaattctcttcctgtcaaatggacagccacaccattcacatttacctcccttgactctttgtccagtaagatttccttgtaatagatgcgttgcgacagatcttttacttggacagaagtctgatgacgaagttggatgccgattcgtaaaaaatcatttactttcacataatctgttctgttttttctcgattaaaaaaaatgtagacaacagcacaatacattcgattagtatgtataacgaaaaaataaaaacatccgttatcctaaatgaatggacagctacatagataaaaaacaaaagatattgtaagccaaacaacagaaaaattcttctataagttttgaaaaaagaaacaccatttaaccgccaaacaacaaatttttgccgataaaggcggaaatagctcagtgtggaataggtaatcaaaacaataaccaataaaatagtaatcgataaatcagttatcctttgtcttatgtcccacaaataaatcaactgcaattctgttttccttaactgttccattgggatcaaaaaaggaaagttgtcttccaatcttgcttccttcaataacggaagatatctatcataggtttcttgtgcagtcccaatcaatggaatttttaatggttcagcaaaactatttcctgtcagaatatttctatgagaaatgggtagattgttcaaagtgaatacatggatgatattcggctgattgatgatgattgcctgttcttggtcaaaggcaaagatttcttgttcatcttggatggtataaaacaaaacatcctcttctttttttgttcgtctaccaggattcgtttcattcaaaaaccaagaacgaagttgaacaaaatcgggcatcattcgttctgggattaatatgatttctcgatcctcatttttatcaatttggataggctgatttgttatgctgatgagcggatacttgtctaaatagtttgtatttacataaatagattgatggatcaaaggattctcttcttcaaaataagcacttgtatcaacctcgattgctccatcatccaacagttgcgaaagcaactttgttttatctaatcctctcatatcttgagaaagatctgtcaaagtcgcttcattgccaccaagtcttggatagaaaacggcatgattttttatttcttcaggtactgcttctggtgtaacgaatgtgcgagcatattcagctaacggaacaagttgtaccacactaaaaaataaaatcaacattttgacagaatagatagtataaaagaatcctttaccaaaagtttggcgatttagttgcttattcaatgaaagattgcctagtaaatcaatcacaaaaaaagaaatgattagactaaaaataagcaagaacagttgcactagaacaaacaaatgattcactgaatgtagaacaaagaagaaagctatcaatagattcaagagaaaaaggatgactaattcttttaataataatctttttaaaatttttctactagttaaaccatttaaacgatagatcgcaatgtgtctattgttctctagtatccataaaatcaaggaaaggctatagaaaagagtaaatatcacaaaagtagatgcttctaatgttcgagatggcgcaaatgtttctatgtcactctcatattgaaaagatgtgggttcgtacgctgtctcaaaggagagattgtattcatcagataattttgataggaaactatctagagttttttgatctttcgtttccacaaaaaaatcagctggatttagcacctcagccatttgtatcggtagtataaaaaaatcttcgtttttcagttgtttattttctaaatattccgcatctggatatttctctaagtcagatgcaaaataatttttttcactgattatttgaggctctatgtaaaaattgttcaaaagatgtgtttctgtttgcttggaaagaaaaaatgtatgtgtttcacctaaacgatcaaaagagatttctcctgtttcagaaaaggtatggtctctcacaccatagaatgaaacttttgccatatagtttacattcaatttttctgagactgattcaagtatttctagaaccctagtttcttgctgtggatctacgataaattctggaaatctgaacggtgtaaaatactcggccgtgtttacctttttttggaaatcttcttccctattcacattcctaatggcaacagccaatgcaagacttgagagtatagacaacagcaaaacgatttttttcaatactatattagtcatcggcaaaactccttgtttttagctcctattgaaagaacttatctagctcaccacatctcaatcaaatcatatcatagtaaagacggaaaattgacttcggcaaaaaatacatacattttttatttctattggttgacaccctcaacagccaaccaataaatgcgtttaacttaagaaaacaaaaaggcaccctccaaatttggaaagtgccttatagtgatagaattgactgatatcgttttttgaaacttcaataaatgatttacttaaaggtttgtattagtttacaaatagtcataaacccatgccatttataggaacatgccaaagaagtaaaataaaaatagacatttttattttacttctcaatagtacaacctctactttttatccaaaaaataccaatagtttatttaaatatgatcggacgttttatcaagagatatccttcaattttcaacaaagtccactcaaaatagttgagtggactttgttgttacttattagagaatataatttcctctccaactttaaaatctggccactcattgggtttagcaattattgctcctggtaacacttcattttcaccatcacggaaatagatagaaacatgacctaattcattgaagtttgcattagctgccgaaccaacctcaccaattatatattctttaccagcaatagtaagctttccaccttttactataacattctttttttcatccacatgatcatgtatgacgctaattgagcgtaattctggtgttgctttaggaccaaaaagaatcaaaagacgctcctcttggaaatctggtacaaggtcccctatttcagtgattgttgttttatacatcttgccacttcctctcgtattaatacaattaaagaaattacatagcaaaactgtttactaagtttaacttaagttaacgtagaaaaaatatattttcaagtcgtatttattggttacacggtgcaagtagcgtccagtactctttcatattatctaattctagtctattaataactcattcaccactttatcagtagttacaataacattaattaattgatgttctaaagcaagttttattgactcaaccttctctattccatatgcgataccaattaccgtaggaattttttttatgtcttccagattaacaccgatcacacttttatttagctgacaatcagcctctttaccgttttcatcaaaaaaccgcgagttaatatctcctttaatcccacttttctttagctcagaaatatcttgttctttgatatagccgatttcagccatagtacttttctcgaatggactagcaaccccaaccaaggcaatatcaacaacacgaccttcttctataacactatagatagtaggattttcgaataaatcctctttaatacgtggattagatactaacgctggggcgtaaagatacttagcttttcccctcatttttcttgctagatcatatgacaattgattggaatgaatatcaacataatcatcacccatccccccaatcagtggatatactgtcacatcaggttgattggtgaaaggataattatcgactagttttctcaatgattttccccaagacattccaatttttgttgctttttttgatgctttttgcaaatacaaagctgcttgacgaccaatcatcttatcaacttcagatccagctaagtccattgtatcaacgactatagcgcttttcaggttgaatttttgctcaagtttcctttcaagttctaccgagtaaacactcttgctattaatgaatatttcaacaagccctgcttccttagcatcaattaaatttttagaaactaacgatctagaaacgcctataattttcgcgatttctgcttgtgtcatcccttcttcataatacattgacgcaattttaaccaattctttttcatcagcgcgatccataacatctctcctatttgcctttttagtaaaatataacatatagattggcatatgacacagataaaaaaattattagtaaaaattgattaattcgtttttcttgtattgatgaaaagttatctggttctataacaattgcgcctagaagagcttcaaccttactgaatttgaaatagatggagatatgtcttaattctttaaagttcttatttgtaacattcaccaacgtaagtaacgatgtattcatgttgtctccaattcatgaatcacataatttgtttttaactcatttgttatattttgttcaaatagaatcagtaatttttctttttcaaatgcagaaatcattttccctacttctaaaacttttcattaaaccaaatcatcttcctcccttaatacattccaatactgaatacccaagcaataactactgctagtacgccagtgatgacgcgactatacaaaatagcaggcacaccaacgcgtaccgtttcgggtttagcttctcctaaagacaaacctactggaatgaaatcacatcctgcttgtgcattgatcgcaaacaatgcaggtaaagcatacacaactgggattgttcctgcaccaatttgtgtgccaatcaatacaccaacgacctgtgcgataactccaccaggtcccaaaatcggtgacaagaaaggcatactacagataaaagcaatcgcaagcatgcctataatcgaatcagaaaaaggtgccagtccttttgcaattaaatcccctataccagtataattaatgattccgataatcatggaaataaatgccatgaacggaatgatgttctttaaaatcatatctacagcatcgcgacctgcttggtaaaaaatccccatgactttcccaatagcacgagaaaatttaactaatatactgtctttcttagcattggctgagacatgatctgcttttactttggcatatgtttcatcaaagtcttcatcgacgacggaagctggactagtagccgcatttgcttcccccgtcaccacgtcccccacaacttccacatcttcaggctttacacctgacacaaaaacatcctctgtaatatgttttgataaaggtcctgatggcgaagatggcagtatatccacggtcggaatacgtttcattggataaacgccgatacgagcagtaccaccacaatcaataactgctgccaggatttcttcctctggaactgaattagagaaaccatcaatcacttcagcaccacttaaatctgccatccgttgcgcaactgggtgaatcccaccaccagtcacagaaatgatttttgttttcttaccttctggttgaatttctaagcctcgcccccaaccattactacccttctttacaaaaatttttttatacatatttcttccccctacgtatgtttagcctgattatgccacttctgttttagccgatgtttcacgtttcattaagaatttagtgattttttcagtaatgaagccacgtacaaaaattataacgataccacataaaaaataacgaactgcaagactcccttgatcatacccggctttcataacaccattggcaattccaagataaacaaacaattcaccagcatttgcatagggaaaaaggccagtcactggatgtagaaatgaaactactgcatcgcaaaaggcaggtttttcatcttcttcaacgaatttaccaaatgtgtaagccataggatttgtcaataaaagaacagatagtactggcataacagtatatcgtaacagcaaaaacttggcgcttactttaattgctttatttacgcgttcttcgccaataaaggcaataatagaataagtaaacgtcagcaaaacgatcaacaaaggaataataccagtcataaaagccataaattgttctccaccagcctcaaataagccaataaagtttttgccaaaccattcaatatatttcatttattttccctccttattctaagtaaccgatttcatttttttagataaaaatgaatgaatcgctctctgcttaagagacggtttttctttggcaatttcattttttaaattttgtgaaattgtttttcctgtcaaaacatcacacggtttaaactgcgaaaaaatggttagtccagcgtatatataagcttctataatagtatcttgactatctgttataaccacgagtactaccgaagaaatacaatttttttccacttcagttgttaacgtgtatccaggacatgtatcgtatcttttaattagtttattcataaaagcattatagtaacggatttgataaagactgagtaacacctgagcgacgataataagtgttcctaaaatggttaaacctcgcataaaaactctctcctccagccatcattcttcaattgaaaatagtgatgtcaatctttattaattgtaattgaattgttccatcgtcacaaggcgaataggagccgttttgtatcatataaagataataaagtacaaaaaaaagctggaggaagatcatctattacaaattatgcaaatgtttcatcttgtaatttgcgtagtttataaactgtagttgattcatccaattctacatcttctatcgttaaaaatgcaccatctttaatattacgtttagcaattgctccagcaatcaacccgattggaatattagcgtttgttaccatatcttcatgtgtttctaatacaccacgaacgcagaatccaccaataccatcaattttttcaccagctttaatatcttttttcgccacacagactgtttcagaaattggtgctcccataggtaaaattgctgtatcttgctccaatactgcacgagcaattgtaattggggtttcaagtgaacataaatgaaatggacgatacaaaatgtggtgatcacgatctcctttcttcatcaagtagttcatttcgtgggccacgccttcattttgtcctttaacaatacaaaaaataccaggagcaataccatctacatactcaacaaccccaaatttacttaaaactcccccattttcttttagatctaatttattgacagtgccatccaaatcagctgagatgccgtgcattccaaccacatcaggcataaaccccattgcattggatagtaagttcatttcccccattgtctttgtaccgtcttggaatgaggctaaaattttaggactcatcacttgtttttttgctttttcagctgctgtgtcaggattggcatgaaccatcaatttattattttttcctttaccaacaaccaaaacctccatacccatacttttagcaaattcatacatttgcattgttgctgctggttcgtctccatctgatccagtataaatcaaatcagtagctccatacattttattcattaatgggccaatggtgatatcaatttctacatttagcaacacaatatgtttttttgccatcaacgactccaaagaaatttgtgcccctgcttcaggaacaccagttgcatcaacaataatttcaactttgtctgagttaatcacgtctttgaaatctggactgatcaaaatgtcatgttttagagccgaactcgctttataagcttctgccgcacgattagcagcttccaggttaatatcactgataccagagacaatcatcccaggaatagttgatatttgagaaatcatcccaaaacccatttgtcctgcgccaatcactccaactctaattgggtggccatccttttctcgttgtaataattttgtatataatgtcatgatttctcctccttatttgtcaaatgacaaaaaatgtgtcatttgttttttacaaaatagttatatcattgtttttgtcaaatgtcaactatactatcaaatgtcaaaaagggcttattatcgcaaattacattattatagatactaaatgaattcgatcgtcgtcacagagatcttgttcagacaatgatgcataagacgatatatatcgatgttactttatagcaaaaaaatctgtgtcacccttaaacaaatcccagatgcatttgatctatatcgatataaatattactcgaacttacgtgaacacttagcgtgatgcaaatgccagttggtgaaattgcttaacgtaatttatctcaaaaaagtcaacaacaaaaaagacgtttcacaaacaatgttgtgaaacgtctgaatcgttgatctataagatatatgaacgttttgagaattgtgatgctttacgagctttcttaagacctggttctgtgacagagattttgaaatagtttgagaatcctttaacagcaatagattgaacaatttttcaacaggtacgattttaatgaatttcagcacattttaagaccatcgtacctaaagacgtacccaaaaaaatatgagtgaatcagaacaagactatgactattatttatttagagaaactctcctgtactctccataaaaaataataatcttcatcttttacttcgtaactttttggtttgtccaaaatcttactaatgtgattacttatcggtattgctcctgaaagtcctaaattagctacagtatctagcccatagtattttccgactgaaaaagtaattaatggcagtataatattacttccaatatttttccatctttgattactaatatatcttttatttttttcaatactactatttatcctgttaatctttggttgaattatatctctttgaaagtcttcataactttcttttgtcatgtcaaatttttttatatcttttgaaaattcatctctaaaaattttaaatgaagataattcactttctctcaaactaattaactttttataatcggaatcttcaatatagggaaatgcatagtcgattttatctaagatttgttcatcagaaatattatttatttttctagctgaagaagacaacatattaataatttctccatcaatgccccggtttgacaaatatgttttagaagttccctcaaaaaaaattttactataaaaaacatcattcaaaatcggttttacataaacagggacaatacaattatcgaacacaaaatttctttgttgttttgttaaagagtactttcttccgttctttacattttctaattctacttgcctaaatgcattgtttaagaatgtgctatcatttattaacacatgcatctcatgttcaaacccatatttcaaattttcaaaaaccctaatataataatgatcatcttgataacttaattcaaactgaatttcggattttatgagttcattaattttcaattcgctatttaaaattaactctcttattgcattttctttgattctattttgttgatagcaattctcacataaacaattatattctgaaaaaaaagaaattatctttttttctattaacggttccatagtaattaagctttcaatatcaaataacaattcatctagctgaataaaactattttctattaaattattaaggtgctcatccataggagacttcaaactagttttatctgcatataacactgcaaagtccaaagttttttttaattgtttctttctacactcaaaattagaacaaggtattggtccgccggatatagttctaccagtctcaaattcaaaaagatttttatttttagagttgtctccatttaaaacatttgacaaatctaaaatcatgtcagataaatgactatcactcaactcagttattcttttaatgttttgttctctattcaagcttgtaaaaccatacccttcaagaactgattttacttttgacatttaattacctccaacataacaaatggatattttttatttctcctcaataaatcaaatattcaaataaaagaattctacaatatttccaatataaggtatatctgctattttttcgaaataatactactgtcatttccaatcatcatcaaattcaaataaaggtaagtcgccaattatttgttcttgatctctattggtttcttttttactctcttcaatcttgataatcataatcaattgaattatagcttctcttgctaactttaacaactcaatagttagctcttcaaaatcattaaagctaatattataggcaaattcatctaatctgctactttctttatttaaatttaactcgtaatagtctaaaatttttagatacctatgctccatagcattccttacaccagatattttttttaatactggatcaatatgtttatcaccatacactgttttgtttcttaaatctttgtatatccaccacaacccattcaaagcataattctctctttgaattttttggatttccttcctccttttttgatttctcacatctttgtaccatagatttacaaaactaataacatcatcggatatgcccaattttaagtacttatttagaaaataagcaagtttatcaaatattgaatatatgcttcgatacgcagcttttactttttcaattcctattccatatactgggtagtcaagagtatccactaaatatacatccttatcagaataatgtagcgttctatcagtcaatccttcataaatccaaaatcttgcagatacatattcttgtttaatttgattaaaaataccatgatacctcggaaaccacgtattatctatatcttctactattccaggtaagtgtaatggatcatagccaacttccatttccaaaaaaagatcattcaattgattgagtgctactccattagccccaatccatgatctatagttctcttcttcctcagacatattctctataggttctaaaaagtccgttaaagaaaaatcaatctttaaataatctaaactgacactacttttaatcccatttaaatatttatagaaaagtacctgtgccatttccttttcaggaaacgttactttctcatctaaaacactttccagtaaatgaaatgcataacaaaacataatatgcctatggctctcatcaaaataagaatagtctactatttttaaagctaaatttccaactgccataggaaagttcatttctaaaacttcattcaaattattaattgattttacatatctaccacactgagaaagtatgtttccataattaacagttagttgtagaaagagtccgtctatataagtttttgaaattatagaagattcatcgtccattatcaattcatcatagcctaacaaacataaatcttttgctgttctatataaataaagacaccgttcataagtttgctctttagtgtctatattttcatttttgggcaaaatatccattaaactagtagctgaacaatataaataactggcttttatcatcgtgtctagttcttcttcatgacctaaattaaaacaaatttcactcaagtttagagatttatcaatatctccagaatcaagagcttgatcgcattctaattgcataattcgtaatttctgattttcccaccaatttccgatttaaacctcctccttaagataagatgctatttctctactaacctaataatctctgatatatcatcaatctctaacgcatcagcgattctttcaatgtgttctaaataaattttctgtctttttccatttgccaaattgcttaaatttgatggctcaattcccgataatcttgcgagctctcttaaagacatttgtcgttctgctaataaatcgttgattagcacttccacttttctaccaccttcattttcgttcatttatatttcctcccccgtgttgtctatataaacatggtatagtataataattttagaatgttgttcatatagacatggtttttaaaaaatagaaggaggtccccttataacatcgaaaaatgaaaataaagaattactgacaaagaagaatcaaccgattaaaaccattactcaacaagatatcaatgctctagaattaacgcttgagcaacttcaatcatggtcatcaatactagcggtattaaaccaatttttcgattgtgaaaaagaaccaattaataagaaaaatattattcataaataccattcaaatgcccaagtattcaaaatttttttctatgattttctacaacgtactgaaagcttagagaaacagcttgaaaagttaaaaactagagaaaaggttaaaatttatgaaaaatgaggtagccaaaaagtttttttttgactatttcgtttcaatattcatctcatttattcgtacccaaaaacacaaaaaaaagacaccttccaaaaacttggaaagtgccagaaaagttaggatcaaggtaactgcgctcagcattgcttcgcccagtacgattctcgtaactcgtgaactcgaacgataatcgcaattaacgttttgagaattgagaagctttacgagctttcttaagacctggttggcagttcaactgtgttattttaaatcaatgaatatcaaaaatgctgatttatcagtatttttcgcctcaagatttgtactggatttcagtcgattttaggcactcgtaaccacgattcgtaaccaattttgaacgtaagacaatttggttacgacaaattcagagcatatcagtatctactacacttcttttttatctttccattgaagaaactgcatggtaaacccatgtggtctttttaacgttgcaaagtcaaagataaaagaacaaatcctccaaatgttaggcgctctttgcggaggggttcgcctcaagcgaattccccttcgtaaagagttcgccttgaacacgagtgggcgctagcccgcgagtgttgtttcaccccccctatctaacaggggggtacaaaaacacgaaaaacaatcgaaaaactacatacaaacactgttataccaaggaaataagcacttattgacaagtgtaaactaatttaaaaaagttcacactttgttttcactggttttagcgagtttcaaatagtgtattgagctaatatttttagttatgcaagtttcaattagcctcattgaattttaaactaccgattttgtgcttctattaatggcccgtgaatcgtattacgatttgaattcatttattagctgatacttagtcgaacggccttgcccgactttttgaatcttattctctgtttgtagcccagccaaggcccgttcgatcgttcgctggctaatatccggcaacaagttctccaggtcagctctgcttagaggttcaaaagacttttctaattcttcaactactcgctctgctggtgttagttcctgattaataatcatctcaaagcgttctgaaaaattttcatacgctcgcaaaataattcccaaaagatagcgcacaaacggcgtatagtcttgctcattttccaaccatcccacagagcttgcttgtagcgcttcataataggtttgcttcgattcttcaatcagcatctcaatactgatgtacttgccgactaaataacccgacttgtatagcaacaacaacgtcaataaacgagacatccgcccattcccatcactaaatggatgaatcgagagaaagtctaaaacaaaacaaggaatcaacaacaacgtgtcaatttcagctttctgaatggcttgattgtattggtagcacaacgtttcaatcaaatcaggcgtcaaataggcgggggctggcacaaaacgaacgcgctcgttaccagccagatctttttccgtaataacattatcgccacttttgaacttacctttgtaacttttagccgagtaattgtagagattcttgtgtaacgttaaaatatcatttggcacgacacgaatatactcgtaactgtcatgaatcagtttcaacacatcccgataaccggcgatttcttcttcatcccgattacgaggctttactttttcggctacgatttgcttcaagcggccatctgttgtcgcaatcccttcaatcttattggaagcctctgtactttggatcaaagccaagtctgttagcttacttagaatttctggttttgtcgcaatgtataactcttgctttcctttatactcatgaatcttagtcagcatattcagcagatcatgactgagagtaagtttattcaattcctggtaatcaaattctttcaccgtcatccacctcttttctccgccattttatcttatttggcggagaaaaacaaataatggcggagaaaactatatttcatcatcacattagttttactattcaaatacaaaaagccctaaaagtatttcacaaattcaattcaaataaactaagttttagtgagcttcgataatccaatttcttttaactggtagattttttaggaaaaagagtaaattctacgtaagagctacaattaaagctctaaatgttgatattgcttttatcagttgtgactgatcttcaaaaaaacaactattcgatgttaatttgtagcttttaaatgggatatcattgtaaaagcattaacttcttaaccctctacctgtatcgactaaatagtaacaaatagaataaagaacaacaataaataaaataagtattgtaatcgacatagctattggtacatcggttgttcctaaaaatccatatctaaacgctgagatcatataaacaattggatttatttttgaaacaccttgccagaatgggggcaacatcgatatcgcataaaatactcctcctagataagttaacggctgtaaaacgaaggtgggtacgatcgatacgtcgtcataagattgagcaaaaacaccgtttatcaaaccagctaatgaaaataatattgcagtcattaataacgtgagaataacaataatccatgaatgaacattaagtggcacaaaaaataaggaaataatcgttacaagtgatcctacgagaatacttcgtcctaacccaccaataacaaatccccaaatgatgatatgtgttggtactggagcaactaatagctcttcaatatttttttggaacttttgagagaaaaaagatgaagatacattagcgtatgagcttgtgattgctgacatcataattaatccgggtacgataaattccatataagtgaacccacccatatctccaattcggccaccaatcattttcccaaaaatgataaaatacaacgatgtcgttataactggtggcaccagagtttgtacccaaatacgtagataacggttagtttccttaatagcaagactttttaaagcagtaagataaatatcacgcattggtttcctccaaaaatcttttttcttcggtgattttcaaaaataactcttctaaacgattagatttattccgcatcgataaaactttcatcccttgatcactgagttgattaaaaatatcatttactccttgatttcgttcaacttccactgataaagtcagatcgtcttctaaagaatacgtatatccttctatcttaggaactgcatcatgaggtgctagatctaaaataaatgtttcaaattgtaatttggatagaagttctttcatactagtattttcaatcaattctcctgattgaatgatccctatgtgtcgacaaagcatttcagcttcttccaaataatgagtggtcaagataatagtggttccattttcgtttaattcttttaagaaggaccacatttcacgtctcagttcaatatccaccccagcggttggttcatccaaaattaatagctttggttcgtgcattagtgctcgagcgatcatcagccggcgcttcatcccgccagagagcatccgagcacgttcgttacgtttttcccataaatttgattgcttcaaatacttctcactgcgcttcaatgcttcttttctcggaacaccataataacctgcctgattcactacaatttgttgaacagtctcaaatggattgaagttgaattcttgtggtacaagaccaatttgctgctttgctctttctaagtctttatcaagatcgtagtcgaaaacttttaccattccagatgttttattgacaagagaagtaataataccaatggttgtcgacttcccagcaccattgggccctaaaagggcatagaaatcaccctcttcaacctggagatcaattccacgtaatgcctcaacacctgttccatagattttttttaaattcgttatttcaagtgcatattccatatactttttcctttcgtaaaacaattcttaaattagaagtcgctctaacttttatactgtaaaaaggcatgtggtcaattgaccacatgaccttattttttcttactttgtctttctttccttttggccaataaatagaataccaaaattagcgtaataaagttgataaatattccaatactaattggataatttagtaatttagctagaataaatgccagtgacatcccaaataatctagcaacggctctcttttcttcagacataaattatattacctcagcaatttactatttaatcaatattctcataaatttcttgataatttttgtttcctccggaaagattgtacacgtgtttgaatccttcgtttaacagtatattttgtgcagcattcccggtaacacctttattacagtacgtaattgtcaaaacattcttgtctaactcatcgtagcgtgtcctcaaatcagataatggaatatgaatagctcctttaacctttgatttttcgaattgctttttggatcttgtatcaattatctgtaacttttcttttctgtgttgtcgttcaattaactcaatcggggacatcaaaggcgctcttctcttcaccgcgttatctaaggccattccagtataatgaacgggatccttggttgttgaaaatggtggtgcataagctaaatctaaatcaaacagttcttccgccaatgctccaaaggaaatagccgtagcaagcacgtcgattcttttatctactccgtcataaccgataatttgggcacccagaactctaccgctgcttttatctgctattgctttgatgaccatttctttgccatccatgtaatcaggtttatttggttttatattgtataaaacggcaacttctaatccttctttaagagcttccttttcagtaagacccgtttgtgcaatggctaaatcaaaaaagcgcaaaataccggttcctaatattcctttaaatcgtaaagagccaccagtaattgtgtcaccagcaattctacccatcttgttcgcagtcgaagccaagggacgatagattggttgttgagtaatgcgattgtagctttctgctacatcccctactgcatagacatttttcaaattggtttccattctattgtctactttaattgctcccgttttgcccaactctattcctatggtttgagccaattctgtatttggccttactcctgttgccaatacaaataaatcggctgataattcattcccttttgaagtcttaacagcagttagttgttcttcacctactaattcaacaaccgtttcttttggcctaaaatcaatctgttgttttgctacttcgttctctattcttatagccatatcccaatctaaatgagacattggatggttgcctcgttgcagtaacgaaacagctattccttgtctctgtaattgttcagccatctctaacccaatatatccagcacctacaataacagctttttctactttattagtcttaataaagttgtgaatatttttaccactggaaacatttttgatttgaaatacattttcaaattgtctattagagaatatagccggtgtattgtaaattgaacctgttgcaaatactaatgcatcataatcatctgaaaacgactttctagtaatcaaatttagtccgtaaatacgtttctttttatggtcaatacgttgtacttcatgcgaagtatgaatatctacgttgtatctctttttgaaccactcagcattccgtggagtcaattcatcgaatttttcaacttctcctccaacagcatatggaattccacaaacagaatatgagatgtcgatatctttatcatatagaatgatttccgcttcttctgtgttccttctcgcttttgcagcaacacttgttcctgctgcaacagacccgatgattattattttcatactatgcaccccaactactcatatagattttcaatttggttagtatcacctgacttaacaaaccatgacttagtattgttggaaatctttactaatagcaacatgatcggtacctcaactaacactcctacaactgttgctaaagtcgcgccagactgtaggccgaaaagtgaaatcgcaacagcaaccgctagttcaaagaaattgctcgcaccaatcattccagctggtgaggcaatctcatgaggcaacttccaaaaccttgaccacccataggcaatagtaaaaattagtagcgtttgaatggttagtggaattgcaattaataaaatatgaattggattggctaatattttttcaccttgaaaagaaaaaataataatcaacgttagcaataatccaatgattgtaacagagtcaaatttctttaaaaagacatcttcgaaatagtacttacctttattttttattatcattactctagtaacgaaacctagaagtagtggcactactacaaaaagaactgtagataatagcaatgttcccattggaacaacaacattgtccacaccaagtagaaacgctacaatgggtgcgaatagaatcaaaataattaaatcattgatcgctacttgtaccagagtgtatgctgcgtcacctttcgttagataactccatacaaataccatagctgtacaaggtgcagcacctaatataacagcaccagcaacgtactcttttgctaattctataggtataagattcttaaaaatcacatagaagaaaaaagcggatatagcatacattgtaaaaggtttgattaaccagtttgtcacgcaggtaacaactaatcctttaggctttttggctgcactaacaatactagtgaaatcaatcttcaacatcattggataaatcattaaccatatcaaaattgctgtaggtattgatacctgataatattcaaacttacttaaggtgtcaggaacgctcggcaaaaattttccaattagcaccccaataaccatacacacaattacccataacgtcagatatttttcaaaaatacctaatccttgtttttcattctctgaactcatttatttcctcctaatggcttgcgccttctttcgaaaaatatttttgtttaaattttaaagcaacattcactaaagcaattaaaactggaacttcgaccaaggggccaataaccgccgcaaatgcttcacccgaattgatcccaaatacacctactgctacggctatcgctagttcaaaattattacttgcagccgtaaaagataacgacgccgcgattggataacttgtgcccattttttttgagagtaaaaatgatacaaaaaacataattacaaaatagaatagtagtgggatagcaattcgaactacatctaatggcaactcaatcactttttcaccctttacggaaaacattacgataattgtaaatagtaatgcaaccaaagttattgggcttattttagggataaacttagtttcaaaccattttttccctttcattttgatcaaaataaatcttgaactaaaacctgcaataaatgggattcccagataaataaaaacgcttttggcaatttctcccattgtaatattaatcgtatgtgtctctaaaccaagccagttcggtaatactgtgacaaagatatatgcaaataatgagtaaaatacaatttgaaaaatagaattaaatgctactaatccagctgtatactcgttgtctccttgggcaagctcactccagacgattaccatagcaatacatcgagcaagcccaatcataattaacccaaccatataacttggatagttgtgcaaaaagactactgctaaaacaaacataataattggaccgacaatccaattttgaactagtgaaagtaagagtaccttccaatccttaaaaacacgccacatttcttcatattttacttttgtaagtggtgggtacatcatcaaaattaaacctattgcaattggaatcgaagtcgtcccaacttctaaatgatttattactttaggaatattgggaaaaaaataccccattcctataccaattgccattgcaataaaaatccataatgtcaaatatcgatctagtaaagacaatttcttagttacttgattcatttttccatctccagcagaataaaaaatttattttcctcaaacgaatagatgaacctatatatagattgttatctatatataggtcaaaaaattaatgaactaattttgcgtcaaagttaggaacccactctgttaccgcaaaatgcccatctgaaagatcttttactttattgatccactcaatttcatttgtagcgcgcgcctttaatacttcattggacgtatcggtagcatacatactttgattgactagccaccaagtatgagcaatctttgcacgattcaaatcttcatctaaacgcatcgattcgtacactggcgttgtttcaggcagagtaaccatcaatacttccgtttcattgctattttgtaatcttggtaatagcttttgaatcgacaatggcacttcgccagaacttctttcaacttctttggcatagctttgcgtggaatccaaaagaagcaatgtgtgtcctgttggagcggtatctattaccacaatttcattttctgacttatctacaatttccgcaaatgctctaaatactgcaatttcttgcgtgcaaggtgaacgaaggtcttcttcgacataagcgacatcatccgcattcatcgtcagacgagcttttgaaagaacctcttttttgtaagattctagttcctgttcttcatcgatatggctgattgaaattggcaactcattcgaaataaaaagatttagatgatcggcaggatccgttgtcgctaaacgaacttttttacctgattgtgccaatttttctgcgatttgaatagcaacagttgtcttgccaacgccaccttttcccatcgtaaaaataatctttttattcgttcgaataaactcactcacaataaaatctaacgttggaaactcaatcggttcctgttcatgttggtgaacagctggctgttgattactcaataaaatttgaagcttatctattcctgcaacgttatatgggcgaagtggaatatagtacttttctaatttgctcaaaggctttggcatttcttctagatcactttgttgttcaccgtagattacctgagaaatcacatcatcaggattattcaataatccgttaaccactagtaattgattcttaatccctaatttcaatagttcctcggaagcacgttcagcttcaattagtggtgctttttgcggtctggtcactaaaattaaagatgtttgggttgcatctgtaagtgtctccactgctttttcatatatctcttttttatcacccaatccggataattgtcccaagcaagaaactccagttgtattttcatccagataattattccaagcagaaggtaattgtagcattcttagcgtatgcccagtgggggcggtgtcaaaaattacataatcaaattgctctgcaacttctttatcagttaaaaagttcgcaaactcgttaaaagcagcaatctctactgtacaagagcctgataattgttcttccatattaactagtgcactatctggtaagattccccgataaggaccgacaatactctctttgtattcttctgccgctgtgattggatcaaaatttgcaactttcaaatggctaattccgtcaaccgtagtcggtttatttgttaattttgtttggaaaacatcttgcaggtttgaagccgggtctgtgctgactagcataacctggttgccgtcttccgctaaagatgtcgccgtggcacaagccgtagtcgttttcccaaccccacctttacctgtgaaaaacagatatttagttaattctatcttttttggtatatattgaagcattgtatctcctccctttcccttttaaagaggtctattaacaacagccttcgctcccattattccctccacagcagctaccagaactagctgattgaactacaaagcgaacctctccatactttccgaattcctctaaggttggataagaaccttctttgacaatttttccatctaataaggttatcggcaaaatatcattaccattttcttgaagcaacttcaagattgttggatttttgacaaaagcatctggatcactggttaaattgtgacgagaagcgtcaattgaatccagtccttcgaaattttcaaatactgaggttaccattagtaattcttcatcaactgatggaccgcagactcctgttgaacaacacattgctggttcaaatagctccaattttttcatcatttttttcccctttacaattacaatttagtttattacaaatgcaatcatctttatcagaaaacaattgcatcattgaacccataaattgatcggcgaagctttccgttaattgataatgatgccatattttatccttagtcactgtgacaatcccagccttttctaatactttcatatgatgtgaaagagttggctgagtgaagtcaaagtgatctaagatatcgcaggcacacaaactaccgcaagacaatatatcaatgatttttaaacgttttggatcagcaagagccttaagcattatcgatatttcatcataattcatatcttctactcctttacatagatggatgtctatgaataatatagatgaacatctatatattgtcaatcgcttctgtctttttatttcttactttactttgaaacctttactgcaaaaatgtaaatactacctatcactcaaaaagtaatagatggtatttatcaagtaattatacgtatcaaccgcactatttcaattttaaaaaataaatttgcattctacttgcctcagatttaaaagccttgtatataaaattcgtagtatcttcgttcttaacttcaaatcgttttgactggctgttataactatactcaacaatattcaatttttcctgcgcacgttcaaagccatagtaaataattctagacttagttaagtctacacctagcattggaaaagctcgtgtaaaataatcaatttcaatttgattccttaaatccggaaaattatggtatagatatttttgtcgcttcgcaaatgtataaggcaacaaatgaactcggttgttcttaacgtctacataggcataataacgtggtgatggatccaatgggtcattagccgcggccgccgtataaagagaatctgttccttcaactttggaatacgttagatacggatcatttctctccactaacataccggaatccataattccttgcagaaactccataatcgtcatttcatcatagacatccactttttgctgtttcaagaataccaacatttgttgtagaaatgctggattcacttgtaactgaaaatggtccttcaataaatttgttagtacttcctctggcgtcccatacaacagctcttctaccgtcgtcttacccaataaggcgattttttttagtttatcttctttaggcagattaattcctcgctcccaattattaactgtggttttgggagaattactgattagctcaccaaactgagccatactgtagcctaaatccgtccttatttcacggattttttttgctactctttgttgatcaactttcatagtcctcatcactccgatatttttctagtttaatcatatcaaactttcttaataatcgaaatacaaaagtacttattttcgaactttattttattgacattctatcgaattgggtgtacgataaacaaaagtacttttataagtacttttgaaatgccctttgaaaactgaatagcacctttcttcttttcacttctagatcggaggtagatcaatcaatggcagttgaaattacactttcgcctgatcaagagacgagtttaagagaatatatgtataccttaatggtagatgaagtgagaaacgcacgaatagccgtacatttagagaatcgctatttatcaaaaaaagagacttgtgagtatttaggtatcgccaacaacacgcttgataaatggattgatgcaggacttcccatgatacatctttggggtgttgtacgattccagcgagaagagatagataaatggctaagggagtattccaaagcacagcaaggcgctgtatgatgagtgtgtagtgatactgatatgccatttttgaaaggaagatagaaatggcaattagtctaatggaaaatggctcgtataaagtcaatgtttatatgggggcggatgcttctcgatatgtggcttatgcggacagcaaacatgaagcagagattttagaaacagaagcaaaactaaaaaaattgaaaggagaagtgaaaaagaagaaaggttcttatacattcaaagaggtttaccaaatgtggtgggataagaaatacaccgttacacaacatcatgagcagtctactttggatcgaactaagacttgctttgagaagagaattcttccttacttaggggatgttccgattaataagattacctatgacctattagaagatacccaaattttgtgggcatttggcaatgaggaaacaggcattaaaccttatgctaactataaacactgtgtctcctacaccaaacaagtattacgctatgccctagtgaaaggttatatccaaaagaatccctatgatttgttggagatgcctgtaaatgcagacctaaagaacaaaaaggaaaaaaaacgtcagcaaaagtactattctaaggaactcatccaacaagtgttaactttgatgaagcaagaatatggggtgcgagactatacgttactttctttgatttatcaattaggggcagccaaaggagaaatttatcccttggtctggtcagatattgatttcaaaaacaagacgatttccctcatgcataaattggtgaaaaataaagctaccggaaaatacgaacgtgtaaaagggatgaaaaactcctatcgatttcgaacgattccagtagcagattccgttattaatctattggcaaaatggaaaaaggttcaatttaatgaacttcaacaagtcaatatttttccaaccgatgatcaatttatcttcacttatacaactcaaaagggagaactgaatcaacctttgcatccagactaccttaacaataaacttgatgccctttcaaagaaatttgaccttccaaaaataacaccccacggcttacgacatacttttgtcagtgaccttttaaacaatggtgtggatgatttaatcgtaaaatctctagtcggtcatgcggaaacgtcagagattacacgaaatgtttacgggcatgtaaatccagaagttcagaaagaaaccgtcaagcacttggaggattaccggcaaaaaacaagttgaaaaaaatagtcgtaaccaaactcgtaaccaaaataaaaaaagcaccttccaactgaatggaaagtgcttgaaatcgttggtataacaacgattaacgtttagagaattgagaagctttacgggctttcttaagacctggttttttacgttcgaccatacgtgcgtcacgtgtaagcaagccagcacgtttaagcgctaaacggaagtcaggatcaacttctagcaatgcacgagcgataccatgacggatagctcctgattgtccagcgtatcctccgccgtttacgttaacaaatacgtcatatgcgccttttgtttcagtaacagcgaaaggttgattgattacttcacgcaagtcagcatgtggaatgtattcttcaacatcttttttatttacagtaattttgccagttcctggtactagacgtacgcgagcaactgcgtttttacgacggcctgtgccgatatattgaacttgtgccaatgaaattccctcctattagattaagtttgtgatgtctaaaacttctggttgttgtgctgcatgtggatgttctgctccaccgtatacgttcaattttgtaaattgtttgcggcctaaagtgtttttaggaagcataccttttacagaagtttcgatcaaacgacgagaatttttagcacgcaattcgccagcagtgattgatttcaatcctcctgggtagttgctgtgacggtaataaattttgtcagtcgcttttttacctgttaatttcactttgtctgcattgatgacgatgacgaaatcgccagtatccaaatgaggtgtgaaagttggtttatttttaccacgtagtacagatgcaacaactgttgaaagacgtcccaatggaacatcagttgcgtctactacataccatttacgttctacttcgcctggtttggccatatatgttgtacgcacgttattttcctccaatttaagttctgatgtttgacatacacttcgagtttccggggctctttgtggggcaaacaataccatttaacatattaccttctaatctggtcaatgtcaacgtttttctgaccggttgaaaaaattatatgaaactttacttttttcctttctttttatgtaaaagggtcgttttctaatatagaagaaaccgcgaaacgatgctgttccgcggtttcttctatataaaaggataagtttcgcgcttacgcgtcgatctctggcgctttgctcaaatgagcttggatcatccagatacgtttttctgtggctgttttgaattcgataaagatatcttgtgttggatcgtcgccttcttctccagaaacttcgattcctttttggtaaagatctgctagataacggtagcctgcaacaagtgtttccaaacgttcaggaatcgtgcggtcccaacgtcctacttcatcagggattttcgtgttatctgcaaattcacgcaatgtagaataaggtgaaccgtctaatgtgatcaagcgttcggatacttcatctaactgagcgttcaaatcatccatgaactcatccatcattgggtgcaatgtaaggaaacctggtcctctcatgtaccaatgtgtttggtgaacaacaacagacatttggcttagatctgcaactaattgatttaatacttctttggtttgttggaatttcatctttcttgcctcctaacattttcttacacttaaaataatagtagactttcaatgaaaagtacaacaaaatcatttacctgagaacgattttcatttcgcttttttatccgtaaagccaatcatttttcagaatcagctaattcttctcgcagttgagcaaattgctgataagtctgtgctaaatgcttttgtgtcgaaacaaataatggatagattttctgatattttttatgatcgttttcttgtactccgacttgctctttcaattctatcaattcctgtgcttcactgatactttgaatctttccgatgcttcgccagcctaaaatcacagctcctaatgcggatgcttctgtgacagtagggaaaacaagcgggtaccctagtacatcagccatcatctgacgaaaaatcggagattgagcaaacccgcctgtagcacggatctctgtgagctgattttcttggcaaactccttttaaaatccgataaagattgagacagatcccctctagaatcgccttcatcatttctttttctgtatgttgccgctgtaagccgataaaactaccaaacgcatctgcgtcccaaagcggtgctcgctcgccaagcaaatagggatgaaaaatcagaccattggcacccgctggcacaaaagcaatagctgaaagcagtgcatcatatggattttcacctttttctttagcagattgaacgacttcctgtaaaaatgtatgccctgcccaatcaaagatgccagcaccattgctagtcgctcctcctactacccaatgtttctgatccagaacataacaaaacgtctccatttctggatggaactgaggctgagtagtaataaaacgaagtgctccgctcgttcctacggtcaaagcggcaatcgtatcaccaaaagcgcctagccctagattagaaagcgggccgtctgcccctcccaaaacaaatgatatatcatttggcaaacctagttctgctgctgtttctgacggtagacctgttacttgataggtggaaggaaacacttgcggcaattgttctgttcgaatgcccaagtagtcaagcacttcttctgcccattggaattcatggatatcaaagtatccagttcctgaagctgttccgtagtcgctgatgagttctccaaacaatctataaaaaatatagtctttgataccgacaaaataagcagtttttttgaataattcaggttggctgttttgcaaccacttgattttgttcaatggtgtcattggatgaatcggtgtcccagtctgccgataaaattctttgccaagcacggtatatttcagtttttctgcttcgtccgctgctcggttatctgcccaagtgatcattcgagataacggtgttttctcttcatccaacaatatcaggctatgcatcgcagaggagaaggagacaaattgaatggtcgtgtctgaaggcaactgtttaattacttcttttataacggtgcagacgccctgaaagatcaattcctgatcttgttctgccatcccttgtgtttcttggatcaaagggtagcgaaaataagcggatgctgcttcttgggcctcatctgtgaaagcaactgctttggtttgtgtggttccgatatctaatccgattgaaacgttcattttttcacctcaaattttatgtatgtacaaaaatttagtttaagcttgcgtatcttggttttgaaaagggggagatggcgtgttactttattttatcattggttgctgtattgggtcatttttatgtttaaccgcccagcggattccgttaggtcactctattatttatcctagatctcattgtgtcaaatgctgtcgttcgctttcttggtatgaattgattccgattctttcgatcatcgtccaacgttttcgctgccgctattgccggtgtcggttgcccttctactatttgttggcagaagtcttatgtggtggtctttttatctggttctttactttttcttccgcaagaaatttttcgacgttcatttgggtgctttcggctttgctattttcgttgatggacttgttttacttcatggtccattctcacacgctattctgctcctgggctgtcttatggattttttggttgcaggccggcgttttccaatggcacagtatgttgttaacgttcatcgtaggcgctgcatgccttcgctatggtcaatcctatctcggagctggcgatactctgttggtgctttcttggagtgggggcttgcctctggaagagttgcttcgggtcttgtttctggctagcctgtttggaatatctgttttttctgtttactttatctgtcataaaaaaaagttggaaaagctgcctttcattccttttttgagtagtgcattgctgatcgtccttcattttaggtattgaaaaaaggttgtgacaaacgacttgtcacaacctctgatatacagtgttccaaaagtagctttttcggcttcttatttcttgtcgccccaatgtcgacgaatgaaaccggcacgtccagaaccttctcgataaagattgtaatggagcttgtttttcttgtaataatcctgatgataatcttctgcaggataaaattcgcttcttggttcgatttttgtcacgattggcttatcgaatcgtccgctgtcttgcaatgcttgttttgaacgctctgcaatgtttcgttcttcttcatcactatagtagatcactggtcgataagaatcaccacgatcagcgaactgtcctaacgcgtcagtcggatcggtttgctgccaatagatttccaccaactgatcataagaaataacttctggatcatattcgatctctacggcttctgtatgccctgttgtgcctgttgttacttgttcgtaagttggatttggtacatgcccgcctgtataaccggatgtcacagaaatgatccctggctgctcttcaaatggtttgaccatacaccaaaagcatccgcctgcgaaaactgctttttttgtcatataaaatcccccttttttctcatcatacctgttttatagataattaaaattattttgctcgttttttaccccctcccggtattttagcagatttttcttcattttccttctttttcaattggttgtggataactatgacaattgtattgaatcattttttccacaggcaagaaaaagttgtcttttcaaccacgttgtgtataagttttatatggtatgcttatcccaaaattatgtacctttattttttcatgcgaataaataaatccatattatcggagggataactatgcctaaagcaaaaagaaaacattcagatacacccactgactttattgcatttgatgaactattaactaaagcgaacaaaaaaataaaaacgcctccagcaccaccccacgaatttgattttctttcacatgaatttgattttccttcacacgaatttgattttccttcacacgaattgatttttcttcaaaggatgattctctaacgctcagcgaaaacgagaggcaagtcatcaatgaactagcggaaatattgcccgattcgatcctccatcaacaagcagtcgaagaaccaaccccatctacttctgctggttcagagtcagcctttgttgcggataagcaaaaaatggacagttcagtagaagtaaatgttgcaaatagtgctcagcagcgtctatatgagatatttggcaatgtttcttttcaaaaaggaagagaaaaacgaataccgcaagaagtgtacgatcaaatccaacaagccttaacattgcctgatcttaatcaaagtcagattgccttattttttggcgtatccaagtctacagtaaatactatgtcccaaaaaaaatttgaaaaagagtatgatatcattgataaacgatatactcatcagcttttgcgtgagagaattggcgaagtttccagcaaacaagggcgatttatatcacaagaattacgtaatcaagtccaacaagccttaacaatacctgatatcaaacaaagacatattgcatcgtttttcggtctatccagatccgcaatttcttatatatatcaagaaatgataggtaatgaacagtcagctgatatagcaaaacctgtagcttcaaaatcatctcccactctttcttctaaccaaacaaatgagaggtaagctacttcgtataagcaaaaaaagggattgtgacaagattttgtcacaatccctttttccgaataaacggtgttcaatcagctgaccctcggtattagttcaacaaacggcaaaatatgaggaactatttttccgtttatttctctaatactcaggtcaaaacgctgatttcacaaaaatttgagaagcaattttcgtaaattctttcttatttcttgaagctgaccacttctgtcacaacctctattttgtttgattgttcattgcatcttctgcagccatttgcgcttcaatatctgaaatactgtagacattttcgcttgctacaccgacttcttttggttccatgtcacggtaacgttgcataccagtaccagctgggatgatcttaccgataataacattttctttcaaaccaagaagaggatctttcttaccgcggatcgcagcatccgtcaagacacgagttgtttcttggaatgatgcagcagataagaaactatttgtttctaatgatgcttttgtgatacctagcaagacaggtcgagaagttgcaggaacgcctcctgagactagcgtattgtagttttgatctttaaagtctgcgatgtctaataatgtacctggtaagatatctgtatcacctggatccattacacgaactttacgcagcatttgacgaaccattacttcgatatgcttgtcgccgatttctaccccttgcatacggtaaacacgttgtacttcacgaagcaagtagttttcaacagataatacatcgcggacttgcaacaattgttttggatcgattgatccttctgtcaatggtgcaccacggtggatcatatcgccttctgctactttcatacgtgctgtataaggaacagtatacgtacgtgtatctgtttttcctttgattgttacttctttggtacgtgttgcaggatcttctgagatatcgatgacatcccctgttacttctgtgatcactgcttgccctttcggattacgtgcttcaaagatttcttggacacgaggaagaccttgagtgatatcgtctccggcaaccccacctgtatggaatgtacgcatcgtcaactgagtaccaggttcaccgattgattgagctgcgatcgtaccaactgcttcgccgacttcaacgtcagagccagttgcaaggttgcgtccgtaacaatgtttgcagacaccatgttttgtattacatgtgaagacagaacgaattgtcactgtttcgacacctgcatcaacgatttgttttgcgatgtcttcggaaatcaattggtttcctgcgatgatcaattcatttgtttcaggatgacgtacttctttacgagtgtaacgtcccactaaacgatcttctaatgattcgatgatttcatttccttcacggattgcttggatctcaagacctcggtcagtcccgcaatcttcttcacgaatgattacatcttgagccacatcaaccagacgacgagtcaagtaacctgaatcggcagtcttcaaggctgtatcggtcatccctttacgagccccgtgagttgagataaacatttccaagacagatagtccttcacggaagtttgaaatgattggcaattccatgattcgaccattaggagcggccatcaaaccacgcattccggcaagctgtgtaaagttggaaatgttcccacgagctccagaatcagacatcatgaagattgggtttttcgcttccaaaccttccatcagtttttgttggatgctgtcttttgcagcgttccaaacagcaatgacacgttcataacgttcgtcatctgtaatcagaccacgacggaattgttttgtaatagtttcaacttgtttatgggcattttcaatgatttcttgtttttcattcagtacactgatgtcagcgatccctactgtgataccggcatgtgttgaatgtttgtaccctaagtctttcatacggtcaagcatcttagaagtttctgttactttgaatcgtttgaagacttctgcgatgatgttccctaagtttttcttcttgaacggtaacactaattcttgctctttgatatgtgcaggaatatccgtaccagcttcaacgaagtatttgtccggtgtttggacggtcaagttgaagtctgttggttcattcagataagggaattcaggaggcatgatctcgttgaagatgatcttaccaactgttgtgatcatcgtacgttctttttgccattcagtaaatggtttttctcctaatgagttagggttcacaccgatacgtgaatgtaaatgaacgtatccgttgcgccatgcgataacggcttcgttttgatctctgaagaccattccttcgccttcgcgtccttcttcttccattgttaagtagtagttacctagaaccatatcttgagaaggagtaacaactggtttaccatctttagggttcaagatgttttgagcagctaacatcaacatacgtgcttctgcttgtgcttcttcattcaatggcacgtggacagccatttggtctccatcgaaatcggcattataagcttcacatacaagtggatgcaaacggattgcgcgtccttgtactaaaactggttcgaatgcttggataccaagtcggtgaagcgtaggtgcccggttcagcaatactgggtgttccttgattacgtcttctaaaacatcccatacttcgtcttcttgacgttcgattttacgcttagcgtttttgatgtttgaagctagttcacgttgaacaagctcacgcatcacgaatggtttgaataattcaatggccatttcttttggaagtccacattggtacatcttcaagaaaggtccaacaacgataacggaacgaccggagtagtccacacgtttacctagcaagttttgacggaaacgaccttgtttccctttcaacatatgagaaagagatttcaatggccggttacctggtccagttactggacgtccgcgacgaccgttatcaatcaatgcatctactgcttcttgcaacatgcgtttttcgttttgaacgatgattccaggtgcgttcaagtctaataaacgtttcaaacggttattacggttgatgacacgacggtaaagatcattcaagtcacttgttgcaaaacgtccaccttctaattgaaccattgggcgcaaatctggtggaataacagggataacatccataaccatccagcttggttgatttcctgaagcgcggaatgcttctaaaatatccaaccggcggattgcacgtgtacgtttttgtccttgtgcagatttcaattcttctttcaattcggctgcttctgcatctagatcaacattatcaagtaattgtttgatcgcttctgcacccatagcagcttgaaattcttgtccatattgttcacgtttttcgcgatattcgcgttctgtcaacaattgttttttctctaaattcgtgtttcctggttcgataaccacatatgaagcaaaataaatgatttcttccaaagcgcgtgggctcatgtctaatacaagacccatacgtgaaggaatccctttaaagtaccagatatgtgaaacaggagctgctaattcaatatgtcccatgcgttcacggcgaactttcgaacgagtaacttccactccgcatcgatcacaaacgattcctttataacggatacgtttgtattttccgcaggcacattcccagtcttttgtaggaccaaaaatccgctcacagaacaacccttcgcgttcaggttttaaggtacgatagttaatcgtctcaggtttttttacttcaccgtaagaccagcttctgattttttcgggagaagccaaacctatttgcatactttcgaatttatttacatcgatcaaaaggggttccctccatttcatttaatggcaaaccgcaagacggctgatcttcgaccgccttgcagctcatagaccggattagtctaaattatcttctgcggtttcaaagttttggatgacatcgtctctttcatcttccacttgttcagcagctttcttttctaattctttggcagtttgctgttcggcaaattttgtcaaagcatcaacagtgatcaaatcgtcgtcttcatcgtccatgtcgcgaagttcgatttctgtctcttcgatatccaagacacgcatgtccagacctagtgattgcaattctttcaccaatacgcggaaggattccggtacacctggttttggaattggttcacctttgacgattgcttcgtatgttttcacacgtccgactacgtcatctgatttgtatgtcaagatttcttgtaaagtataagccgcaccgtaagcttccagtgcccatacttccatttcaccaaaacgttgtccaccaaattgagctttacctcccaatggttgttgtgtaaccaatgagtaaggtccgattgaacgtgcatgcaatttgtcatcgaccatgtgagcaagtttgatcatgtacattacaccgacagacacacgtccgtcaaatggttcacctgtacgtccgtcgtacagaacagttttcgcatcgctggccataccggcttcacgaactgtttcccatacgtcttcatcacttgcaccatcgaatactggcgttgctacgtggatacccaactgacgtgcagccatacccaagtgtaattccaatacttgtccgatgttcatacgtgaaggcacccctaaaggattcagcatgatatcgattggtgttccatcaggtaggaatggcatatcttcttccggcataatacgggatacaacccctttatttccgtgacgaccggccattttatccccttcatggattttacgtttttgaacgatataaacacgaactaacatgtttacgcctggtgacaattcatctccagcttcacgagtaaagattttcacatcgtgaacgatcccgccgccgccatgcggtacacgtaatgatgtatcgcggacttcacgagctttttcgccaaagatcgcatgcaatagacgttcttctgcagataattctgttaccccttttggcgtgactttccctacaagcaaatcgccatcttggacttctgcaccgatacggataatacccatttcgtctaaatctttcaatgcgtcttccccaacattagggatttcgcgtgtgatttcttcaggtcctaattttgtatcgcgggcttctgattcatattcttcaatatgaatagaagtgtatacgtcatcttttaccaaacgacggctcatgatgatcgcatcttcatagttgtacccttcccaagtcatgaaaccaactaaaacgttttgacctagagccatttcgccttgttccatagatggtccgtctgccagagtatcccctttttcgactttctcacccaaatgaacgattggacgttggttgtagcttgttccggagtttgaacgacggaattttgttacatcgtatttatctaatgcaccgttgtcgcggcgtacgcggatttcagaagcatcaacgtattcaacgacaccgtcatgtttacataacaaagcagctcctgagtcatgcgctgatttgtattccataccagtaccaacccatggtgcttgaggattgatcaacggcactgcttgacgctgcatgttggcacccatcaaggcacgattggagtcatcgttttccaagaaaggaatacatgctgtcgcaacggcaactacttgtttaggtgatacgtccatgtagtctactttatcaatagatacttctaagttttcactttgagcacgagccataacaacgtcttgagcaaatgttccatcttcattcaatgggctgtttgcttgggctacgatgtaatggtcttcgatatctgctgtcaagtagtcgatttggtcagtaacacgaccagtttcgcggtctacacgacgataaggtgtttcgataaatccgaatttatttactttcgcataactggacaaactattgatcaacccgatgtttgggccttcaggagtttcgatcggacacatacggccatagtgggagtagtgaacgtcacgaacttcataaccggcacggtcacgagtcaatccgccaggtcctaaggctgaaagacgacgtttgtgtgtcaattcgccaagagggtttgtttgatccatgaactgtgacaactgagaagaaccaaagaattctttgatacttgccacaactggacggatattgatcaattgttgaggtgtcaatgtttcagtatcttggatcgacattctttcacgaaccacacgttccatacgtgctagcccgatacggaattggttttgtaaaagttcgccgactgaacggatacgacgatttcctaagtggtcgatatcatcaacattgccgataccttccatcaagttcaagaaatagctcattgaagcaatgatgtcggctggacgaactgtttttacagctgcttctggatagccgtttccaatcacgttcacttcacgttcaggatctcttggtgaaaatactttgatgatttggacagtcattggatctgtgaccacaccatcttctgatggatagtaagtcactgaatttagaccgttatcaatgaaaggagctaatgtttccatgacttgatgagtcaagactgttcctttttcaacgatgatctcgcctgtttctggatcaactaatgtttcagctaatgtcagattcaatagacgtgtttttaaatctaattttttgtttactttgtaacgaccaacgtttgctaagtcgtaacgttttggatcgaagaaacgagcattcagcaagttacgtgagctgtctgctgtttttggttcgcctggacgcaaacgttcgtaaacgtctttcaaaccttcttctgttcttgagtcgcttgcgtttttatgcaagtctttttcgactgtattgcgtaatgtttcgctgtcgccgaagatttcaaagatcgtatcatcggaaccaaatcctaacgcacgaactaatacggttaaaggaatcttacgtgtacggtcgatacgtacataagagatgtcttttgcatcagtttccatttctaaccaagcgccacggttagggataacagtagaaccgaatccttcttttccgtttttgtcgacttttccatggaaatagacacctggtgaacggactaactgagaaacgattactcgctctgccccgttgatgatgaatgttccttgttctgtcattaatgggaaatcaccgaagaatacttcttgtgctttgatttcgccagtctcgcggtttgtcaaacgcaatgttacatgtaatggtgcagagtagtttgcatcatgcgcacgagcttctgctactgtatactttggttctttcaattcataatctacaaattccaaagatagattgccattgaagtcatcgattggcaaaatgtcttcaaacatttctctaagtccctcatctaagaaccattggtaagagtctgtttgaatttcgatcaaatttggtaattccaacacttcactgattcttgcgaaacttctacgttcgcgatgttttccgtattttactacgtgtccagccaagctcttcacccctctaaaatgtcattcaaaaagactacccgatcaattgttacaataatatttcaaatattatttctaggtaacaacagacattttttgcggcttttaggcaaaaaaaaaccaaaaatagaacattctcttgaaaccttacttcgtgagcttctacttttgtttccttatattaaagccgaaacggacaatatttcgtttctgccttttcttcatcagatagtttttgcaacttcatatactacacttattttctataaaagtcaacacttcctggcgtttcttctgctttttcgcaatgttttcttaattttttcaattttatgttttcaattatctgacaattcttaattgacagaccgttttttctcggttatactttagaaaattcattttgtggaggaacttctatgcgaaccaacatcaagcaaatcgtaccaacacaactgaataactttttctttagctactttagataggtttgtattcatcatgatggatacaaacgttaaacgacagtttgtatctatgatggctaaagaactttgtattgcagcaaaaagccacgtagacaaaatgctaagtggctgagcagtgaaaatacaaagtaaaagtatcaagcattctacttttcaatttattttccgacttttcaatccatttggacattttgtctgaatggattttttgtttcccaaaattaaggaggaaaaagaaatgaaaaaaaatatattaattggattaggcgctgccctgctactagctttaggaggttgcgcacaaaaagataattccgcagaggcatcagatggacaaaaaacaattggcgtattgcaacttgtacagcataactcgttagacgctgcctataaaggattcaaagaaggattagcagaagaagggtataaagaaggcgataatttaacaatcgattatcaaaatgcccaaaacaaccaagacaacctgaaaagcatgagtgagaaactcgtcaaagaagatcctgatttgctacttgggatcgccactccagcagcacaatctttattaaatgaaacaaccactatcccgatgactgtcacagcggtcacagacttggaacaagctcatttagtcacatccaatgaaaaacctggcggcaatgtgactggcacgacagatatggtgccaatcgaaaaacaaatcagcttactgttaaatatcgtgccagacgccaaaacaatcggcatcatgtataacaacggtgaagccaactctaagatccaagctgatttggcagaaaaagaattgaaaaaagcgggcgtaaaagtcaaagtactgacagcaaattccacaaatgatgtccaacaagtgacgaaaagtctagctaaagatgtagatggaatctatattcctactgataacacgttcgcaagtgcggcaagtgttgtcggtgaagtcgcaaaagaaacaaaaacacctgtcgttgctggcgcagttgatcaagtcaaagacggcggtctagcaacagtaggaatcgattacgaaagcttgggcaaacaaacggggatcatggcagcaaaaatcttagacggcaagaagccaagtgaacttcctgtcgaaacagcgaatgatttggaactgtatgtcaataaagacatggccaaagcattaggcatcaatccagacagcatcaaagaagctgaataaaacacaggaggattctcatgacaaatctgctctctcttttcttatcatctgcatcgcaaggggtcttatgggccctacttgcgattggtgtgtatgtcactttccgtatcttggacattgccgacttgactgctgaaggaagctttcctttaggtgcagggattgcggcagtaagtattacaaatggctatcatccattgacagcttgcctcctaggatttttaggaggtgcggcagcgggacttgtttccggactgcttcacacaaaattaaaaattcccgcccttcttgcagggatcatcaccatgactggtttatactctgtcacatcccgtgtgatgggtgcgccgaacatctctttattgggtcagccaacgatctttcattgggtcgagtcattcggcataacaaaagacaacgctgtactgatcgtcggtctgctttttgctttgatcgttgtatgtttacttgttttgttcttacgtactgaaacaggtcttgccattcgtgcaactggcgataatctggcaatgagcgaagcaaacgggatcaatacagataatatgaagatcatcggttatatgatctctaatggatgcattgctctttctggctccttgcttgcgcaaaacaacggctttgctgatttgaattctggtattggaacaatcgtgatcggacttgcctccatcatcattgcagaagttttgttacgtaaccagccgctatttctccgtctcttgactgtcgttttaggtgcggtcatttaccgctttattttggcgttagtcttcgaactgaatgttgagccaagtgattcgaaacttgcttctgctttcgtgctagtaatctgtctttctttcccgcagattcagcaaaaattccatttatctcaaaaaaagaaaggcggtagtgtcaaatgaatgacgtcttaacattggaaaatctccatcatacctttgaaaaaggaacgatcaacgaaaaccatgtcctgaaaggtatcaatctttccctgaaacccggtgacttcgtgacgatcatcggcggaaatggtgcaggtaaatctactttgctgaacagcatcgccggtacattttctgtcgatcagggacagattttattgaatgaaaaaaatatcacgaaaaaatccgttgttgaacgttcgaaatccatcagtcgcgtattccaagatcctaaactagggacagccgtgcgtttaacggtagaagaaaatctcgctcttgctatgaaacgaggaaaaaagcgcggcttctttcgtggtgtcaaaccgcaagatcgaacgtttttcaaagaacagctggctcggctgaatttgggtttggaaaatcgtttatcctcagaaatcggtttgctgtctgggggacaacgtcaagccatcacgctgttaatggctacattgcagcgtccagaactaatcttattagatgagcacaccgcagcgcttgacccggctacttccaaaacggtgatggaattgacagaaaagctgatcaccgagcagaatcttactgctttcatggtcacacatgatatggaagacgcgatcctctatggaaatcgactgatcatgttgcatcaaggaagaatcgtcgttgatatccagcaagaggaaaaacagcaactcacagtacctcaactattggcgttgttcaaacaaaacagcggcacgacgttgaaagacgatcaagtacttttatcttcataatcagaaagaggctgggagaaaaatgaacgcccaccctcttcttttttctctttccttctttcgtttttgttttatgtatcaaccgttgtttcttcaaaaactattttgttctctccttcttcctgatagaatggatgggaaaggagcttggtgccatgacaacaaaagacaaagtacttcatttattgaaggagacaccagattttctttccggagaaaagttagcacagcaactggaagtttcccggacaagtatttggaaagccatcaaagaattggaaaaggcaggctatcgttttgagcacgggcctacagggtatcgttacctgccctctgacgtactagatgcaaaagaaatccagcaagagctacggtcttttattcccgatttgaaggtacaaacgatgttgacttctgaatctacgatgaaagatgccaaactggcagcagttcacggagattctgtttcgaagttatttgttgctgatacacaagaacaagctcgtgggcgttttggacgacctttttttgccgaacctggacgaggaatctacatgagtctcttgctccatccagacaaacgttttgatgaactgcctcaatatacgatcatcgcagctagtgcctgtgtgaaagccattgaatcggttgccggtcgctctgcttcgatcaaatgggtcaatgacatctacatggatggaaaaaaagtctgtgggattttatctgaagcagtcagtgatatggaaagtggcaggatcagtcatatcattatcgggattgggctgaatttttctgttcctcaaaatcattttccagctgatctccaagaaaaagccacctctgtctttcctgatggacaagcgagtatcacaaggaatcagctaatcagcaaaatctggcaagaattgttcacctatctttctcaaccgaaaaaagcattggccttttataaagaaaaatcattcgtattgggaaaaaacgtgtcgttcaatcagaaaggaacgacttatgtcggtcttgcaaaagaaatcggcgatcatggcgaactgatcgtccaaacaaatgaacaggaaatgagcctatcttctggtgaaatcagccttacctctatcggttcctgagaagaatagcgctctgaagaggacaccgatttctatgcagtgtccttttgcgctttcctccgtataccattttccctcacgctgaccctctacactttttccattaaccagaaaaagacgtttcgcccacaccgataaatcatgctacccttcatatgtatatctaactgtaaaatagagagggagtacgcatatgccgaatgaaaatcagatagaagaatttaaaaaacatatctgtacaatcgaaacatataagaacactttaaatgtactacaaaagacgaaacctaagaatagtaaagagatgagaattaaagcaacaaaaataaagactttgcaaaaaaaaatagaaaacgcacaagacacgcgtcaaaatcttctgataaacctatctaacgactccaatgtcaaaaaactttctgaaatcatagaaaaatttaataagaacgcattagaagtaaacacaagtaagcagacagtaaattcgaggattagcttcttagaaaaacgcttatcgaagttaaataaaaatcaaaagaaaatggagcatccaaaacgctatttttgggtttcaaaacaaaaacttaacgaaaagaaccgaaaaattttaacagaaatcaatataattccctcgtatcaacaactcgacctgttgtcctccactacgcctatgcctactgtcataggctacataaaaaaaacgttagaaaaagaaaaagacagtctagaagctaaagatgtagtccaaatggaatacaagaaaaatcttccttattttaaccacattctggaccaatatgtaataggaaaaactacctctgaagaaatagaggaaaaaatagacgctttctctaagatgttctcatctattgagtatgtcgatcaattgatatatactaatttccctgcagctaaaaaactgatcgagaacgcgctagaaagaagccaactaactaaccaaccggtagaagctagaaatgtccggcttctaaaagaaaaaacacttacttcatctgctatacagacaacaaatgaaaataaagaaatgcaaggctcaactagcaataattctcaaatagacgctaatctagatagtaataatctatcacaaaaaactcctacttcatctgctgtacagtcaacaaatgaaaataaagaaatgcaagactcaactagtgataatactcaaataaacgctaatctagatagtaataatctatcacaaacaatgttgcctcaaaataaacatataacaacaactccagaaaaatcatttgttcaaataacagacaccctagattcttttaatataaatttgacgtttactaaaaatatttcggtagataacaaattagattccatactaagcgaagataacaacggaaggacagatatgatccatgtcaataatttccatgaactgacagagaacattactgctagtgatattgattcggaacattctgtagctagtaattctaataaaaaaaacattgaagaaatactatctactcctttatcagaaataccagaagaaaataattttaaccatttatcagtagacagaaagcgaagcgaaataaagatccttaatatgaatatacctgccaatgagctcaaagagttaaatactcttttatcaaaaagaccagaagaaaataattttaaccatttatcagcagacagaaagcgaagtgaaacaaagatccttaatgtaaatatacctgccaatgagctcaaagagttaaataccactgtatccaatgacaccaacagacaggaagtaaatccaaagaaaggatgcccaaccactcacgaactctagcacaggatttttatccgcctgctctctcttcattggcgtaccgtaaagcaaaaagcgatagatgctccttgaactggatacatctatcgcttttctatcaatggtgataaagctattatgttttcttttactattcagtttttatgatacccacaaaggactatttgctagtcctttgtgaacgtacctatgaaaatcataggttatgtgctttgattcttatctatttttcatcgtcttttgatcaaaagatcattgaggaacgatgtcaatagagccgatagaacctgcgcgatagttttcgatgactatcagtggcaggcattgctgataccatcttcttccctaggattgagatagttcaccttttcttcttgaagcgtgcgactgatattgagcacgtgattttccgcttgcaagtcttcattgatgaacatatttatcatactcgtcaacactagcgttgatagtaatagactaccaatgattttctttttcaatcaaattactccccttttattatctatgtagcaaccaacttacaactaaaaaatcaacgcatcccatcccccctgtctgacattctcgtgtttccatctcctatgataaaggactattttgttttttaatctttttgtatgcgattgcaacacttttaataacatatttgttattttttcctgtttgctacatagatagaataataaatagagtgatcaagaaagttcttttgcttttggaaagaacttcagctggttctcaggtgcttcacacaccacttgcattttgaattttttctctgcgacagaacggatcaaaaatttgtctgcgctcgtcaattttatcccgctttctttttcgatgtcttcaaatgtaaatgcctgtttctctccttttagccgaaggatcaggggcgggacatctgtacgtgttaaattagtgatgagttttttcaaatgcatcctcctcgatttgatttttgcggacagctgtttttctcttaggtaaacagtaagaattggctgattgctctgccaatttcacttatgtttttactataacatgttttttttcatgccttgggaccataatttctaaaaataaaaaagaatgatacgaagaaaaaaagcctttgacaacaaggataaaagtggattgaaaaaaatcggtacgaatcttttttcataaataatccccttggtttattttttatgggaaatatcagaaaaccgtaccagatattttccaccttagaaaaagacggaacaaaaacaaaaagaaagcatgataaagtgaatataaagatataaacaaaaagaaaagaggaattgacatgccaaaagaagatattgcaaattcaccagattataggcaaaaaacgccgttagataaaatgatcagtaatattcaaaaccctcaaacaaaagatcttgcaatacagctaagagatcaaataaacgttatggaaagcataaacgcgcacagatacactaactacacacctgatcacacaatagaaaaggataataaggcatataaccgggcacaaaaagaagtgtcaaacatccgagcagtactgaacaaacaagccccagaaatattaagtaaatttgatgatgctagagaaaaaacgcaggaagaacgggcacaacgacagcaaaagaatcaattatatgcaaaacaagatgcaatacaacttgataaattaaaacagtttaagaatttgctaggtcaacaacaaaaaaatataaaaaaatataagaaagtgaatacattctggaatagacgttataacaaaaataaaatcgcgcttgcaaagaaaaaatacgtacttactcaagtagaaattaatgagagatccaaagctgatcaatcgttgcttttgaatactagagaagagagggcaaagctagaaaatccacctaaaaacttacaaaaagcagttgaggaatacacacagagcctttctaaaagcccaacctcttatgacgtaaaaaccaaacgaaaatccacacacacccacgaaaaattaaaattggatgaaataactcaactcgctaatgaaagaagcagtaattcaaatccatcaagtccatcgctgcagaaacctaaccacacacttggaaaataatactcaagaagcccatcaaccgatttcaatcgattgatgggcttttgtattcgtacatcatttttttcaaatcatcagctttctaacttacgaagcaacctcaaatcgatagcggatgtccaatccaatgttgacttcttgctgatagtttccgaagtattgaccttcaatcataaactgggtttgttcattcggtgctagctcagcaactgcctgatttggtgtactttcataaagatcaacaaggatattgctcgtcttgtaattcatacgaagttttgctgctgccctctctgcagatggatctgcatcagctgtgcgtaacagctccaagttattcgtattgttcgtaatgttgatttcttccacgctgactttcagatttctcgttcctgcattttcaatatagtaaagcggagaagaaacgactcctttattcacatcagatgtaccgaaaagtagtttcttaggaatcttgacatcgatccattccgtcgagttctccacgataaatggcaccgtatagttatacttcgctgtgccacctgtcgctaatgtttcttctacttcgatgatcccgttacttgttccagccttgcttgtgtcaggatattggatgaactttgtcacattgatcgtatcgaatccgtcagtcgacagataggattcgatattttgacttaattcctcttctgtcaatccattttcaatggtttgcgtttctaccttcaattggttgatatggagtagatttaatccagactgagttagttcataataggctgtgtcaaatcctactgtttctgtaactaattgattatctcttgaaacccatgtattagctccattatagttagtgagattatctaattttttcactgaatgcgaaagaacatctccataacttaaactattattgattccattcaactgagaattccatctatccatcaactcttccggtgtttgatccaccgtaacataagaaacagtatgagatgaaacagttaaatctggagtagtgaatagctgtatcgtcggtcttgctgttaactgaacccaatcactaaatccacttcctttagtagctaccaatttaggaacaccgttgttatcaagtaaagaaacagcgctgagcgtttcattcatagattgtgttttagaaacgatcgaatgcccccatgtcacttcgtatggaatttctaattctaaagatgcagtggatctaatagaagttactttgacttttgcattgcgagtacctactgaggcagtatcaaaattggcgagtaactctacttcgtactgatctgaaggaatctctaaaccatttagtgtgacatcttctagcaaatcatgaaggtctaacttacccgtatcttctcccagtataaattcttgagctattggtttcgcttcaagcatagccattggctcaaatccatcttctgtcactttatagtaagcatagttcgtaccataagtgtaatttttctcctgttcattttccatcaataagtttttatttttatagttatttgattcctcttcttcgatgtgatagactttcacgacatctccgacagctacagctagtggagacccattgttgaattgattgatcgaatcttctacgatcattccccctgttacttcatgcatgaatttccttgatccatcagacaatacttcgatggaatagtaaaccgtgtctgggaacaactgatggacttgactggtaagtgagtagatctcacctttcgttgtaacgatctgcatagccccatttgcatttttgtttagactgtacacaccgactgttccgtaaccataaccttttaatttaagcgtacttccccattttacttcataaggtatagttatctgtgtcacacctaacccgtccgtagtacgtacttcggcttccacttcacgggtaccgaccaatgtcgtattaagatctgagagtaagactacttcatactcacttgcgtctacgactgtgccatttactcgtacatttctaatcaattcctttagattgcgtccatcgacactttcacctaagttaaatgtctgaggaactgcttcggcttccaactgtttgatcggaactaatccattgtcagtcactcgataataagagaaaagtgtgccgaaggagtagttctccgcaacttcatttaccatcagtctgcttcgagtccgagattctgcatggtagactttgatgatattacccgaagagacctctaatggctggccttgattgaacccattgattgcatccctgataactgcattacccgtgacttcatattgataggtacttgtttctccgtctaatacttcgattgaataatacatgagatttgcgtaataggggtgaacgtttaaatattgacgagtactgttatcaccaaatttcgaatgaagttgtagctttccgttcctatcttttatcaaactgtaggatccgactgtatttccaccaagtcctctcaaggaaatcgtacttccccatttgacctcatacggcacagttgttctcaggatgcctaatccatccgtcgtgcgtatttcgacttctacttcacgcgtatcgattaatgtcgtattgacttcggaacgtaacgagatttcatattcacttgcatccactgctacaccatttacctgcacatccgtaacgaagtcttttaggtcacgtccgtccgtgttttcacctaagtagaatgtctgaggaactgcttcagcttccaagtgtttgatcggaactaagccattgtccgttactcggtagtaagaaaaaggtgtaccgaaggagtagttttccgcgacttcatttaccatcagtctgcttcggctgttagattctgcgtgataaactttgacgacattccccgaagatacttccaatggattgccttgattgaatccattgactgcatttctgataatcgcattacctgtgacttcatattgataggtgcttgtttctccatcaaatacttcgatcgaatagtagacactgcctccataataggaatggacttgcgaaccttgattcgttctattgtcaccaaatgtcgaatgaagacgcagtgtgccatcggtgcttctcgttaaactataggcgccaactgtacgatcactaagccctcttaaggaaatcgtacttccccacttgatggtgatcggtacctcgatgattgaaacagctccttctgaatcttctagttgaatactagctgtcatctctccaacgagatttatatctggtcgattttgataagttgctttcagagctgacggatcgtctctgtcatctgatatattttctagtagatccatcggcgaatccggcaatgcttctcctaaatataattcttgcgcaattgggtcagctgttggaggggtgttctctgcctcaactgtgaatgaaatctcataatcataggaaactattttccctgtagataaggtttcttttacacggatcgtcccacttgccgtaccgactacagaagtgtctgggtactggatgaatttatccaagctgacaccttctacacttgatacatctagaaactcagctaatcggctatctaactcacttttcgtcgttccttgtaggatcatatgacttgatggagtaagtttactgatattcagtgctcgataaccgcctgctgtgatttcatagtagacttcaccgccgttatagacaaattgctcgttttctgtcactgcattccccgctggtactgctacccatgaacgcacgacatcaccatagttaactgattgtgtagtccagcggcttaaaacatcatcctcttgttcttcgccttgcgcagttactgtttgaccggcagagtcattctttagatccacactgtttttttgactcaagtcgtaccaagaaaagttatagtaatctcttccagcataatttggagctatactttcagacgtaccagtagatctccatcctttacttgcagtgatcaacggatgattttcacgatgatgtaaagtaaaagcagcagctgtcctactaacgagtgggaatcgtccaaagacgatactgtctccccatatgatttctatagcgacaggtatctcttgagagagagctgtttcatttacagtaatccgtaacgattgtactcttctagcactcacggtatctgtagcgataggcgcagaagtcatttccacttcatatcgatcttcatcaagcttttctccatccaccacgacatctacaaactgacgaagatccactgtgttcatgtctgttcctagcaatactttattatcagtcttagccgttacttcaagtttagaactaacaacaaatggtactgtgtagttgtaagtagctgtctttccagaatcgagtatctcttcgacttggatgaccccgtttttccttccattagtagccgtgtctgggtaggtaacaaaaccttttactttcactctaccagaagtccccacatttatataattagcaacattttgatctagttcttctctggtcatcccgttaaaaatctcatgttcggagaccgataacttatggagttcaagttgacgatactgaccatgcgaaagaatctcaaaatattctgtttgcgcgctcccagtataatctggcatctgaccttgctttgataaccagatcttcccctctgcatggtaggcaacggcaagatccccaggagtaggagtgtaactgctattattccacctgtccagagcttgtagtttaaaactgcttcccattactcggtgggttattttagtggttccaccggaaagattatttaacaaaatagtagagttgaccccaaatataccaaggctgtagtaagcgttagaactgttcatgccctcacctattatatctaggacatcatttccttcagctgcaaatgcctctatcctactagacatcattcgataggctcctccaactggtgcccatctgtagttgtttccaaagacgatcgtatccctatccgtataactcacctctataggaatatcctgacttattaccgtaccattggatatccgaacagttattggtagttgatgtgtaccaatcgttgtaagtttcctatctggcgcagatatactatagtcatcctgaccgataggaacaccatctagcaatacatttataaactgcttataatttatcccatttgtgttacctgggtacgttgaacttacagcagtgtgttggcctaaaggaaatgatccgggatcattgacctggagtgtatatggattactactgaccgtaaagttcccgatcgacagataagagatcggtacatcttctataggcgtagcaggcacctcaccacctgaagctacggcagtagagcctaatacaagattatgaatcccagctgttaattggtagttagtacggttgctgactcttgttctagtgatcgtccctgacatcgtcatcgtgaaattattattgtttatcgtgtgattcgaagtaatactaagatcaccagaaggccccccaacttcgacgacttccgtgcgtccgatctgataattatttgcataagaatttcggccatagtgcatcctgttgacaaaagcaacaccgatattaccattaccaacgataaatgagatccagtcactgccgttcccatatacgagagaatgggtcgggaacgtaaagctgtaggaaatactgtctcctacattaggtcccaattctgacaagttactgactcccgtattaaatccagattggactgctgctcgataagaactttccccgtttcttctcaggtcttcacgatattggggaagattgggaaggggaatctgcggacttggcacagctagttccggtacgggaatagctgagtctgtctgtggttcgacggacgttggttccgttgattgttcttctgctacaggttcttctgtaggctctgctacagcttcctccgccacttgtggttcggctgttggtgtttcttcacttgcgacctcgctactttcagacgtcaaggttgaaactgcatagacgagggtagttggactgatgctagaaatcatcaacgtaaaaactgctagtattttgaatagtttcatttttctctcctctctcttttgtatttgttcgcctgtctaaacatatgtgtctccagacaaggcttttttactcaataaagaaagagaaccgaggagaagcagcacacctgctgccgttacccatctacttgtttctacagcattcgtttgaggcaaattgcccttagtgtcgctagaaccggatgttcctgacgtatctccaccggtactttttccagaatcagttgcggaatctgcagttgagcctgtatcaggcccagcacttgatcctgttccaggatctgtgcttggatctgttccaggttccgttggtttttctgaatagatcagaccgctgacttcgatcgtgctttctttttctgctgcatctgtcaaactgttcattgataagcagaaaaatcccagaaggaaaaccagtggaatgatccctgtttttttcatttttttatacccctatagcttcaaattgtaagacaagttcgtattgaggattaattgcttccccaaattggaaattcgctccgacactaccagagaaagtaaactctgagacatcgtccttgttcggcaatgtcactaactcacgtggaaattgcggcgcagttgttggattgactaaagggatggatgtactactacttacactatccatgttcaacactaattccggcactttgtctgcatcttgcccttttacgaagtttccaacagagactttcacgccttttgccgagttgtttctgatttggtagatcggcgctacgatctttccttctgttgcatctgtttgtccgaataacacttttgtcggaatcgatacatcgatccaatccactggatcagttggttctggtcctggtcccggatctgtcggatcccattctttgaaggtaccttctgctgggatcgtggcattgtcttgtttttggacagaatcatacaccgtattcggatcaggttctcctccgacccatgtataagcgcttactgtttgcccaatcgccgccgtgcttaataaagcaagtgccggcaccatcacttttgcagataatttcatttcttttcctcctaaaaatatatgtttgctatcagttaactttcaactgttaacttccctacgacagaagacgttccgactacatttgattcatcatctaaaaactggacggtactaactgtcttgtatgtgccttcttcaacttttcgcagtagttttccttccgtcacatattgttctggctggattacacccgagatataaatctcttcgtcttccccttctatataagttgtgacttcgatcgcatattcattgctgggcgggttttggatattcactgatcccggatcgtcagaggtatcaaaacgcatcgttgtatctaacttcaatcgtacgtaatcaccgtctgcttggtcctgtagaaaattgcgcagttcttcttctgacatgtctttgataaatgactggtctccactgtttaagttcatgatcacttcgggttctctccaaaaatgatcatagataaaaaagccaataagcatagttgtcacgatcgctagagcagcgataagcttttttttatgtcgctttatcagaatacctccctcctttgtcgtttttttatcgatagagctattatggttttatctacaaaaacaaacgaatggtatctgatttttctatttgtttttctcgttaaagccgcctacctgttactactttatcagatgctgaacagtctcttagaacagttttttccttttacagaaatatgtggatgaccagaaaagttaaatgaacttccttcttattggattatttattaggatgaaatagtaaccgattacaatggaaaatggagggatttgaaatgaaaaatagaaaatcacgtttactgacggcttcactattatgttagtacattccttactactattcctactctacaagtagaaggaacctctttaccagaaagacaaccgagtgttgcaacagtacatagagaaatgaatacagaactagaaaatatactcacctcagaaatagacccacttgtatctactttcattacgcgagtggtcgagcctgaaaaccaaacagcgatccaaatcaaagataggaacttggaacgttgtttgaaggagcactttggtttaagtgaaaacgaaccgattaccgataaacatatggagagtttgatcgtattagatgtctctaatcaggaaattgcagacttgtcaggcatggaacatgcaaagaatatagaaaactttcgtttcaacaataaccgtgtgtctgatttgtcccctttaggagaacttcctaatataaaaattatcggagcagattctaaccagatcagcagtttggagacactaaaagattgtcccttcacttgaactgttgtccttggtaaataacggtttgactacactaagaggaatagccatctgtacctccttaactcatctatggatttcaagaaatcaggtgcctacattaacagagctatacaatctacataatttggagatgatcgagttcaactataaccttgtcgcagacatctcaccattgaagaaccatgtcaatctagaaagaatttacggagcacataatcaaatccgccgattggatgaccaattacagtttccaaaattgtccctcttagagttagggtacaatgatttcccttacttaaataatgaggcgcaactccaattcttgaataagatcgcacaattcaccacactggaagccttaggtctttcaaacaataatctttctacgatcgaacctttagaaagtttagtgaatttgagaagtgtctttttaactgctaataaattgacatcaattgacactttgaaaaacatgcctgaaataagctttcttaacgccagagaccaattagtcagcccatctgtcgccactgtctatacaccatttccattacgtatcagagatcgttttgggcagttacctgaaatcgtctttgatcatcccggtacctatgacggatagaatgtgatttggcatgaagctggtacgaacaatcttcactggtacaccacaggcggtgcttcaattgaatttagtggtaccgtcatccaacaagcgattcctgattaccgaccgtctcagcctggaagaattcgctatacattcaatccaagaagcacgacagttacttgggagccttcagtagatcattacggtatcagtcactacgaattctatctatgggactttctaattgctacaacaacggaacccgaattcatagctgaggacattcgtcatcatggacaatacccaatcacgatcattgccgtttctaacagcaggagaaaatcagatcctgctttcgatcttatatatagatcatggatgccaatcaactaaaatcaaaaaagaacttacgacttgtttttgtcgtaagttcttttttatttagtgtcttagtctttcaatcccaataaacgtctcgcatagatcacctgaccagagtgcatggcagcatcatcaataatagaaacaagacgcatccctcgcgtgactggtggtgtccagttttcgtcaattacttcatctagctcggaaggttctaaccctcttaaataggaaagagcagaatcagaagcagcccgcaagtaccctagcaagtcttctacttgattagtttggatttgttttgctcgttccagactgtgcttccaatcttgttcgtcatctgctattctaatcggaaatcggctttcccaatcttggctgtgccaaattggagaggtactggctaaatcagcaatctggaaatccaattctcgagcggtatgccaagccagccaagtcattgatttgatttgtggggctctatcttccactggaaaacggttggcctcctcaatagagacaccttcaaacaaacgttcaaatcgctcgtatgctcggtctatgctctcgcataacatatctaaataattcatctattttcctcctttttatttatcctacttgctttttcctaactctaggatttctacttatatgttactacaccccctcattttttacactttccagtcactagtatgaatcgtttggagattgaaagagaaagatgttctctattttccatttgaacaaaaatcaataaaatgaatgattcattaatattgtttaaataaacaatgattttttaaacgaacagtttaagcctaggaaaaaaagagtataacaggaaaatgtttgaaatgaaaggaagggaaaagatgaaaaaaagggtaagtttattaatattagttactttattgttcaacatcttttcgtatggtgtggctgtttcagcggagacatttcctaaagatcctgggaatgtttataatgatttaactggtaactatggtttgctgggaattgctggtcaattccatgtatttgccaaaaacaagacaacagttaatgcccatacagacggaaatatagcaacacatgaactggatgcaaataataattttgggacagagcttcatgaaggcttattgaaccaagagatcaattatatacaaaaaactgattctttcattaattcttcaggtatccctactggcgacacaagagtaaataaatttgtcgttggtagtgatgtggatgtagcattacaagatggacatcctacggttaatggatcaaggcttgatcacttaactccggatgatttttataaagaccgtgatggtaacgaatatattgatttcgagcaagagtttgctagattgaatgtagcagcaaatgaccttgcaactgccaccccaggtaaaacatatactgctgcggattttccagacatgaataatcgaacaattgatttgactggtctatcagattgtggatttttattggtaaatatcgacgcagaagtgttaacgatgaatacgccacttcaaatcatcaatccaagtgatcaagtagtcgtattcaatgtcatcaacagttcttctgcattgaacgtacagtcaccaatcaaatacaacgatcgttcaaatcatgaaacagaagatttttcggatgcgaatatctcttggaatttcggaaatgagatgactgatttgacaatcagtgctccttttcaaggaacgattcttgcgcctaatgccactattcacattactcaaaaccaagatggaacgattatagggacaaatgtgattttagatgcggccaccaatcgttgggatcctaacgaaatatttatcagcgacaatggtacaggcggtacagatacaacgtccacaagtgataatactgacacaacgacttcaagcgatagcacagattctactaccacaagtgatagtacagatacaactaccacatcaagtgatagctcggattttactaccacttcaagtgacagtatcgatacggcagatacaacatttatcacaagtgatagtcgtcatgcaagtgtctctttcccaagaacaagttcggataacaagacgaacgttaacttagctaataaaacaagcgatgatcgtttaaataaatcgaaaaaagtacttcctaaaactggaagtcaatcaaataattggataacaatcgcaggcgttatattacttgtaatcggtttaagaatcactttcatgagtaataagaagtcgaaaagataaaaaaatgaaccgagataaaaaataaagagcaacgtcagttagtgacattgctctttatttttgcttgttaacatcaaaaaatccatttcaagtgatccaaaaacatgtagatttcatccttaggaatttatccacgtgttgcaccaatttctgttcagtctttgcggtctagaatcaattgagtaagggaaaaaagattttctctcgttcgaagagaggtgtcaggtaatttcttgatttctttcaacgccttttctgtgtaggctgctgctaatttcttggcttctcccacacctcctgtacgttcaacgattttgcgtacagcttcaatatcttcttctgtcattttcgttttcttctctaaataaggcagtaaactctgtttgtttttttgcaaagaatagatcaatggcaaagaatagactccttgacgcatgtcttctagtacaggtttcccgatttcctgactctcttttgtataatccaaaatatcatcgataatttggaaggccatcccgatagagagtccgatatctcctgctttttttgcgaaacgctcgcttgttccactttcaaaagcgccaacagaacaacttagttggaacaattcagctgtcttacctgagatattctccaaatattcttttacagaaagttcataattatagcgatcatccatctgccctaattcgccattcaatactttttccatactgcgagaattcaattgaagacttttcagggaagtcgagtaatcagacaatagtttaaaacagcagacgaataaataatctcctgcataaacagaaacgacattcccaaactgactacggatattaggctgaccacgccgcagatctgcttcatcaacgatatcatcatgaatcagtgtggccgtatggagcatttcgatggaagctgccaaagcgatggctttgtcccggtcttgctctggtccaaattgtgagaacagtagctgataggcaggtcgcaacagttttccgccagcatggatcgtttctttgattgcttgttcgacaggtttgtttttcagacggacagtttcttccatccgttttagtgtttctgtcaattctttacttaaagcaggatagttttcccacattggatgtagcttcataaaaaaactccttgtgtgacgattattttttggtaaacatcgggctccattgttgtttggttccctgctcataatctttttggaatcgttgcagtgtctgcacatgtcgtaaaagataattcgccgcgattccgatagcgattcctgacaagattcctaaaacggaaaggactggcaagtacagcatgactgtccatgattgcgcaatgaaagaggccatcaaaagctgaccgacattatgcatgaacccaccggccgcactgatcccgatgatactgatacgtttgggtcctaattgcttgaccaataacatcccaaaataactaagcagagcaccgctcatgctgtaaaggaacgtggaaatcgttccacctagcaaggtagtcagaaatagtcgcagccacaatagcaagaagctgtcccgttttttcatggtaaaaatcgcaacgatcgtgatcaggttggctaagcccaattttgctccaggcgcaaaagcaaaaggataaggaatcatattttccaataagccaatgatcactccttgtgcaacaagtagcgaaatataaatcattttttgtaatttgctcatggtgtgtgaaggtctaataaatcagactgtcttcgtcacccccatctgtagatcggacctcgatcactaatttatgtggtaaacaaacaatggtttcaccattttttgttgcccagcctcgacgtacgcagatctggtcatcgcagtctgcttcttttatccgtactcgatcgccatctatctcaatcaagttataatctccgtgtttatctttgtaagtatatgtgtagctcttttctccagccatcaaagggaatgttttgatttctgtgccatccacacgcagcaccgcttctttttctgctgttgcggtattttgctgaagaccaaaaatcatgactggtaaaaaagaaagaacagtcaaaagcaaaataataaaaacatcccaaggtttgagcagacttttttcagcaaattctttaaggctcatttttgttctcctttttccagattaactcacccaattttagcataaaaacaagaggttgtgacacctgtgccttgctttgagtaataagaacgaagaatagaaagcagctttccatgttttctaattctctgggcttattaccgagaagcagcaggtggaacaccgtttatatcaagaggttgtgacagaagtgggcagcttcaagaaataagaaggaatttatgaaaattgcttctcaaatttttgtgaaatttcgtcttatttccgaagaagctacttctggaataccgtttatcagaggttatgacacctgtgtcttgctcatggaggtttatctcgggcatcttattcctttgttttacataaaaaggaggctgcgacggtttgcctcagcccctttctattgaaaatcttgcattcaaataacgttgttcatttatttttatctatttatttcttgccgtattgggcacttggtctaccgtaccaccaattgcctagtgtacgttgtagccacggaatcacccaacgatccaaaccaatcgcacgaccagagccgttcatcaatgcgaaagcaacaaaaatgaaccaaatgtttacccaataaaacattcctgataaacagaatgtgatcactaatacgatcgttgtcgcactgcatagccatgtgaataatccagcaatcaatgctaatgccaaggcgatttcaaagaataccataaatttttggaagaacattgctacatcattatttggcatgattacttgcataatcttcgtgaaccagtctggtgacttctcgatcacagccattggttcttctccgtatgcataactcaaaccgaaatgtgcagcatgagtcgctgcttctccggcacttgcccctgctccgctggcagctgtggttgcatctccagcagcagaagcaccactggcaacatctgttacattatattcccacgtccaaggaaatacactgtttccagtgaaccatgatccttcaccaaaccaagtacttggtctgaacacttcaccattaccaatgatttttttggaagcttcaacgaaccaaactaaaccatagaaaatacgaagtggcacactccataagacgttaccgtaacgagaagaatgtcctcgagtcacgttgcgatcgtctttgatatggaaaaactcatgcattaaatattggaacatataataaccagaacgaatatcaaagaagtatttcaaattcacgatatgtttcattacgatagctaaaaatccgcttaaatggatcttgtcaaataggttagctaccccccatttggcaccaatagaaaccataaatccttgatagtttcctttaaatttatgcttttctccgcctttgatcgaagccacgatattcgctgcggctgtgtgtcctgtttgttcagcagcttggacgatctgcggtgtcggtgttcctggaaactcttcataaaagactaaatcaccgatgatatagatgtttttatcttcatagccttttgcctgcatgtattcattggcgatcaaccgctgtccgcgtgctgcttctaatccaaaatcagcagcatcagaagttcctttaacaccagctgtccaaatcagtgtgtgggtcggaatgttgcgtccgtccttcagcttgatatgatccgcagccacttctacgattggtgcattcaataataattctacattgtgcttacgcaaatagcgttcagcttttgcagcatcatttcggtctaacatattcaagatcgtcggcattgcctctacgaccatcagtgtgatctcgtttggatccaacttgtaatctttggctaagcgatttttccagtcaatcagttccccaatcatttcaataccggtaaacccagaaccacagacaacgaaagtcagcatggctttacgcaactcatcatttggttccaacgcagcttttgctactgttttctcaatatgttcacgaatccttacagaatcttcaaatgaccaaagggtgaatccgtgagctttgacaccaggtgtaccaaagtcattcggctctccgcccattccaaggatcagctgatcaaaaggataggaacccaatttggtcttgacgattttctgttctttatcgataccgacaactgtatctgtgacaagttgtacattcttttgacgagcaaacaaatgctgcagatcgtattggattgcttctggttctacacgtccgccagctacttcatgcaactcggtcatcatagtatggtacgaatgacgatcgatcagagtaattgctacatcttcttttttcagtttttttgccaagtattttgtagctgaaacaccggcatatcctgctcctacaacgacaatattttgctttgccattgatcatccgctccttatagactatctatataatgaatatatgataattcttttagtttgatacttattacacaatctccatatattatatagatgttctgttcttttgtctaactccttttggatttttttcaaattttaaaataaagcgttttttcacgaaatttgctgaaagaaaacgtttgaaatattacgcgggttatttatcaaaaatagttgacttataggctaaaaagattagaatgtataatgaatcacaaagaaaaattgtggactaaaaatggaatggtggggtattaaaatgaagaaaaaacgttttgtaactggatttgccgtgttagcattttcagctctagtgttaggcgcttgcggcgcagatgataacggaagttcaaattcttcttctgaatcatctacagcacaatcttcaactgcaaaaagcacaacagaatcatctacaaaagttgttgctggcggagacttgcaagacggcacatataaattagaagaaaaaaattattcaaatggttaccgcgcagtttttgaaatggttgtaaaagacggtaaaattactgaatcaaaatatgataacatcaatgaaaacggcgaatcaaaaacaaaagatgcagaatacaacaaaaacatggaagcaaaatctggcacaaatccagaaaaatatattcctgagttgaacgaccaattcttaaaagcacaaagcgcaagcggtgtggaagtcgtaactggagctactcactcatctgaaagcttccaaaactacgcacaacaattgatccaagctgctcaagctgggaacacagatacaatcgaaatcgacaatggtgctgatttgaaagacggcacttacaagctagaggaaaagaactactctaacggctaccgtgtgcaattcgaaatgacagttgctggcggcaaagtaactgaatcaaactttgattatatcgacaaagacggtaaatcaaaacaagatgatacagaatacaatgaaaacatgaaagccaaaagcggaacagaaccaaaaacttacatccctactcttaacgatgaattcgtcaaagcaatgggtgaagaagatggctcacctgctgatgtagaagttgttacaggtgctacacacagctcacattcattcatcatgtacgcacaacaattagtgaatgcagctgaaaaaggcgacactcaaacaatcgaagtagacaatatcgtaacagagtaatatcatataaccatattaataaaagttggagggtgggacgatagccagattaggcagtcgtctcacctttcaaaatgaagagaggaaaacaatgcggaaaaaactactattttccttaatcacactgggcatctcttttatggtgctaactggctgtactaattcagcaaaaaaaacaaccactgaaagttcagcttctaccaagatcttgaaagatccgtactctgatgaacagttcttgttagggacttacgttcgtatccgtgtgtatgatgaaggcaaagaagcagcattgaaacctgcctttgatcgagtaaaagagcttggtgataaaatcacgatcaaccaaaaaggttccgagattgatgaagtgaatgaacaggctggaatcaaacccgtaaaagtttctgacgacgtctacacattagtcaaacgagcctatgaatacagccaagattctcaaggcggattcgatatggcaatcggtgcaatcactcaattatggcgaatcggatttgatgacgccagaaaaccttcacaagaagaaatcgatcaggcattgaaattagtggattatcataaaattgaactaaatgaccaagaaaaaacggtctatctaaaagaaaaaggaatgatcatcgacttaggggcgatcgccaaaggctacattacagacgaagtagtgaaagtcttgaaaaaacaaggtgtgactactgctatcgttgatttaggtgggaatgtctatgtcttaggacacagcccaagaggcgaaaaccaagactggacagtcggcatccaagatccaaatatggctcgtggctctgttttaggttctatcaaagaacggaacaaaacattagttacttctggaatttatgagcgctatctagaagtagatggcaaaaaataccatcatttgtttgatccaaaaacaggttatccattcgacaacgatatcgcaagtgtcacgatcataacagataaatccattgatggtgacggtctgtctacagcagtcttttcaatgggtgtgaaaaaaggtctggaatatgttgaaagtgaattgaacaatgggacggaagcaatcttcgtgacaaaagacgataaagtatatgtgaccgatccgatcaaagacactttcaaattatctgaggactcccattacacgatgggtgaccgttctgaactaaaataaggagcacgaaccatgacactaaaaatctttttagaagtagttgaaatacgaacaaaggtggctagtgtatttccttttgcggtaggggtattattctctatcgctttttttaacgagatacattggttgaacacttttttattttttgttgggatgctagtttttgatttagcgacaaccgcgatcaataattacatggattatgaaaaggcgcattctgaagtatataagtatgaagaaaacgtcattggtcgccgaaatctatcccctgtattgatccgaaacatgattttagcgatgatcgcatttgtttttgttattggcgttattttaacaatcaatacgggttggcttttgcttttgatgggatttatctgttgtttcatcggagtattttatacattcggtcccattcccttgtcacgaatgcctttaggggaaatcttcagcggggtgactatgggacttgggatttttgccatggtcgtttatgtcaatacattcggttcggatgtctatgatctgacaatcgatttttcatccggacaatttgctttggtaggaaacctttgggctgtagcagccattgtattggcttccttacccttggtgtttacgattgccaatatcatgttagctaataatttacgagatcttgaccgcgatattgaaaatcatcgctatacactggttttttatatcggacgcccagcaggaacagtcttattccagttattgatgtatgcttgctattttgtgatcttgatgggcttgttgagtggtatctatgaatggccaatcttagtcaccttcttgactttgccaattgtgaagaagcatttagatcaattcaagcaaacattaccccaacctatcagtttcagctattccatcaaaaatatggtcttgttcaatgctagctatgtattgggtctattactaacgatcattgtgcaatccatttaacgatttgaagaggttgtgacagaagtggtcagcttcaagaaataagaaggagtttacgaaaattgcttttcaaatttttgtgaaatttcggcttatttccgaagaagttacttctggaacaccgtttattcggaaaaaggaactgcgacaagacttttgtcacagttccttatttttttgattcgtatcagcgaacttgatgagaattttcttgaactaatgaatttctcatagacttagcatttttacgcgcttgtcctactttattttctaagtttggattttgtttattaatctctccttctctacgcacagctggcaataaattgttcaactcttgagatatttcttgttcattgagaaggtgtaacttgacattagcagtatcagcaagatctttgatcgtactgataacatccgctgtttctttaggataaaatttattgtaactgttttttaaagctgctaaagcaaatccttctttatagttcaactgttcaaatgttttactaccttttacataactgggtttatttttgatttcttctctttttctatatattttttgctcaagattatgcattttctgacaaatctttccataactaattaaatttttttgatattcttgaattagttctacagatgggttataaatcaacattctatttttatattcgccagattgaaatgctttttttaattctgctttatacacggggttgtttagctctatctcttccttctgtatttctctttgtcccttaaccaattttcgttttatcgcgtgccattctttacaaacgtttttgaaatcctgattcagcaattctttttctttttttaagtccttcttattaggcattttttcagacctcgctttttgttttattaagcctacctgttggctttgctgttttaccgacaaccgtttttttttatgacttgatcttctctaggattatttggggtacttttaagggctgctctagctttaataatgtcttctaacgtgatttgaaaattactaggcgggcgttctttattcacttgttgcttgtataattcaatcccaaaatttgctgtcttccggatatcattcattgattgttcaacgttatgacttaaataggatttggctgtgcccaccacataccctttccttttcatcgtcttacttttatactgataatcatttttgttattcaataactttcttacatctagaatctgttcttcgacatctgctaatcgttgattccacaccctatatgtttcttttgtttgattatattcatcaagcaacacttgcctttcaggaggtgcagtcattttttcctgttgtttgtttaactttttttcgatttttttgacgttatctaaaatataagtaaagtgtttatttagtacgttcttactgctgcgtaaataagctttttctcgtttatccatcatgaacctccgcttcattcgctaaatcgagtcatgtgctgttgaccattgcgccttgtttcatttgtctattgttgagatacaaactgttatacgcttgatttagaaaatgcttaggaagaggtgaagatctcgttcttcctaagcattttcgatttttcacttatctagatcttgatggtggtgaaattcttctctcattaagcaccctttcattccatttgttagctttcttagttgcggaagctgtaatctcacttaatgaacgtttccggttctgtgttggactttggacccgcgctctagcagctttgttgcttcttagtagttcaaccccctctgcttttgtttctcctgaattttgcattgacggtcctagttctctattgatgttattccgtgatatagtaatttctggctttttgccttttagatcctgactttgggtctgactctcattttggactgctccatttttttggttctcttgtttgttttctttttgtttcccctgcattttttccacaaaattgatacttcttgttctagcgttatataaaagtttaaacataactattggaacacgaggtaggcttttaatagtctcgcgaaaccttctctgtctcacaagattgatcgttcctcttacaattctatatagagacttcacggcaaataataaaatacggggagtacttttagcaagatagagaaaccctctttccgtgagttctacttctttgtctttgctagcattgtttccatccattagcttgtcacatctctttcagtgataatgaccttgttcccttcttcatctgttgtctctatcgtccgttcgggcaaatcgtctcgtgttgtcccatcttgcgttagtgtgacatcgtcatattttttttcatagtaagagttccacttgaaggtccctactggtcctgccaaaatatattttgatccttcctctgttattttgaagttgatatcttgctttctatcgttactatcggttctgcttaaagaaatggttgctccactttgttcggtaactattcctgaaatagtatatttgaaagtctccgtctcctcatcgtcaccttcgattttcgtttggacgtactctccgtctttgaattccaacttgaatgttcgatctgaatttttgttctcccagtgaccttgcgtcaagatatcagaccacatttggttcactgctttttcagccgcttcgatttgttcggcattttctgattccattttttgtttgatgtcttcattcggatataagaaaatctcttcttctccttctttcagatacatcactgtgctacccatccgtgtttgtaattggaattcctttgtttttccatcttctgcttctaaaaccataatgttttggtccttgaggtagtattcgcctttaggaatccaggaagaagcccagtaagttccatctgcatctaactcgatatacatatcatccgaacggttcgaataccatgttccgctgtagattgttccgttataacgtccgatcgtttctttgctttcttgggtctgttctgtcttatcatttgcttgggctgtttcctttggtttcccactcatcagtgaataagtgacaagagtaataacgaccacgattagaacagctaaacctataatgatgtttcttccagctttcgtctctaaaaaatttttaagcatcttcgcacctttcttaaaaaataagattatggggttccataccccgagatagctatgctatctaaagcataggttcttcttcttactcgattgtcggaatttccttcgatgacttggaccattccgccccctgcatattccacgattccgacaaaatccttgccagttcttccacctgtccaatcaaagaaaataagatcaccagattgtggtaaatactcttcatcatgacgtttgaatttttcattttcgtagaaccagtctctcatcgctaatacattcggagtcttcaatactcgattctggttgatataccctgcttgatctgccacccatgaaacgaacatcgcagaccattctgcacgattttcaaaaccaaaccagcgccagtatttatcaccattcaaattccctaactcttctctagctatttctaccatacgtccactctcgaccatgatattattcgttacaagttgcgcataaaacatatttccataatcatatcgccacgtataaccaaaccgcaacgcaataggattgtgatacggaacggttttcccattacttttatctcgggcaaagattctgctgtcatcaaaggagtaatcactatttcttcggatcaagtcatctaaatatccttctccaaagttatatgcctggacagcagctcgctcattcttctggttttcctgtgcttttttcagaagacgagcaaaataacgtacgccaacttcgatggattcttctggacttctaattgaattaggcggtcttccttgtgattcactggcttgcatgatatccggaaattctctctcatttccgcctgtttctacccagataatagataaaatcgcattttcatacccttcgatatcattcttctttgtctcttcggccactttctcccgccatttagtaacagaagctggtggattgattagttcccctctcaaccctcccccactgcggaaataaccgagattcgtctcatgagcaaaagaaagattatcgatatatactgctggatatagtggtggatctgcgtgccagaaacgataaagttccatatccataagcaaattaccaccattatcagaacgagtatatccaataaggtcacctgcagataatcgctgacctgaacgtagtccaggtacaagattgatatttcgataatgcagataaaatgaaaattcattgatgtagacccatgtacgtaaacctggactgcctgtatccccccctaaggtcccatcaatcgtttcttctcccattgcgtagactggcgtccctggctctgcttctagcacaatatcattgtttctatcatctggatttcgtccacgatatccgtaattttcgattacacttgcgtaatgagtggctccgaatggattaagtaaaaagattttgttctcaaagcgatctaaatcactgattggataatatttatcaacttcctcttcatcaaatgcagatactctgccgtaataaggatcattgtttgaaggaataattcctcctctcatcgtatagacatctacttccgggtctgaatctagcatttctcctaatgtttggatgttgatatttattgtgacaatatcttttgtttccgtcttgacttctactttctcttctccagtctcttcatcgatcgtgacggtcgttgtttcaatctgtttgccaagttcggccagtgtactgtagttatagaccatatcatggattgcaaggatctcatctctgactttattcactctaactggatgatcagtcaatgtatatggagtatctgcaaaaatagcatagatacttccacgattaggaatccattgaccggttttttgagcaatcctttcccgatatttcgctattgctaattcatcgatatcgtaatcttcgaattttgcattcaaatagtataagtaactatcgccatttgaagaatataaaaacgtctcgggatctgattggacaccattgaccatgaagtacacttcatcgaatgcgtcgtcattgatcaaattttggtaagcattataaacattcttatttttgagagcatctagatgtgtgacgtaacgataggcttcttcaagcgccatatcttcggtctttatcacgaatagactagcaataaacatgaaaatagaaataaccactgtgatgacggttatgactattgcaacgatggtaatgatgataatcagtttcaacaatatcggtactaaaataaacagcgcaatcaatagcccgattaaattcaaattgccgtccccatctcgtcctaccttatcaatcactaattcctttatctgtgaacgaaaacgatttttaggcgaaatatttcgttgtaatgaacggtctactttatgtttcatattcttgacgctatatgtgctcgctcgtccagattgtctcttatatttctggctcgtttgacccgtttgcttcgattgagcagagagagtcgaacgctgatattttcttttataagattgagtagaaaattgagttgatttagcttgtcgagtaacggtcgcttgcttttgttgtaaagaagctttttttgcttcactgacatatcccgtatacttcaattctttttgcaaaaactgcttttgatatttttgcttgcgagtaatgtcttgggttgtttgcttatctgaaatgacactatttcgatatgtctgctcattcggtttttcccgttgaatgatatgttgttggttcgtttggcgagcattttccaactttagctctttttttgattttaaaagtaattgtcttcttcgaaataacttttgctgtttcgcgatttttggattgtgcactgcgacaattcttttttcgagaagcatggcacgaaggcgttttttacgcgtattcgaagttatcagttttacttttttcccgttttttttcttcaaccgaatgtttttctttttctcactactcgttttgaagacttttgtttttgatgatttctcaccgtttctatttaaaacaatattttctgctttagacttggaagtggagctgcttcctttctcatcctctctttcgttatccagttcaatatctcctattggattttccgaatcagccactatcacatatcctttctgcttgtttttactttattatgtttctccaggcttggtcgacatcattttgtacagcttcgtatcttttggaaaatgatcgtaaaacgggagagtggtatccccaaataccattaatccatagccttctggagaattgactacgtatttctcttgttcttctgaaatatcgaataatcgaacgagctgtgtcctgtctgatttagcctgattgagcatcatgacgaagtcactgttagacaacattcttcgtgcaagatccgatagcagcaatgtctccacattctgagtaatccctgttggaatggccccccattttcttgcccgactccataattcaaaaaagtaattctctgaatattcattggtgaacaaaagttgcatctcatcgatatacagccatgttcgcacgcctcgttccctgttttccgtgatccgattccatacttggtctaaaacgatcaacatccccattgtcttcaattgtttcccaagatctttaatatcgtaaatgacaagccgcttcgtgatatccacgtttgttttggcagaaaacactgacaaacttccttcgatataaatctctagatccatgactaactgctttgcttcttcttcttcctgttcttttaatatgttataaaaatcaacaaaagtcggcatatcaccgctcattatttcatatgttctacgacagactcggtcgatcagcgttttttgagcagaactcaaacctagtgccccaccaataatcaaatcgaacaacgaaatcaagaattctgacttcaatactacagggtcggtatcgtccccatagttttcattgatatccatcgggttgatcgttgttgcagaatcactggatatcttgatgatctctccattgaaattctgaccgatgaccgaatactcccgttctggatcaataatgatgacttcatcctctgcatctcgtaacaagacattgactatctcccgtttgacagaaaaactttttccggagcccggtgtcccaagaacgaatccattgggggcttttaaaagttttctatctagtgaaagaatatttttagaaatagcattcactccataatattttccgttttcttggatcaaatcagatatggtgaatgggataaaaatcgctgtgctggctgttgatagcgtacgatctaacggtatcgaatttattcctagcgggagtgtggcatttagtccattctcctgcataaattctaattcaatgatcttgaatccaaaacgacgtcctactgcattcacttcgtcttgaatctccgccagctgttcagttgttcctgcccgaaaatgaatcgagcttgtcatcgcataaagcttttgacctctattttgcaaatcgtctaccaagccttttgcttctgttaatgaatacgaaaggtcataagaaagcatttcgtaatcatatccgttttgcaacgcctttttttgctcatcgactttttgttgctccatgaatgctagctttgttttcactaaatcaaaagcttcatcttgctctagaggatcaatatgaagagtaatcactaattctttcgggatttctaacagctcgtataagaacgtatctgctaattcagaaggatattcttgaagataaatcgtttttgcataatgcgtatctacctttagatagtttttgttttcttttatctcaatgacttctggcaatacatcttcgaccttttgcttctctcttttatcatctgtccctaaaatctctgagaggattgtcaataattctgttttttcgatgcgcttgatcttgcttcctaatcgactggcaaacattgcaaagcgatcagccaccatttctagttctttttctgcatgctctatttttgtatgtttttgtacaaaagtgaacaagatacatttgcggtacccatttttttcttcatctaattttctagagatgacttcattcatttctgaccggtagtcatctaaaaagtcacctttttcttgataataaagaactttttgcaaatctgctaaaggtcgtttctttttatagacggtcagctgtaatttcgtcttactacttaaggaattcaaaaaatcacaatactgagaaaaaatctcgatttgattgtcttcagacgataattggtaattgatgtcttctagttcgatggtagtagaataagtgatatcatcgatttgacaaataccgctaggaaagatttcttgaaatgcaaaagttgctctcaaaggatccgtctcttgtagatcttgtgatttctttcccttcttttgtgcctttggttcattgttcttcaattttttctttaattttcttgtttgagtgaatgacttcaacttcatcatgtttcttgtccgcctgtatctttatttgtttctacatttacggtttcagctacttttttctcttctttcattgataccccttgcttcttacggatgccaggagaaaaatgatatttgaaaaattgtttgatatacacttcgaaggtcaatccatttcgcttgaaccaaccaaatgaaacgattgggatcgacgaaaggatcatcagccagctggtgatttccatcgggatcttcagccatgcgatgaaaatcagactgatcacgatatttactccagcagcgatactcagacaaagtaactgctttaaagtcataccagcgattactttttctctgtattctttgatatctttcggtacttttacttcgacagccatagttcctccttatgatgcagagagcaatgtttttgcccatccttttgttttattgattgaaagcagtaaagcaagcatataaatggtcaatcccatgatgatcccccagattccgctaccgacttcttccatgatttttataaacaaaagcggatagataactaagaccaagccaataaatgttgcttgtagtcccgtggccgcaaaattcttgaaaaagcttttcgacattgctgaaaattcctggtttggaagtgcccccattgggattggtgccatagcacaaaaaatataaagttccaagaatcttagatagatcgttacttggatcaacactcgcacaacaagtgaaaccaaaaacatgatacacatgactaatagaataactagttgttcccaccatgagaggtcggcgactgctgaacttacccgatctgctacattattcagtacaccatcatttccaacctcaatcactctggcagtcaagttgctggtaataatgatgattccgtctaatatgtcttggattcttaaaattactatgtaacaaagcacgaatttaatcagtgctttcataatcatctcgaatccaagcataggggcaccacctgccccttctactttcattgagatcttctggaactccaaaagaacaaaaatagccaatattgataaggcaatcggtcctactacatgttgctgtagacgcataaccaaactgtatgcatcatacatataagactgcagatcctgactcaacatagcttgtaaatcttctccattcagataagcaataatctgattgaagagactcattatcgctgtgtgcatatgctaaactcctatcatcctcattgtattcagactcatggcaacaaagaactcatatcaaaggatgtagcaaaccagcctgcagccactagaattaatccaccaccaacgatttgccagataccctgctgcagctgaggtccatttttatcttttaaggcacctgctaaaataatcgtcccccaaatgagccacaaaccgcctccaactaaagtaaaacgtgaaactaatgtaaacacctgttgtaacaatcctgaatccataataattacagtctccttctctaattaatttttatttttaagcctaatttcagtatagcgaaaattctcccttactctctcacagttatttctaaattcagaaaattttggaacgtttcagaaaacatctttcttggtcatttacacataaagaaggagttccaaaagaacccctctttccattcgtgtagagctgccgttcctactcccataatcaaactgtttctctcaaggcttcctcgtcatagtcatcatcaggctcttcttgatactcgtcatacaagtcttcctcatcaatcatgtcatctgattcatctaatgtctcatcaaagtctgagagcaatagttcatctggttcgtaaggcaattcctcttgtccaggaagcaactgttcctcttgctcggaaaaatctcgcgtatacatatatttctctgtgacgtctccgagttttttataattcttgtgtttagtgatgtcatattttgaagataggaacggatgggctcctcgaattttcaagatacattcttgccctttcaaacttgcgacttcgtcaggatccatcaggtttctccctagtttttggaagctttcattgaacgaaccgtttgcccctttcgttacactgatatttcgttgttcgatcgtttctttacccaataatttagagatgtattcatgggtgctttgttccatccctcccaagtataagaaggtgtcactcgtaccgatgatcgtttcccatgtgttcttatacaatgttttcagctgactgatattttgcaagatcacactcgttgagatttcccggcttcgaacaacggaaatgactttttcaaaatcaggaatctggccaatgttggcaaactcatctagaatacaacgtacatggactggtagtcttcctttgtatacattgtcagctttgtaaacaagcatatcgaacaactgttggtacatcatactagctaaaaagttgaaacttgtgtctgtatccggtaacaagatatataaaatagttttctgatcaccgattgaatctaacgccaatgtatcttttgataccaactgtctgacacttggaatgtcgaatggcgctagacgtacacctaagctgactaaaatactttttgttgttttcccggctgataatttgaaaatcttgtattgtgcaacagcaaaattttgtgggtctttttgttctaattcttgaaataatatatctaacggactgacaaaattagggacatcttcctcgatatcagctaatcgaaccaattcgatcacacttcccaatgttcgatcttcttccacgacttcttggatcaagtaactgaaaatcgccatcaacaatgcagtctctgctttttcccagaatccatctccaccttttttatccggatcggttgtattcttgatcaagttgttgatgatttttaagatatcatcttcatttctgatatatttgaaaggattatagtagtcggttgctttccggttgatcaaatcaaaaatcttgatcttatatcccgcttcttcaaacatttttcctgtctccatcaacaataatcctttggagtcactgacaacataggaagaatgcatctgcatcaggttaggttttacaaagaaccgagttttaccacttccggctcctcccaccacgacgatgtttttattacggttgaagttgtctcttttagtgatcttcattcgaccagacaaagacagactttctgttttcgtcaataagatattgaaatctttctttttatcaataaatggacgaatatccccagcttttccccaacgtgcgcttccgtattcttcattgggtctagtatttttagtatcgaacgtcttatacaaaatgaataacacatagctaactcctgaaacgacacctactagaagcgacatttgttcaaattcgatatggggactgaatttcgcaatttctgcaaagctttgattgattgcttccataattcggtctgctagctcaaatgaagtaaattcctcacttaaaaacaaaaaagcgattcgattaccgaaatacaaaagtatactaaagactaaaaaatgaaaactaaaaaccatagaacgtgaatttttcacatgactctccttttcgttttttcttctgtttcatttatagaacactctgctccttttttggagttggttgactgttgcttctggtacgtgctgggctgtttctattgctatcatcttttccgttttgattacttgctctaacgactgcatcttgttttaactcttgaaattgacgtggccctgctactggtgaaacttgagaaggcgcatttcgattattttctgtcaatttttgatttataggaactactttgtttgattcctttccttgttcgagtgatactttcttatttggctctgcgtgaatctctgctttcacttgttggttatcttttgagtgtgcaaacaagttgtagtctatgggtccaagagaaccttgagaacttattgagcttcttttggcacctaaagcatcctgagaaactactgagcttgttcgagaactatctgacgagatgttttgttcttttgtttcttgcacttttgagtcttttgttttttcttgtacctctttaactttctcttctttttgattcgagaggtcaaatgaatgaagtgctttttctaatttttgatcaaagtttttctcttctcttttattcaaatgattttctacttttttcaatccaaatttgtcaatcagttgcgccccgatacccacagaagcccccatcaacgctacagttccaagagtaaatataccggccccaactagtccaggtgcaatgattggcatgaggaatacagaagccactgcaatcaacgtacttccgcctactatgatcgctagcgtcttccaattgttcttcaagaaatctttcgttttggctttccaatcttttttcgtggaaggttccagacttggttctgccgttttttctcctttaagcgtttctttgtctttttcatttgtcgttatatctattttctttgcttctttttctgtttctttgtctgcttcttttgttgcttctggctgctctttttcttttgtcagtcctttatttagttcttctttatctttctgagcttcgcgtcgattggctattttttttctcgcataattgattaatttagggacataataactggcacaaaagaaagaaaaagcagtaatcgcaactggtgccgcatagagactaaccgtcagagctggtaaaatcatcactgcccaactcacaaataaaggatatgccgccaaaggccatagatgcaacgctcggcggagccaacgcatttttttagaatgtgggaatagttctttttttaaatctttgatatccatgcttttgatcttttcgatatctgttttgatcttgtctgtatctgctttgatattttcaacagtagctgattgcccttttggcagttgaatcatttcgggcttccacgttttagggtcatctaactggattttcagtttcgcgagttcggcttcattttcttggatcttcttatctatcgcatttaattctggtaaatgtttcgcttttttaggaatgatactaaatatttctttttgtttttcgatcgtcacttggagtagttcttgtctagcttttaagttttcgccgattgctgtatgtaaagcatctttatttgatatatctggtgtaacttccttggctatttcaggtgtatcttgcgtctttttaccactatctggtacgtctgtcctgaactctccaggatcgctagcagctcttggacgaggtccattttcccgtttttggctaggattctcttgaatgataacgttcgggtcaataggatgaggtgctttctctgatttttgtgtttcttgtctctgccataatggatcacgtggcataggtggtggcactggaatactcggctgcaccttttcactatcagctcgatgcaaaggtacactttctttgactatttggctaggctgctcgttgggggtatcttcctttttcggtaattcttgtgaaaattcttttgtcttagtaggaacatcttgagaacgttcaatcttagctattgccgatatctgtgattcgatgactgctttttcttctattagtttttggagctgtacaattaccacattgttattcatttcccaactttttcttcgctctttatcctcaggtgctggaggcaaagtggattcaatttttgtgatttcttgtttttttttttctaaatctctagacaaatgtttttttaactgggtagcttctattcttagtttttctactctttccctagctttattagaaggctcatttatttgatcaagacgatatttgttttctgccacatttattctagataagatcagcatttcattttgatagctatcggtgttaagagctggtttctcaggagctccataagtaacagattctctttgttgttcaagtttatttttatgttcagtgactttctggaccttttcctctaaaaattttttttcctgctccatctcccctaaaggttgtttctttatgttattgatcacaatttgaagttgcttttcctccgaaagataactatatagcttctgttcatcagttaacgtttttattttcccctcaattgcttctgaaacagattcgttcaacttatccatattgatttcaatgttcgggtcgcgtgggtttacgaagggagatggttcttttgtaaatcgttcatctgccaagttgtattccagaagttcaaataacttttgattgattggtgtaagcatcttttttacttcctctcagatttttactctatatacagttgcggttaacgacaaattgcttgttccttgggtaaaatcggttcgttttttgactcatttgtcttgtctgcatccttgaaagcatctgatatccgattggcaatagtcccatattgtctattgttttcccttgatgatgtagatgaaatatttgaaagattgctctctcttttgttggctttgcattctttgtaacacttgtatcctgcgactggtaataaaacaagggttcttgccacgtaatacaatgctttgaacattgaggccaatattctgaacgtaaaggataaaatgcaaaataaaccgattaactctttcattttcgttcctccagtgtttttatttttatcttaacgctgaaaattgtctataccacgcctactttttccgaaataataatttattggcaactcttttctcaagtagaatgaagaaatgtttccaagttatgccagaaagcatccgtcggtactttagaaattttcagaatggcagaagatatgcgattcaaattcaaattcacatcggtcaatactaggtcatattggttgatcagtgtatagtctaaagaaaaaacatctttttcataaatatcgatttttttaaaagaagggtacttattcaaaatcaagttcttatataaaataggcagtcccatttcttgtgaacttaataacagaatagaccgttcttttaattttggctccacttgatgcagtaattcattcgaagagacaatcagctccaacagtaattcttttaacaaaagttcatttttccgtacagaggacaagttagagataatcaatgcactttgataagcttcccatatctggacttttttctttaggattttcttataaaagatatctgcatagctgactttgaaaaaagtcaattctttataaaaggtaataaaactggtaaaatgcaaaaccttttcaggtgtgaccgtttcattgatattggaaagataatagaaatgtttaagaaacaattctactcttctgagcatatactcatccgtttcagctggattggtaaaaagcagactgagatatggactcaaaatattttctatattttctctactgatcacaaatttataattttgattaataagtgtgcagaagacagtatcactcttgatcgtttccataattgaatcaacgacagctggtcgatctgccagttcctctttaggaatcagatggtcgttcccgattcgaatgatcgaagtaaaaatataatagactgtataaatgattttagaagagctagcatcccgtccttgcttgatcaaacagcgtttcaacattttataaatcatttcaaaataaggaagatctttttctttgcagatttctttgaacatacttgagaaaaatttgcgaatatagatttcatcaccgatgatttgaagtctggtggttaagatgatttgtatatctaatctttcttttgaaaagtacgtatttattttggtaatgattctcctgacacttgtcttactcaaaaataatttagctgaaatctcagttagtgatggttctgaaatcagaatgtattttaagacttctatatagatagaattatttaggatcttgataaaaatatcatctaaattgaggttactgggtattttcaacgttacttctttatactgattgacctcgatgtacgcaggaaaacaagaagaattaaaattatcaatatctgcaataattgttttatccgttacttttagctcttccgcaaggtcgttgatctcagccatatccatgcttaacaagcagatcagcatgatttgtctctctagttgcttttctaaaaatcctaccatttttttcttccccttttctcgtttgctattaaatctatcctacagttatttacgctagaatttagtattttttttttctattttggaaaacctgtttcttaaaaactgtttttatatgttataattattatttttggataaacagtataaataactatatctaatggaatatatatcaaaaaaaataaaagaaaatgatcttttattttcggaaacaaaaaatcgaatgaagagcaactcccttgaaatatcatttacaaccctcgaagatataaataaaaaaacaattttatataaaataattaaaagtatagttggtttaattttcattcagtagttatatttgctattttaaataacaataatctaaagaacataagcatgatatttctatctaagctttttatttatgttttatttttttaatgtaaatatagagagtacaataaggatttataaatacataattaaaaataacaaaaatacaaaatatcaaactatttattttatagttattacgttattttaattaacaaaaatatgaggtcaaagcattctgtttttgctgtttattctgcctgttgcttaaaattgttgaacaaacatacaaatgaatcaattttctctataacgtgggataatgattaagagcgactgaaaagaaaggaagtgaaggagcgttttatctattatttcttaaaaacgcagttggaaatatgacagaagatataactatgcttgaaaaattatcagaaagacagttaagattagccatgcttttgagtatggattcattttatttagaagacttagagaagaaaattgctgtaacaaaaaaaacactcttatctgatattgccgcatttaattttgttcattctccggcatctattcatatcgacgagcatcagaaagtttctttgagattaccttgtgaatataatttagaaagcatcacgagtactatcttaaaacattcaagctatatacaagtgttgaaaatcattttgatgcaagaaccttgtattgctaaactagctgatcagttatttatgagtacagcaagtattcgcagaatcattatgtttctgaatgaatcctttcaaaagcgaggatttctttttagaatccacactactccatatgtacatattcaaggtgaggagagacaaatacgttttttctactgcagtttattcgaggagatctatacaccggatcaacttcctcattaccaaatattgtctgcagctatcaaacgatacatgaaactttatcctccattaaacaaactatctgtccacaaacagctgtttttgatttattattttttgatttctattatccagctcggaaagaaacatagattatccgatcagttgaaaagccaacctctcgaaatggatattgatttattttttgagcgaacgaaaaataacgttacattttgctccgttatggagaaaaattatcatttctatttaactaaagaaacagctagtgaacttttgcgtccaatcagccagatgatccattttgcttctgtaaaggcgccagctcatgaaatcaaaaaattaagaaatttgtcacaaaatttctatcgttctttatctactgatacgatgttatctgatcagcaattaaattacttgtatcatttgatttctttcaagaaggagtttttaccttttctaaccaattcctttaaacaattctttgtgatcgtcttgaattcggatccactcattctttctttttatgaacaagcattagtggaagaaaattattcgtttattctaaccaatcgtctattatatgaagaattgctggaagaactggttttgctgtctccagctcttattgatcgaatcattccaaaaaaaaagacatatacagtcatgatcctttcttctcaagaaccgaaagtttgtttcttatataaggaattgttaactaaaaaatttcctgagataaaagaaataaaagaatatcaggatagcttttttgatttgaactatcggttgatcaatcaatatgatttggttttgactgactttcctttagataggaatcagctgaatacgaagataatcaaaatatccaacttccctgcttattcgttttgggaaaatatcgaagccatcttacataaacaatgaaaaaataaaaagcccgaaaatcagtatacagattttcgggttttacattggtttattcaataaaaagctactagaactgctagtattaaattatcgcatcgttacgaattcttccgctcctgttggatggatggctactgtattatcaaagtcttctttagttgcccccatcttgatagccacagcaaaaccttgtagcatttcatcgacacctacaccaatggcatgcaagccgacaattttttcttcttttccgacgcaaatcaatttcatttcgcatttttggcgatattcattcaaagcaaagtacattggagtaaagcgtgaacgataaactttcaggtcattttctccgtatttttccaatgcttcttcttctgtcaatccaatcgttgcaattggtggatgcgtaaagacgactgtcggaacaagattatagtcaagataagaatctttcttcccattaaacaaacgttccgacaaacgtcggccagctgcgattgcaacaggagtcaaatctaatttaccgatcacatcaccaaccgcaaaaatatgttcatccgttgtgttctggtatttatctactttaataaatcctttttcgtccaattcgacatttgtattttccaaacctaaattttcagtattcggcacacgcccgcctgcaaaaaggacacaatcaccagttaaggtttcgccattttcaaataacaccgtgtattcgtcattgtttttagtgatttctttagccatatgatgtgcgtaagtcttgatcccagcttcttggtacatttggatcagattgtccgaaagcattttatcaaacgttctaagtggacgttcttttcggtatgcccacatgacttcactacctaaaccacgaaatacacctgaaagttcagctgcgatgtatccagcacctaaaacgattgctctcttaggtaattcccttaattcaaaaaatccatttgaatcaatggcgtactcaccaccaggaatgcccattttgcttgcacggcctccagtcgcaatcaaagttttaggcgcatgataagtttcaccgtttacttcaatcgtttgactatcgataaaagtagcatatccttttatagcctcgacatgattgctatctaatcctctttggtaagcaccgtgtagaaaatcaatatatttttctcgtctttctactagaccagcgaaatcaacactttttaaatctgcttggatgccgtaacttggagcatcgcgttcaattgtttccaaaatcgtacttgcttgccacatgacttttttaggtacacaaccgacattgacacaggttccgcctaattcatttgcctcaatcagcaaaacttttgcgccatgcatccctgctctgtttgctgaagcaataccgccagagccgccaccaattacgatgtaatcatatatttgcattttgttcctccttattgaagagatcaatcaaaacctttatttaacgatcctttttctacagaaaacaagtgtaacacttttcttagattttgtatgcgaagatgcttgaaacaaagatgtatcagctttttctttatttgcgtttccggatcatatctccaggtttcactggttgtgcaactggcatggccaaaaccatcattggatttggtgctcggtcaatggattccccttcttcattatgcatgatttcgactgtttgactgaaatgactgaatcctggaccataaaattcgatttcatcccctacagagaataagtttctctgacgtatcgtagcaatctgtgttgcctcatcataagataatacttcaccgacaaatttatatactgggattttacgacgttcaccaaataattgctcgttttcagttggtgtattgtaataaaagcctgtagctaactctcgttgtgccactttccataactcgtcgatccattcttgtttgcagacatagttttcaggatcttccatatagctgtctacagctgctttatagacatttgacactgtagatacataatggatcgatttcattcttccttcgatcttgaagctgtctacgccgttttcaatcaattctggaatatgctcgatcatggacatatcaactgcactcatcgagaattcttcttcaatttctcctgtatcagtcaaactatttcgttcttgaccaaaaggcatatcgaacaatccatatttccagcgacaagattgagagcatccgccacgattcgcatcccgcattgacatatggttggacaatgtgcagcgaccagaataagaaatacacatggctccatgaatgaatgcttcgatttcgatatccgtatttttacggatttctgccacttcctccattgaaacttcacgagctaaaacgacacgttccaacccttcctctttccagaattccaatgtctcaaaattggttgctgaagcttgagtagataaatggatcggcagacctggagcttctgtcgcgcaaatttcgatcaaagctggatcagaaacgatcactgcagaaataccgacatcgcgcagactacggaaaaattccccagcgccttcttcatttccttcatgggtgaccatattagcagcaacgtacacttttgcatcgtgttcttttgcaaaagcaaccccttcagccatttcttcataagtaaaattacctgcacggcttcttaaaccatacgcatttccgccaatatatactgcatctgctccataatggatcgctgtttttaacttttccagtgttcctgctggcgctaagatttctggacgttttaattttctttttactgtcatttcattcatcatactccttatttgatagcagaaggatcaatataaaagaatcctgtatctaattcccggttttcaggatgcaatttgttgatttcgctcgtcaatttttctgctttttcttgattccagctaccttctaaaatttgtttttttgcttcggcgaatagttgagtgatagtcacgaaattttcgcctggagtaaataacccgtccaatttccatgtacggtaatgatgctgataaagttcattcaattcattcgagagatttagatcattactggcaaaaatatgtgtgccatgactatcttcataaatagaataatgtgtctcttctttttttggttccgagataaaaagacctctttcacgatctttttgttcgtcttgcttcgtatagttatagtaattctgtagcagtggacgtttggattgatggatgcatgtagcaccatacacaaggatttctacaggaatgtcgagtttttcttccatcgccttcatctcttcaaaaggaacttcacgagcaagtactgcgccaactgcgccttttttcgcccagaaattgatttgacgtgcactcgttactaatgtttcagcatcataaatatacggtatacgcaattcaggattctttttcatcgtataaatgatacctgtatcaccaactgtgatcacatctacgtttatttcttttaaaaaagccaaatattcaggtatatttttcattttttcaggatgaatgatcccatttacagcaatatttgcttttttaccatgcttgtgtgctaattctactaattgtcgctgttcttctcgtgtgaacgaagcaggcagacgcaatccaaattgctcttcaccgaaatatagtgtgtctgcacctgcagcaagcaactgttctgcttgtttgatagtctctactgtggttatgagttcgatcataatttcctcctcctacaacttcataatagtagcatagctctaaaaactttccaatacttcttctatttaaagtcggatttttgaaaattatttcacaaaaagtcaaaataaagttcgatatattctgtccaaatataaaaagagattgtgacaaaaatcttgtcacaacctcttaatcaagtcttactattataaaaattcagctaacacagaccgagtacctatagggaacctactgtttcctttttaggcccgcgaacattcaatgtgatctttccttttgatgcacctactgttacgtggtcacctaagcgaatctctccgccaagcaatgcctcgctcaatcgatcttcaatttctttttgaagtgcgcgacggattggacgtgcaccatattcaggatcaaatccggctttcccaatcacatcgattgcagatggggtgattttcacttgaatatcttgttctttcaatcgcttgataatcgctttactcatgatttggacgattgtatggatttcatctttactcaatgaatggaagacgacagtctcatcaattcgattcaagaattcaggtcggaaagctttctttaactcttctaagatacgtttttgcatggctttgtgatccttcgtgacatcttggacattaaatccgacatttttttcttctcgaatttgtgtcgctccgatatttgaagtcataatcatgatcgtatttctaaagtccacttttctacctttagaatctgttaaatgaccatcatccaatacttgcagaagtaaattgaaaacatctggatgtgctttctccacttcatctaagagaatcactgaatatggtttttgacgaattttttctgtcaactgtccaccttcatcataccctacgtatcctggaggagatccgattaatcggcttgtactgtatttttccataaattctgacatatcaacacggatcagggcatcttcgcttccgaacatgacttctgaaagtgctttggccaactctgtttttccgacaccagttggtccaaggaacataaatgatccaattggacggtcaggatctttcaagccgcttcgtgcacgacgaatggcgcgtgaaactgctttgacagcctcatcttgaccaaccacccgttcatgcaggagaccttccaattctaacaaacgttcactttcttttttctccaactgctgtagagggacaccagtccactccgatacaactgtagcaacatcttcttccgttacacgatcagaatatccttgttcttgttttgcttcgattgcagaaactttttgtagctttttacgtagtgctttttcttgtctacgtaattgcgcagcattttcaaagtcttgtttttggatcgctgcttctttttcttgtactaattcatcaatttctaatttgattacagttgattttgttaagtgatcggtttgatccaaacggactttcgccgctgattcatcaatcaaatcaatagctttatcaggtagttgacgagaagtgatataacgaacagaaagattaactgctgcccgcacagcttcatctgtaatctctaccccgtggtgctcttcatatcttgaacgcaatccttgaagaatctcttccgcttcttcaggagttggttcatctacttgaattcgtgcaaaacgccgttctaatgcagaatctttttcgatatatttttgatattcatctagagtcgttgctccaatcgtttgtaattctcctcgagctaacgccggtttcaagatattcgaagcatcaattgctccttctgcgccacctgcaccaattaaggtatgcaattcatcaatgaacaagattacttgaccatcattatagatttcgtcaatgacttttttcattcgatcttcaaattcaccgcggtatttcgtaccagcaaccaaagatcccatatcaagcatcatcaggcgcttttcttgcatgtcttctggtacttcacctaaaatgattttttgagctaacccttcagcaatggctgttttacctacgccaggttcacccaccaatacagggttgttctttgtccgtcggctaagaatctggataagccgtttcacttctctagaacgtccaacaactgggtccaacttgttttcttttgctaatttcgttaaatcacgtgctaatgaatctagtgtaggcgtgccttgtggtgtttgccgtttatcttgtatatttctacgacgattcattccctttccacccgaatcaccagctagtcccattttttgtttcagaacttgtcgggcttttgaaaggctgatacctaagttgatcataattcgagtagccatgatactttcatcttttaataagctcatcaaaatatgttctgttccaactttttgagaacccgttttctttacttcgctactagctaaagcaaaaacttgtttcattcttggagaatatggaagaaagactcctttagggtaagaacggataccgccataaccaatcagatgttcaatttcttcataaatttctgtctcattcaaatccatttcacgtaatacttttccagcaattccattttgttcaactactaacgctagtaaaacatgctctgaactaactgattgatgtttcaatcgttttgcttcttcttgtgcaatttctaataccgcttgggctctttcagtaaaaagttcttccatctaatctcacttcccatcttcataacttaaacgttccagaaatgctcggagaatccgagcacgtgtatgatcttcaaattcattgaaattcaatgtgttttttgcaattgcacttaacatcaagtttccttctttttttgtaattatttggtcttcataaagtttttgaataatagcaaaagcatttttctcactgattgtatcatcaaacaactgatttatctgctcaagtaactgttttttatctgatattcttactttcgcaattcgtatatagccgccacccccgcgtttgctctctactaaataaccgcgttggatggtaaaacgggtattaatcacatagttgatttgtgaaggaacacagttaaagaggtctgccatttcaatccttcgaatctcgatcatttcactattttccagaattttctttatatatgattcaattaaatccgaggtattctgatgtgccatcttattcattccctttgactaatattgaccttaattataacgaatttggtaatagaaagaaagaagaacgctttttgttaaataaatcctttagaatcaacaaaaaaaaatacggaatatgctattccgtatcgacgcgcccaagaggagtcgaacccctaaccttttgatccgtagtcaaacactctatccagttgagctatgggcgcatattcaatttaaaaaaattataaatcatttgaaaacaaaaagcaagataaaaaaaatcgggaagacaggattcgaacctgcgaccccttggtcccaaaccaagtgctctaccaagctgagctacttcccgtttaaaaaataaaaaagactaaataaaaaaagatgaactagaaatagttcatctttttttatttttattaagttaaagaacggattcaattgcagtggtcattttcaatggagaagtttgtggtgcaaatcgttcaattacttttccatttcgatcaatcaaaaatttagtgaaattccattttatggctttagtgacagtaccaggagcttcatttttaagataagtaaaaagaggatctgtattttctccatttacatcaatcaattgatgcatagggaaggtaacgccataagtggctttacaagcttctgctgcttcagtcgctgaagctagttcttgtttaaattgattcgaaggaaagcctaatataaccaaaccttgtgactgataagcttgataaagttcttctaattgctcgaattgcggtgctaggccgcattttgttgcagtattgacgatgattattggtttgccggcgtatttttccaatgaataaactgtgccgtcttctaaagcaacttcaaaattatagatagacataaatttttctcctttctattatatgataaaaagagtgctaaactgaaaactagctatttgttttctcgtttagtactcttttcagacaataaatagttaataaaacgactacgaagataagatagctttattgcttctcacctttacgttcttttagaaactatgcttctacttcagaccattcatcgcgttttgctaaaaattcacgagctaaggcttgcgcaccttctaatgtatggctagcagcccagccgcattgtgtttcattgcttgctggtacttcagtagcttcaaggacatctttcatcgttgcttccagaacatctaaaatatcttcgtaactttcatgattcaacacagtcaagtaaaagcctgtttggcatcccattggtgaccagtctacgatataatccgcatgattacggattagttcagcagtcaagtgttccaatgaatgcagacttggcatatccatgtgttctttatttggttgtttaaagcggacgtcgtatttaatgatgacatcgccatgtgcacctgtttttcgatcggctacacgtacataaggtgctttgacttttgtatggtcaagattaaaactttcgacattcattctcatttgtaagactcctatctatttgttcatttgttttgatgttttccactaaagaattatttagtgaaatttacaaaaacgtctttctacttgattctaacacttatcgtttccaaggtgtagcaatctgaaatattttttagatttttctgctaaaccatttatgtggactttctagttcttgattgtgtcaaatgcctgagctaaatcgtttatgagatcctgaccatactcaattcctacagaaagacgaattaatccgtcctttatgccagcctcttcacgtttttcttttggaatagacgcatgagtcatgacagagggaacttctactaaactttctacgccacctaaactttctgctagagtaaatagttggagagattcaataaaaggaatagcagttgcttcattttttaaagtaaaagaaaccattccgctaaagccgctcatttgttgcttagcaattccataaagttcatggtcgggtaatcctggatagtagaccttttctactgctggatgagaaaagagaaaatcagctactgcaaaagcatttttttgatgttcctccatacgaacacttagagtcttgattccacgctgaagtaaccagctatcttgaggaccaagaacggcaccgatagcattttgataaaatccaatctgctcagccagctctttatgtctagtagtcactaaaccagctactacatcgctgtgtccgcctagatatttggtgccgctgtggacaacgatatcagaaccaagatctaatggtttttgaaaataaggagtagcaaatgtattgtcagcaataactatcaatccatgtcgatgagccagagtggcacttttttctaaatcagtaatctttagaagcggattgctaggtgtttcaagataaagtgcttttgtattggggtggatggattgttctattttatcaagattgctcgtatctatgatcgtgtactcgagaccatttttagtaagaaccttgtcaaatagacggaatgttcccccatagacatcatctcctaataagatatgatcgccagcttcaaaaagagaaaaaacggcatgaatcccagaaagtccagaagaaaaagcgaatcctcgaacacccccttccaaatcagcaatcagttcttccagtgcaaaacgagtaggattaccagatcttgaatattcatattgcttaggatgtccgactccatcttgtcgataagtggatgtttgataaataggtacactgacagctcctgttgtgggatcttcactgatgcctccgtggatcaattttgtttgaatatgcatgtttctttcctcctataagtaaatgttttttgataaatagcggtctgctgcgtctggaaaaatcgtaacgacacgatgaccaggtggtaaacgacgaatttctcttaatgctgctgcaaaagccgcaccactcgaacttccaactaatagtccttgttctcgtgctaattgcctagtatagttaaacccttctccatcagagattgtttcgatctgattgattgaaaggggagaaagaaacggcggaatgaattctacaccgataccctcaatttcatgaggggctggatctccgccatttaacacagagccctctggttctacaccgattattcgaatatcgggatatttttctttcaaaaaggtagaagttccagcaaaggttccaccgctaccgatccccgccacaaaactatgaatatcttctttgatttcatgaaagatttccggtcctaacgtataatagtaagcagcgggattatctttattttcaaattgaagaggcagatagctattcgatatctcttctgcaagttttttacttttgctgatggcaccgacgattcctttctcactaggagaatggatgatctttgctcccaatgctttcatcaattgttgtttttccaagctgaacttctctggaacaacaaaaatcgttcttaactgatgcgtgagtgcggccagagcaatcccaatccctgtgtttccggcagtcggttcgatgatcgtcgttttttcattgatttttccttgggcaagtccttctttgatcaaataactacccaatcgatctttgatacttcctcctggatttaaatattccagttttgcataaatagcagaacctttaggcatagaatagtgctgattgtcaaagcgataaagcggtgtggaaccaatagcttctgtaattgtcgagataatcatatggacctcctaaaaaagataataaaaaaaggagctgactattaaatcagctccttgaaagacatagagaaaaattgagtagacaaaaggtaaattacctggtactcattctatgaagggcaattaatagacatgacaaatagtatgctgcttttacgcaccatacaacagcaacgattcaattgtttttggttgctgactgtcatgtgtatccctccaattaaaatttttattaacgatagcatgaaaaaaaataaaagtcaaaggcttgaaagaaaaaaatttcgatagtatcgtttaaccgtgtttatttttttttgacaaataggcatgaaaccttaaaagatagagaatactctagttttctgtccggttgtctgatacaataaagttgattatgataaagaaaagaaggagcaaaaataatgatctcagcaagtgatttaagagccggtatgacgttcgttcaagacggtaaattgattaaagttctggatgcaagccaccataaacctggtaaaggaaatacagttatgcgtatgaaactgaaagatgtccgttcaggcgcaacatacgacacaactttcagaccagaagaaaaatttgaaaaagcacatatcgacacaaaacctgtgcaatatttgtacacgatggacgatacagctttcttcatggatttggaaacatatgaacaatatgaaattcctgtagaaacagtagaagaagaaatgaaatatatcctagaaaacatggaagtaaaaatccaattcttcggtagcgaagttattggtgttcaattaccgacaactgtcgtgttgcgtgtcgtggaaacacaaccttcaatcaaaggtgcaacagttactggttcaggtaaaccagcgacaatggaaactggcttagtggtcaatgttcctgacttcatcgaaacagatgaattattggaaatcaatacagcagaaggttcttatgtaaaacgtgcgtcaaaataataagctaacgaattgataagaagttgaaaaacatagtttgacctcttgaaaagtggatcatccgatctgcctttcaagaggttttttgtagaatcagccgattgaaaaataaaaaagtatttgttttatttacactttgaaatacaatttaattgaaagacgtgatctgtcgaatattttgaaagagaggaatctttatgggattcatcctattactgtttttttatcttttgatttttttgttatgggtaataattgtaacgcttgcattcccagaagtagctttgtacataattgttgttttgttttcgatgttccttccgaatgaaataggtgggcgatatattgaattattagaattttttcagcctatcatccattattttcaacgatttacagaagcgcatctatctgtaaaattatttattcttttaagcattccactgagttacctgctgttgtctagtctattacaattttatggtatttatccattgcagatcataggatcatgtatgacgatagttactgttttttatttattaaatgttatttttcaattagctttgatttggaatattttgctgacagttccgatctctctcgtagcaattggtatccgtttagttgtttatcattctttgaataagtattttcgtaagtgtacgtatttattcacttttttactcaaagaaaaaaatgaaaagaaagatacttctgagcatacgcaacaatcatctaatcaaaataagaacaacaaaaaaacttctttagtaatcaacgagccttttgaactggaagcttattttaggctaatcttaggtgtagatgaacaggcaacaaaagaagagatcaaacatgcctatcgacaaaaagtcatgaagtatcatccagataaatccgtagaagaaaatgcgaaagaaaagtacgaagagattatcgaagcctataaatatttgaaatagtttcaaattgccatgtttccttttattttcctactgcttgtataatcaagatagcgttttctttctctttatattaaaataatattataattaaattagtttaaaaagagaaaacggaggctggataatggagaagcatacgacgaaagagacacagaaagaaaataacaacgtaaaaaaacaattaaactttgcggataatcatgaatttatgttagctagccagaattgtgttgctccctttaaccatttagagattattcaagaaggaaaagttatatggagccagaaagcttatgcatttttagaagaggaatgtccaaactgtgcgaatccaagtctttgggaaaatgcgcgatgtaaccatcaaacgggtctctttcgtgtcactgagcaaatctttcagttacggggatttgatatggccaacctcacactggttcttaccccaaacaataaatggattgtctttgatacattgatgagtatcgaatgttcaagagcagcgattgagtttgcggatcgctggtttaatgaaaacgggtatccagaagtggaggggaatcttgcaggaatcattatcagtcattcccatgtcgatcattttggtggcatacgcggtttgtttaaagacttcaaagtagatccttctgttccgatttatgtacctgaaggatttacggaagctgctatttttgagaaccttatggtagggaaggccatgggaagaagagcagtctttcaatatggctcttccttagaaaaaagtccatttggttccttatctgttgggattggacaaggacaatctacaggcacaatcagttttgagcttcctacttgtgagatcactgaaaataaaataatcgctatcgatggattagatctggatttccaattgacccctggcacagaagcccctgccgaaatgaatacgtatattccagcatatcaagcgctttggatggcagaaaactgcacttgtacgatgcataatctttatactctgcgaggggcacagatacgagatggaaaaagctggtcgagataccttatcgaggcacaacggcgctatggaccaaaagcaaaagtattgttccatgcgcatacttggccgcggtatgccactgaggaggaaccagatgctattaacaggtatttactagaccaagcacggttatataaaggaattcatgatgaatcacttaaagctgtcaatgccgggtataccataaacgaattagcagaacaagtcgctttgccagaagagctgacaaaccagtggtatctaagaccatattacggaacgattgctcataatagcaaggcggtttatcaaaagtatatcggttggtatgattcaaatccggtgaatttgaatccgcttcctcctgaacgggaagcgaaacaaacggtaaagtacatgggtggagcagaagctatcttagaaaaatcgcatgaagattatgaaaaaggaaattatcaatgggtggcaaaagttacgaatttggtcatttacgcagatcctgaaaataaagaagcaagagcgctttgccggcggtcgttgacacaactagggtatcaaacggaatctggggcttggcgaaatgagtacttgactggagcactggaattaaaggaagatgtggacttgttttcaattgaatcggctgattcgtcagagctatcggcacagatgaatggagaaatgttgctggattatttaagcatccatactatttcgaccaaaaaacaacagacgggcatggtaaagttcacagatgactggcaactttcaaatggtcaaatccattcattgccaacgacttatttcatcgattactggcaaggaattttgacttattatcctatttcttcagacaaagaggaggccgcgcttatttatgaaggaaaaagagtagcattcctccagcaaatgcttgattcctcaggtgaaccacgaagctggtccatgctttttaaagcagatacaaacaactatttcaatatcatggaaccgtgaaaatagttgaaataactcaaaaatttaagatgtccgaacgatatggaagaaagaagggtttatcatcgctaaacagcgataaacctctgctaatacgcaggaatattcttctaatagttcggatattttattttttgtccccttttttatttttgttttaaaaaaatgtttcgaaatatactagacaattcagaaaattttgtataatattattccaataaaattcaaatctttatcaaatgaaattccaataaaaacggaaaaaatgtgaaaagaggaatgaaaaaatgacagaattgataattggcggagtcacagcaagcacattagcagaaaagtataagacacctctgtatgtgtatgacgaagaaaagatgagacaaacgatgctgtcattcaagcgaggctttgtatcgaagcattttgatacaaaagttctttacgcctctaaagcattccaaacgattgagatgctacgtttagtccatgaatatggatttgggctggatgttgtcagcggtggggaaatctataccgctttgcaagctgattttcctagagatgctatttatttccatggtaataacaagaccccagaagaactgagctatgcacttgaaaatgagttgttgcatgttgttgccgataacttgatggaagtcgagttattagaagaattaagccaacgctattctaaaaaagtcgatgtcatgcttcggttgaatgtcggtgtagaagcccatactcatgaatatatagtcactgcacatattgattcaaaattcggcatgagctatgaaagtaaagagtgtcagcaagctctccaattgataaaagaaagcagttatctagagttagaaggttttcatgcccatattgggtcacaaatttttgatgttactgcttggctagctgaaatcgacaaattgacgagttacttaatcgattttgaccaaccactttccttgaatctcgggggaggattcgggattcgttatacacaaaatgatcagccaatcccaatcgaagaggcactaaaaaagctgattgaatatacggaagaatctttggacaaacgaaaactgacgattcgtcaactactgatcgaaccaggaagaagtattgttggggaagctggtacaacactatacacgattggcttcatcaaaaagacaccacataaaaaatattactttgtagatggcgggatgacagataatatccgcccagctctgtatcaggcagcatacgattgtgatttagcagaaaaactgtcggaagaaaaaacagaaaaagtgacgattgcagggaaaatgtgtgaatcaggtgatgtggtaatcaaagaaacttatttgccgaaagcaaaatcgggtgatcttttagctgtttattccacgggggcttacggatattcgatgagcagcaactacaatcgagcgacacgaccagcagttgtttttgtcaataatggtcaatcgagactggttgttcgcagacaagtattttctgatctactaaggggggaagtttcttatgatccttcataaatataatggctgtggaaatgattttatcttattagattacacagaggatacggattatagtcaattagctgcttctttatgtgcaaaagaaaaatatgacacagacggattgatcgccgtaaaaaccgatccgttggaaatgatctattacaacaaagatggtagccgtgcccctatgtgcggaaatggtattcgctgttttgctcgatatgtgaatgatcaaaataggatggatgaacaggaattcgacgtagagacgttagcaggcacaagaaaaattacggtgttggctccctcacctttttattgcagcgtagatatgggagtgccagatgattctccagaaaaaatcaaagctgcgcaatcttatccaataaaaaaccaggaaatagagattggtggcgaaaaagtaacgatcactagtttatttttagggacgatccataccgttgtttttgttgaaaatgcgcgtgaggaagtctggaaaaaaagaggcgaactgatctgtcatcatcctttattcaaagaaaaaaccaatgtcaactttgtagaagtagtcaatgaacaagaattgaccgtccgtacctatgaaagaggagtagggtggacacttgcttgcggtacaggttgctgtgcctcttatgcggttgcgaaggaaactgggaagatttcagcagatcaggtagtcgttcacttggaacaaggagacttgatgatctctggtgaggatacgatacaaatggctggtccagcagttcatgaatggacaagaatattggaggaatgaagatgataaaaggttcgatcgtggcgctgatcacgccgatgaatgaagagggatcagtagattatgctggtttggaaaaattgatccaattccatttagatgaacaaacagacggattattagttttgggtacaacaggagaatcttctacactcacacaatctgaggaggagaagatccttcaactgacagtaaagaaagtggctggccgtgtgccggtgattgcaggagctggaacgaataatacgaaagaaacgattgaaaaagcgaagcattttgcttctttgggcgcagatgcacttttggtcatcactccttactacaacaaaacaagtgatgcaggattagctgctcatttcacagcaattgcagaatcatcaccaatcccgcttattttatataatgtcccttctagaacaggcatgtcgattccaatccatgtactagtaaatttagcagaacatcctaatatcattggtttgaaagaagcctcaggagatatggcttatgtgatggaagccgctcgattgattagcgaaaaattcagtctttacagcggaaatgatgatttgatcctgccagtaatgagtgtaggagggagcggtgtaatcagtgtatgggcaaatatccagcctaaaatagtccatgagttagtaaaagatacgatggacggaagatggcagcaagcaaaagaaaaacaattaaatgcacttgagctgatccatgccttgttcagtgagaccaatcctattcctgtcaaagcagctatgtcgttattaaatttaccttcaggacctctacgcctgcctttagtgtccctttcggaagagaaaaagaaacaattagctcagcttttgctaagggaaaggacggttgaaaaatgaaaatcggactgattggcagtggacagatggggaatagagtcgaagaagttgcacaagaaagaggagacacggtccttcttttacggacggcatctaaagaagcaactacacttgcttttacggaactgccagaactgcttattgatttttctcatccagataatttagagatgatcctttcgtatagcttgtcttatcaacttccgttagtcattggcacgacaggttatacacaatcacagttccaagaaatggaagaacatgccaagcaggtacctgtgatgtatagtgctaatttttcgttaggcatcatggtgatgaaccaactgatcaagcaagcagctgcaatgttgcaaggctggcagatcgaactgattgaaaaacatcatagtcgtaaaaaagatgcaccatctggtaccgcgaatatgctgcttcaaacaatccaagaagtacaaaagcttcagcctgtatataactggcaaggacaaaaaagagaagaaaatcaaattggtgtacacagtattcgtgcaggttctttacctggtgaacatgaggtaatgtttgcagctcccgatgaagtatttacgatcaaacatgaatctttttctaatcgaatctttgctgcaggggcagtagaagcagcggactggttgaaaaatcagccaccaggttattacaaattagaagatttattaatggataaaggggtgtaagaaacgtggaagctcaagaaatcatccgctacattcaaacggcatctaaaaagacgcctgtgaaagtctatctgaatgtaaccgagccaatcaaatttaaagacagcaaagtttttggtgaaggaaacagcttcgttgtttttggtgactacgagtcgattgctccggttttagaagctgaagcggaaaaaatcattgaaatcgaaatcgaaactgctgcaagatacagtgcagttcctttgttggatatcaaaaaaatcaatgcccgtatcgaaccaggtgctattatcagagatcaagtgtccatcggcaacaatgccgtgatcatgatgggagcgattatcaatatcggtgcagtaatcggtgaaaacacgatgattgatatgggtgctgtcttaggtggacgagcgacagtgggcaaaaactgccatattggtgcaggagctgtcttagcgggtgtaatcgaacccgcctcggctaaaccggttatcgtagaagacggcgtactgataggtgcgaatgcagtgattgttgaaggtgtccatatcggaaaagatgcagtcgtggcagcaggagcagtggttttagaagatgtgtcagcaggtactgttgtcggtgggatacctgcacgagtcttgaaaataagtgatgatcagacaaaagaaaatacagcattgattgctgcgttacgcgaattatagaggagatggagaaaaatgcgcgaaatagatacctgtattgtgggggcaaccggattagtcggacaaacgatgctcaaagtgttagaagaatatgattttccagtaggacgattgaaattattagcgtcaaaacgttcagctggcaaagtttgtgtattcaaggggaagaaacacactgtacaggaattgacagaaacttcatttgaaggatatgatttagcgctattttctgcaggtgcttctgtatccaaagagtttgcgccaatcgcaagaagtcaaggattatttgttatagataattcctcggcatggcgagaagattcggatattccattgatcgttccagaggtcaatccggaagactatacattgaatcggctgattgcgaatccaaattgttcaaccattcaagcggtactaccgcttaaagctttacaagaagcttttggaatccaacgagtcaattattcgacctatcaagcagtttctggttctggacagaaaggtatccaagatctttatcgcacgcaaaatgacgaggaaccagctttgtatccttataatattagtcaaacggtgattccagaaatcgatcagcctttggaaaatggttataccaaagaagaacagaaaatgataaatgagacccgtaagattctgcatcagcctgatttgccagtatcagcaacctgtgtacgtgtgccaatcgagaatggacacggagtctcggtggccgttcagttgcaaaaagagtttacgattgaagaagttaaagagtgtctcagtcagtttccagggatccaattagaagatgatctagcagcacataaatatccaacgagcattcttgctaaaggaacagatacggtttatgctgggaggatcagaaaagacacctctttagagaacggactgttgttctatacaactgccgataacatacgcaaaggagccgctgcaaatgccgtacagattgctgtagctttaatgcagaaaatagcggaggtggcaagatgagtaatacgctgaaaatagcaaaattcggcggaacatcgatgtctcatgaagaacaattcaaaaaagtccatacaattgttctttcagatcccaatcgtcaagtgatcgttgtttctgctttaggcaaacgtacatcagatgatgacaaagtaacagacttactttatttgatttatgcctaccttcagcatcatgttgattggacacctctttgggaaaggatctgtgaacgtttcgttcaagtaagagaccttcttgacctgcagttacctgtggaagaggaactggcacgcatacaaaaacaactggaagatgaaaagataactgaagattatttagtaagcagaggtgaatatctgactgctcgactgatggctgagtatcttggttaccagttcattgatgcaaaggacctgctgttctttgactatgatggaaaaatcgatgaggaaaaaacagcacaggaaatcacaaaagcatttaaaagatatccgaaaatggttgttccaggattttacggggcaaaccctgcaggtaaagaaaaattattgggacgtgggggaagcgacattactggcgcgttactggcgaagatgctacaagcggcgagttatgagaattggacagatgtttcaggaatcatgatggctgatccgcgaatcatcgatcatcctaaaatcatcgaggaaatctcttttagagaactgagagagatggcttatatgggggctaatgttcttcatgaagcagctgttttcccagttcaagaggcggatatccccatccaaataaaaaataccaatgatcctttcgctcaaggaacaaaaatatcgaatcacgaagtggaaaaggaaaatggactgacaggaatagctggacgcaaggattttctttcgatcactttattcaaacgtcatatgtctgatgaaatcgggtttatctggaaagcaatgagcatttttgctaaacatgagatatcaatcgaacatattccttcagggatcgacaatatcggagtgatcgtttcagcagaagcgattgccgataaattatttctcatcacaaaagaattaaaagaaacacttggcgtggaagaaatcgtcgtgattgaagacttagctttgatctctgtcgttggcggaccgcataaagaattgatcggtttatctgggaaagtgttatcgatattgaacaaattagaaattcgcacatcgatcttatcacaaggagcacaggagttgaatctaatcatcggtgtaccgaatgatcagtatgaaaccgtagtgaagggtatctatgaagggatggtgaatacggatgctgaaagaatatcgaatggcactccatcaaattcctgaaatcggatttcgtgaattcaaaacaaaaaaatatttatatgaacaagtaaaaaatagtggagccgttatccatgaaatcggcgaaacaggactgcttctttattttgataatcaacaagaagaaacgattgcttttcgaacagatatcgatgcactgccagtcaaagaagaaacaaatctcttttttgcttctaagcatgaagggtatatgcatgcatgtggtcatgacggacatatggcgatgcttttagggttgaccgactttataactgaacacatcgaggagcttatttataatgtagtactgatttatcagccatcagaagaaatttccggcggcgcacaaagtgttattcagtcaggattgttagataaatatgaagtacaagcaatatttggctttcatctatggcctggactagctaaaggagaagttttttctcgaccaggacctttgatggcacaaagcagtgaaacagacattatcatcaagggccagtccgcgcatattgcttctagtgaaaaaggaatcgatagtctggaggcagctgtacgatttttgaagaatgtttatgattttgatcggcaattaccggcagagtggaatcatctaatgaaatttggtcaaatccaaggtggaacgatccggaatgttttagctggagaagttattgtatccggaagtatccgttcttacagttcagatatgcaaaattatttgaagaggggattagctcatttagcagaacagtttcactctgcagcaactatttctttccgctataatgacggctatccagctgtgatcaatcatggaggcttatatgcagcgttgtcggattcaaacaaattacatgaattagaggatccagttcttcaagccgaagattttggcatatatacgcaacaatatccttgtgtatttttctttttaggtgtcggtgatacccctgctttacatgatccgacgttcgattttgatatggatgttttagaaaatggtgtagaatggtacaaaacgattctttttacagaaaatcttcttgaaaaaatcgatagcagttcaaaagaggagcgagtaaataatgatgaatttatccaatcgatttaatcccagactttctagaatagaagtatctaaaatacggcaattcgatcagcaaatatcgtcgataccagatgtgatcaagctcaccttgggagaaccggattttccgactcccgaacatgtcaaacaagccggaatagcagcgattgaagaagacttttctcactataccggaatgagaggactggaggaactgcgggaagctgcttgtatgtttcagcaacagcgttatggattaacttatgatccgcaaacggaagttttgacgacggttggtgcaacggaagcgattgcctctgcattgttatctgttttagaagaaggagacaaggttcttattccagcgcctgcttattcaggatatcagccattagtggaactagctggtgctgaattgattccgataaatacttctgacacagggtttgtttgtcagccggaacaatttgaacgagcatttgaacaatatggatcagctatcaaagcagtcattttaaattatcctaacaatcccactggaacgacattgtctgcaagccagttggaagcaatcgctgaagttttaaaaaaatatccggtatttgttataagtgatgaagtatatgctgaattgacttacactggaacgcatatatccatagcttcttatcttccggaacaaacaatcgtgataagcgggttatccaagtcacatgcgatgactggttggcgagtaggctttatttttgctcaaaaagcccttattgacgaactaattaaagtccatcaatatctggtgactgcggctacaacgatgtcgcaaaaagctgcgactgaagcgctaataaatggagtaaaagatagcgagaatatgaaagaacaatatcaaacacggagagactatctggtccagcaattggcgcctttaggatttgaagtgactcagccaaatggtgcattttacttattttgcaaactcccagctgtcattcaaaccgactcttggcagttttgtgtagacttagcggaacaggcaaaagttgcgtgtatccctggcattgcatttggcccagaaggagaaggctatatacggatttcttatgctagcagtatggaaaacttacatgaagcgtgcaaacggatcaaagactttttaacagaacagtaattcatgaattttctcaaaaaacaatcgacatctttgcggtatattctgcaagctgccgattgttttttaaatttggttcaaatgagcgcgtttcttttgattcataactgatgtaatgttaagtttaaattgtttagaatgattttaaaagaatattcaaggaggtttcatcaatggaaaaaatcaaagttgtcattgtaggtgcatctcatggagggcatcaatcgatcttggaactattgacacgatacggtgaaaatgtagatatcacgctatttgaagcaggagactatgtttccttcatgtcatgcggtatggagttgtatctagaagataaggtaacagatgtaaatgatgtacgtaatttcagaccagaaaactttccgcaatccaatgttcatattttaaataatcacgaagtaaaaacgatcaatgcagataaaaaaacagtaacggttactagcacatcagataacgaaacaaaagaatatccttatgataaattgatcttgagttctggtgtcaaaccaaacaatttgccagtaccaggggcagatttagaaaatgtctatttgatgcgtggatacaattgggcaaccaaaatcaaagaaaaattaaatgatcctgctattaaaaaaatcgctgtcgtaggtgctggttacattgggatcgaagcagcagaagcaagccgaaaagctggaaaagaagtcgtcttgcttgatgtgatcgacagacccttaggcacatatttagatgctgagatgacagacattttagaacaacacctaaatgaaaacggtattgaagttttgacaaacgccaaaatcgaagcctttaccggaaacggaaaagtggaagcgatcaaaacaagtgaaaaagaaatcccagcagatctagtcatccaagctgctggtgtgaaggcaaatactgaatggttaaaagggatcgtcgacttagatgaacgtggctggatccaaacgaatgaatacttgcaaacaaatcttccagatgtgtatgcagtaggagatgctacacttgcttattctatcccagcacgcaaaaaaatgccgatcgctttagcgactgttgcacgtagagaagcacgttatgtagtaaaacatctttttgaagaagtaccaaataaaccgttcggcggagtcgtaggttcctccgcattaagtgtcttcgactaccattttgcagcaagcggattgaatagcttcactgcagcaaaagcaggagtagatgtacgagtgtcttattatgaagatacgttacgaccaaaatatgtaccagaagaacaaggaaatccaaaagtgtccatccaattattctcagatccaatgacccatcaattgctaggaggagcagtattatctacctatgatgttacaggtcaaggaaatgtgttggcactagcgatacaaaataaactgactttagaagaactggcagaagccgacttcttcttccaaccaggttttgaccgacaatggagcatgttgaatctagccgctcaacaagcactaggagaagaaccatttgtagaataaggaaacgaaatatttgaaaagaggttgtgacagaagtggtcagcttcaagaaataagaaggaatttacggaaattgtttctcaaatttttgtgaaatttcggcttatttttcgaagaagctacttctggaacaccttttgttcggaataaggactgtgacacgactcgtgtcacagtccttattttagtgaaaggatacatttcttccttgtatattccatgcgtgtttgagagaaagcatatataatttaattaacagatagttagggggagaaagaatggttttttcaatcacaatgaaactggtattcgggttgatcggcttgttattagtggtgcgtttgcttgggaagaaatccatgtcggaaatcacaccatttgatttagtctatacgcttgttttaggggggatcttagaagaatcaacctatgatgacaatgtccatgtaggccatgtcctatttgccattgcgctttgggcagtaatgatttatggtatcgaacgtatcgtccaaaaaaatgaaaaagtcaatcgctgggttaaaggcgagccctctgttttaatcaaagacggcgtcatcaacatgacagagttggcaaataaccatatcgagatggagcagttgcgagcaatcttaagacagcaggaatgcttttctcttgaaaatgccaaacatgttatcctagagaatgccggtcaaatgagtgtattgaaaaaatcagatgatgacaaagctttgtcgatcctgctagtggacgaaggacaaatccagcataaagtacttcaatccaatcaactagatgaatcgtggcttctggagaatttgaagaaagaaggctatgcagacgtaaaacagctgatttatgtcgaatggtcagaagaaaaagggttctacgtactaaacaaagaagacgtgatgcatgaatcttaccggatagatggatagagagaggttgtgaaatcagctctttgacttgatactcaaaactaagcgactttttcgcaacctccactaaacgatgttcaatcagctaataataagatcaaaatgctgattgaacagcctctcatgtcacaaaccatttttttgtttcttttaactcaatatgccgtacgtcttcccaaactatcggctgatggtcgatcataaaataatcttcataggcttcaccaatgaaatgaccttcaacctcatctaagagtcttccaaattcatctgttaaattgagctggatgattactgctttacgagataaaaaagcttctgtcagtatactatcgatttcttgtaatgtcatttgttgtttagggagaggttgtttgcgtgcttcttcttcattttttttgataccgttgactagttcttccatcgcaaaagcggtcccccattttaatccaaatggacgatctcgatactcgttatagtcaatgaatttttttgctgtccgtctcatcttttccaccttctaatccactcataccacctgcatgcccaccaacgagagagctacgtgcaatggcgcgtcctccttgcaagagactatgcgcatggatgattgatttaaagccgtatttttttctgatcgtatcgactacaaaatcaacttttgcttcatttatctgcttttcaggatcttcaaaaaggttaagctgtaaacctgtcgcgtatacgaggttggaacagttcacgcctatacgtcgaatatcctgacagcggtaatgctggtggaaaatggtcaataaagcatctgctagatttctgctagcatttgtcgcttcgatttttgtttgctggtgaaaaccggtcttaccatttgggtcaagataacctaaggagtatcctacccataagctgactacttgtgcttttgctgcagatcgtctcaagcgagtgccgacttgatcggccatttctttgataacgatctcgatttcttcttgcctcgtataatctctatctagaatttgactatttccgatacttcttgattttggtatatattcttgtcctaaaaaacttcgatcgattccccaagcatgggcataaagctgagtaccgatgatccctaacgtgcttttcaagtgataataatccgcgtgagctaaatcataaaccgaatgtatacccatttgtttcagtcgttttgctgttcgtttgccgattccccaaaagtcagtgatatctgagattgtccataacttttctgggacatcttcataacgccattcagcaatcatttgttttccgtcttttgagccattatctaaggctagtttagcaagtagtgggttatcgccgattcctatagtcgtgtagattccggtctgttcaaatacatctttatggatcagcttagccatgtcgtacgcattcgttttaccaaagagtgccatgctatttgttacatcaaggaagctttcatcaacggaatagacatgatggttcgcttcatctgcatattttttatagatagtattgatttctctgtttttttccatataataagccatccttggagcaacaatatataaatcacttggatagggaaagggtaaatctctggcacggctgatattggtgatgccgtatgctttttttgctgcaggactggaagccaagattaatccgctaccccgtgtttctgtcgaatcagacggataggacattactactaatttagttgtaaggggatcaagatccttttccacgcactctacggaggcgtaaaaagatttgcagtcaatacataaaatatctcgtgaaggttctttttcataaacaaatactggattttgattcgcccacataacaatcacctcttctacacaattagaacacatgttccctttttgtgtcaataaaaaacagcaattttcaaatgtgagccttttgctcatgtttgaaaattgctgagaggttatttgtatttgtttatttagctgtgttcattgatttttctatcaaacatgaacggcttctggatcaatctttgttgtcccatttccaatgtgtgcaacataaaattctggagcatagccgacaactttcatatattcatcatagacattgtttttgaaggcaggtatattttcttctttgacaagagcaatcgcacagccaccaaatccagctcctgtcattcgtgcacctaggacaccttcttgtttttgagcagcgtccactagcgtatctaactcgatcccagtcacttcataatcatagcgaagagagtggtgagaatcatttagcagttgtccaaatgcttccaagtttccagcttctaattcagcttttgctttcaaagtacgttgattttcagaaacagcatgacgagctctgcgtgtcaatgtatcatcaccgatttggtcaatagttgattcaaattcttcttcatctaagtctcctaaagaagagataggcaaagttttttgcagacgtgccaaggcttcttcgcattcgctgcggcgctcattgtattttgaatctgccaattcccgacgtttattcgtattcatgatgacgattgcataaccatctagtttcactgggaccatttcatatttcagcgtatttgtatctaacaaaatcgcatgatctagctcaccgaagccgatggcaaactgatccatgatacctgaattgacaccgatgaattcattttctacttttttacccgtttgaactagttccaaacgatccgtttttaaatcaaatagatcttctaatacaacacctaccaataattctaatgaagcactactggaaagtcctgcaccgttaggaattgttccttccaccaacaactcaaatccatgatcaattgggtgtccagcttcttttaatttaaggatcattccttttacgtagtttgcccaatttgcttttttatcatattctagctcgtctaaagtaaaactgatgacaccgatatcatcaaagtttgtggaataaactaatattttattatcgtctctaggtgcggcgacaccttgtgttccataagtgatagaagcagggaagacatgaccgccattgtaatcggtgtgttcaccaatcaaattgatgcgacctggcgagaagtattgtgtcgtttttttagggccgaatgtttcggcaaattttgtgtttaagcttcttttgatttccatgatgagttattcctctcttgttttgattttgaattctgtcactgtttcaaatgctgttccggcttttaaatgaatcgaaccaaatgctgagaaacgctctgcccctggagctgtttgagtctcaaatgtgatgccgccgtgatgtgccagttttcgaccacgcatttctggtgtttctggaccgaaatttgcagtgaaaataaccatactagaagcatctgtagcgatatctacttggatttttttatccggactagtcaagcgagcagcttctttatccaagccagattcttttaagaaaaatggatgatcgattccgtcaacgagttctttttgatccaaatcactagcaaaaacggtcgctagttttttaggcgtttgaaaatcgaaagcattccctgcagtattttcttttactcctataggaatactgtctgctcgtaaaggagcgtaagcttcactattgagccaaagctcatgttgatcgatcgtttgagaagcatctcccgtcaagttgaagtagacatgatttgtcggattgaataaagtatcttgatcactgatgccgcgagtggtcactcgccagatattatcttgtgtcaaagtataacggacttccacatccaatgtacctggaaaaccatgttctccgtcgggacttgtagtagtaaaaatgacagcagcttcattttcgccattcaaaatgacataagaccatttttttaattcaaatccaggagaaccaccatgcagattatgcccagtatttggatttgtagctaattggtaagtttttccattgagagaaaagcggccattttcgatcctccctgcggtgcgaccgatagacgcgccgatatacgggtctttttcgatatattcttcagcggtgtcaaatcccaaaactaattcttgatcatttgtttttaaacaaacgatcctagcacctaaatcagagacagaaagtactagcttgtttttattctccaaggttatcaaatgataaccttgaccgaaatctttttctgtaatcttcattttcaagatcctttcttaatgtgaaggaactactgcatcgtgaagttcatcttccattgtatcagctggagccaatttgttttctaattcctcaacgatttgtgcatgttttttctctgtcaatgtaatcttccaagcaaaaataatagcggagaaaatcatcaaagcagcaggagcatagaatgcataagctttgaaagtcgttacgccatgagcagtgatatcagcagcagtagcattaccagtcatcccagaagcgatagcgacaaaacctacgattccgttagacaaagcaccagcgattttatctagtaaaggacgaatagagagagtaacagcttcattacggataccatttttccattgaccatattcaacagagtctgtgattgtcatcaaagcggataagaaaatcaattgttgagggaagtagaacaatactaacccgatgataacgattggcaaacttgaacctgcgatcgtaaagaaaaagtaggaagaaatcatcattgcaatcccgccaaggtaaacgtagcgacgagagatgacacgtgtaagcattgggaatagtggaacagctactaaaccaagtaaggcagcaactagaccaacgatccaaaattcagttggttggccaagtacatatttgaagaagtagaacaatacagcagtcgttgctacattagcaatcgcataagcgatataagcaagggcaagccacatcaattgatcattttgagcaactgctttgaacacatctttgattccggctttttcattttgttgacggatcgcagtatcgacttcttttgttcccaaggcagtgataattgcagtaccgcctgaaataacagcagcaatcacaccgaaccagaaccaacctgaagcgccttcaatatgtttatgagtaacaagataagtaaagaaagtaacgatagggacaacgactagtgtagtaccatttgcacctagagaagagccgaaacgagcaaacgtagcaaatttttcacgttcctttgtttccgtactcaaagcaggaatcattgaccaaaaagcgatatccttgaatgaataaaaactatccagcaatatgaaaacgattgcaaacaatatgataaataaagtcgtattatgagtagctaagccaaagaaattggtaaagattgctaccaagagtacagaactaacaataccaccgataactaaccatggtttgaatttaccatattttgtacgggtattatcaataacgccaccaatcaaaggatcaaaaataatttcaactaagcggatacctacaactaagcttgtaactgtagcaatcatttttgcattcgttgccttatctgttcctgcaaacatctggcttgtcacgaataccataaaataagtgcttaatgtaacatagaatgtgtcgtgtccaaaagcgcctaaagcgtaggacatacgttggatcattttgcttttcataatctgtattcctctcctgttcaatatataatactaagtaaaccggttacaacgaataacaaagatcttttaatgacttaaacttaacaagaaatcgcttcctttttaatatatttctgtgacttttatttaactttttgttgcattatactaaagaagtaaggagagggagaaatggagcaatcgatttttttaaaaaaggaacatcaacaagtagaaaaagaattgtattttgatttttgcggcttctctaaaacgatgccgtttcattcttttggtcctgctattcgcaatgattacatcttacacgtcgtgatggaaggcaaaggatcttatcatgtgaaaaatcaacagtttcaattgaaaaaaggagatctattcttgattcgtccaggagactcgacattttacttatcagatggagaagatccatggatgtattgctggctttctttcggtggacatgcggcagaagaaatcatccggcagtcgcttttcaaagaagaccagtacacgatggtctcttccgatatacaaaaatatatcgacattattttagagtgtatgaaagatacggaagaaaccttggaaaatgaattacagttaacagcactaacctaccgttttttatcagtccttttaaaagacggcggaaagatcagcggtggcgtacaaaaagttcattcctccttagctgttgagacagtcaaatacatcgaggcacattatgcggaaaatttatctgttgaggaaatcgcccagcatttagctgtcaaccggagtcacttgtcacgagtattcaaaaatcatatgggtaccagtatcaaggaatatttgattggggtacggattaatcgaggggcgtttcttctttccctgacggatgaatccgtggaaagcattgcctaccaagtagggttcaatagtctagtcgtatttagccggatgttcaaaaaaagtaccggagaaacggctacgaactatcgtaaacggatgaaaaacgaaaatttcaagaatattgctttggatactttgaaaaaacagttggaaaaacaaactgcagtctcttggacgacctaatttgcttggacaaaaggacaagcatctgcaaaagaaacttgtggcggttatgctacactgtaaaacgaagactaaaaaaggaggagaagggatgcgtacacttatcatcatcagccatccaacgatggaggaatctctgaatcagcaatttttcaaagaagcttcttccggtttatccgttacttggcatcatttagaatcaagttatccagatggaaagatagatgtaaaggctgagctacagctcctggcacagcatgatcgaatcatttttcagtttccgttttactggtatagttcccctgctcatttaaaaatttggcaagataatgtgttggaacaagcaacacgtgtattagaaggaaaagaattagggatcgtattgacaacaggtgtggcggaaaaggaatatcaagctggagggaaagaagaatatacgatctccgaatttttgagaccatatcagcgaatcgcaaacaaattccatatgacttatctttcgccattcgttttagcacaatttatgtatttatcccaagaaaaacgttgggagaagctaattgcttatcagcagtatctctcattggaagggaagccatcgcttactcaacggattgactggtttattcaaagagtacaggaaaatcagaaaatgcaggaagaagattcggaaaaacaaacatatatcatagaagcactgactgacgcaaaagagcagatcgaagacttgagctttacactgcaagaaatgaaaggaacttcattatgacaaatgaatggttgatccaacaattagatgaattaagtgaaaaatcagaatatcaagaccgtgcactcttatatgagataaagaaactgatggctgagatagatgaacgaacaacgcagttgcaaggagaaatcgacggacgatcttggaatcatctcaactggtgaaattttcttataaataacaaggataaaaatgtgcacaatgacaattatttgctacaataagaatatgaagcgtttgataacgctgttatacataaaaattggtggtgaaaaaaatgtatgatgaaaatgagtggggagaaaacgttcggatgacccgaagaagacagcaaaaacaggcagcacgtaagcggatgatcatgattggggcagcagttgccgtttttttgatcatagcaggaggagtagcagggctgtattttcacgggaaaaattcgtcagatgcaaaaagcacgaccgtaacggaaacaacgacaaagaaaacagatgcgaaacaaacaagtgaggcatcaactgaaacaaaagaaacacaaacttctgaagaaaaaacagcagatgatttgccagagcaactccaagcaatcgtcaatgattattcgaaaaagatggaagaaaagacacctgtgttgattgaagaataccaaacagaaatccaaggaaatcaagagggcatagctggtttatccgcagttgctaaccaaaaagcacgtgagctccaagcaatctccgatgaaggaatcggaaaattacgtgcagcgtatcagtcagcagataataaagacggtgtagccttagataccttgatcaatcagctgtcggctaactatacgaatcatgtcgctaagatttccgacatatatttgcagacgagcgcttctcttcaagcagagtcaacaagcacacaagaaacagcatcttctgagtctgagacgatagaatcaacagaatcttctggaatgcaagctcgaacaacgcaagacacaacagaaaacactgaaacgactactagcagtacgacgtcacaggctgcgacaactgttgttttagaaggagaaggtccaaatcaaatagctgagcgaactggcgtaccagtagaaacgattttgtcactgaatgggatgagtatggatgactatttcctgactcccggtgagacactaaaattgaattgataaaagcaataaaaagaacgaagactcccttgatggaagcttcgttctttttatttggcggttcttttttcgcgtataaagtaatggatcgtcatgtaaagcaagaaaacgagaccaatgattaaagaaatccttgtttcaggattgataaacatgaaaatcaacacgatagctaaaaaagcaagtgtcgcataattcgtgtaaggagacagcggcattttaaaaggatgatcatgcattttatctgcgtgagtctttttgaagcgaatctcactaatcaaaatcaccacccaaggaaccataccaggtaaaatacttgagctgtatacgaaaacaaagatattttcggactggttgatgaacattggcagaagatagtttaagatcaaaccaatcaagattccgcctgagatggctacgacagggtaaaaaggcgcaccatgacgagataatttcagaaactttttagacatctttccatttatcgcaagtgtatagaccatacggcttgcactgaaaatgcctgaattgcaacctgataatgccgctgtaatcacgacaaaattgatcaaccctgcagcaaatgtaatgccgattttagaaaaagtttggacaaaaggcgagccaatctcactcaattgattccacggataaatactcacgatgataaaaatggcaccaatataaaaaatcaagattcgaccgatagtggattgaacagcttcaatgatcgtctttttaggattctctgcttcgccagcagtcattccgatcagttcgatcccttgataggaagcaacgacgatcgataatgcaaagaaaaagcctttgacaccgccagtgaagaatccaccgtttttccaaagatttgaaattcctaccgcttggccatgattaccaaatccaaataaaatcaccccaagacctgcaatgatcatcaaaatgattgttatgactttgatgatcgaaaaccaaaattctaattcgccaaacgccttgacagaaataagatttgccagcataagaaataagacgacaatgatgccgggaataattgctggcagattgggccaccaataattcatataagatcctacagcgattacttcacttatccctacgacaatatattgaaaaatattactccaagcggtcaagtagccagccacaggatggatgtactcgctcgcgtaatttgcaaaagaaccagtcgaaggatcgacgtaaagcatttcgcctaaagcacgcataatcaaatacaaaaagaatcctgcaatcgcataagctcccatcactgagggccctgtccagcgtatggttgaggaggcacccataaacagaccgacaccgatcgttccacctagtgcgatcatttggatatgacgggcactaagactccgagttaacttttcttcttccatacaaaaactcctttcgttgttgagtcaacaggaaaaataattaaacgtttcaatagatagttgtattatttttaggttagccttattgaactcttgatgtgattctacagaaaattttcataaaatgcgaggaaaattcgaaaaaaactttttcatctttctacttgtaaatgctttcctttttagttaaactatatttaaataaaaagttagggaaacctaaaaaggagtgtaggatttggaacgaacggccattgaaattcaagacctttcagccgcttatcaagggaaaactgttttgaaaaccatcaatttaacaataaagtcacaaaaaatcactggtatcatcggaccaaatggcgcaggaaaatcaacattcatgaaagcattgctagagttgataccagcttctactggtaaagtcactttttcaggacagccagtaaaatcagtccgtaaaaagatagcctatgtggagcagcgaagcgaattggatctttcttttccaatcgatgtgttaggcgttgtacttttagggacgtatccatctttacgaatcggacagcggcccgggaaaaaagaaaaagaacgagcaagacaagcattaaaaaaagtagggatggaagactatgccaaaagacagatcagcgaactatcgggtggtcagcttcagagagtttttattgcacgagctctagctcaaggcgcagagtggatctttttagatgaaccattcgtaggaatcgatgcattgagtgaacgaaaaatctttgacatcttgcaagagttgaagaattcaggaaaaacgattctgatcgtccatcatgatcttcataaagtagaagaatatttcgatgaagttgttcttttaaataaacagctgatcgcttctggtccagtacaagaagtctttacatcaaagaatcttcaactggcctatggtgagatcatcggacatttagtaaaaggaggagagaaaaaatgatccaatcttttattgatggattgatgaattatcaatttctacaatatgctttggtcacttctatgcttgtaggacttgcttctggagtcatcggttcctttattattttacgtgggatgtctttgatgggagatgctatctctcacgcagttcttccaggtgtagccatttcttatatgtttggttttagttacatttttggagccactgcttttgggatgttgacagcagcggtgattggtttcgtgacacagcgaagccgattgaaaaatgatacagcgattgggattgtctttagttcgttttttgcattagggatcatcttgatttcatatgctcaaagtgcgacagacctgtatcatattttatttgggaatgtcttagctgttagggagagcgatctgctgctgacagcactagtcagcggaatcgtcttgatatttgtctttttcttttataaagaattgaagatcacatcattcgatccaacaatggcaaaagcttatgggctgaacacatcgctgatccattatcttttgatgttctttttgacattagtggctgtagtcagtttgcagacggtaggaacgatcttggtgattgccatgttgatcacaccagccgccacggcttacttgctaacgaaccatttactgaaaatgatcattacagctgcaggaatcggtatgttcagtgccgttgtcggcgtatttttcagttatagttacaattggccatcaggagctacgatcgtgttagcatgtaccgcattttttatccttgcttttttattttctccaacaaaaggaattttatttcagaaaggaagcagatagatgaaaacaaagaaatcactcttttttatcctggcaattagtttattagcattagttggctgcggaaagcaaacttcaaatcaagcagacgaagtaagtaaagaaaagctgtcagtcgtggcaaccaattcgattttggcggatatggcaaaagaggtcggaacagataaaatagatatccacagtatcgtaccagtcggaacagatccgcatgaatatgaagtactaccagaagacatcaaaaaggcaagcgacgcagatgtcatcttgtacaacggattgaatcttgaaacaggtaacagttggttcgataacttgatggaaacggctaaaaaagaagaaggaaaagattattttgcagttagcaaaaatgtagaacctctttatttaactagcggtgaagaacatacaaaagcggatcctcatgcttggctagacctgtctaacggaataaaatatgtgcaggaaatcgcacgtatattctctgaaaaagatgcagaaaatgcgacacattataagcgaaatgcagaaacatacgtggaaaaactaaaaaaattagatacacaagcgaaggaaagttttgcttctatcgaagagaacaaaaaattattagtaacaagtgaaggagcattcaaatatttttcaagggcttatgatttgccagcagcatatatatgggaaatcaatacagaaagccaaggcacgcctgaccaaatgaaagcaatcattgatcaggtaagagcaaaagaagtgccagttttattcgtggaaactagtgtagatccaagaagtatggaacgagtagcaaaagaaacgggtttggaaatttatgataaattgttcactgattctatagccaaagaaggggaacaaggagattcttactatcagatgatgaaatggaacatcgaaacaatccatgaaggtttatcccaaacaaaagagagctgaaaaacgcaaggtctggcttaaggagcggaccttgcgttttttttacaagaaaccggaaaaaattatgatgtttttcggcgtacagataccctttttgagaaaattccgttatagttagagtaaggaaggaaggtgtggctatgaattttacacgtaaagataaatatacgattaaagaagaagtatttcgattgatcaaccagcaagaaaatactgacaaggatcaagaccttcaatttcttgaagcagaattagctaaattattcatagcaaatcaaaatgagacaacagaaccagatgaagagctgtacataggcaaatggttgtttgatgaatttcagcctttagatgaaaataccggtatcggttattttgtgttcctttctccagtcggcttcacacctggcgtattagttaaacaaaacgacgaaatcaccgtcaaagcatggcctgctttgttttcagtaatcaaagcagaaggagtaatcaaaaagatccagtcggcctattataaaagtcaatttattgccaacagcaaattaatgaatatgttttataaccgcctagtagaaattgccagacccgggaagatcccgcaaacattcacgtatacgcagcaaaaaaatctctatgaagaagtactgtattcccgcgatctgtctgagttttcaccatgggaagaggtaagactccatgaattgttaagtacaaaaccagtttctttgaattttttcaacgcattggataacaaaagaaaattgatttcgacaaattattgggaagtatttgctgcaagaaaaaaatggatggaagaaaagaagattgctgatcagcaaatccagtttgtccaactgaaaaaagaaaaactatattatggattatacagccgttaacagcaagcgaggaagaccatgacattaaaagaagaaattatacaagaaagcaaacgattaggaattgacaagatcgggtttacgacggcggagccttttgattcattaaaagagtcgttggaagagcaaaaagcagccggacatacttctggtttcgaacacccaaatatcgatgagcgactttacccagaaatgacatttgatcagccaaaatcaatcatttccattgctcttgcgtatcctactaggatccatgaagaagtacctagggatgaaaaacgggggcaattcgctcgtgcctcatgggggatcgactatcatgatatactgagagaccgattgaatcgattgatcgaattcatccaaacaagagcagaaaaatggcaaaaagaagaggaatggcgtctagctccgcaagtagacactggggaactgattgatgtcgctgtagcacagcgagctggattaggatttatcggtcgaaacggattgctgatcaccgaagagttcggttcatttgtatatcttggtgaaatcgtcactaatatcgtatttgagccggataaaccaggagagtttggttgcggtgactgtatgcgctgtgtgactgcttgtccgacgaaagcattgcttggtgatggcagaatgaatgcacagcgatgtttatcttatcaaacgcagacaaaagggatgatgcccgaagaatatcggaaaaaaatgcgaaatgtcatttatggatgcgatatctgccagttagtctgcccttacaatcaaggaaaagattttcattttcatgaagagatggaaccaaaaatagatgaagtatatccaaaattaaagccgatgctgtcgatgtcgaataaaaatttcaagcagcaatttgggcatttagccggttcgtggcgtggaaaaaaacctttgcagagaaacgcattgatcgctttagctaatctaggagatcgaacggcattgcctgagatttcagaatgtttaacggatgtccgccctgtcatcagaggaacagcagcttgggctattggacgtctcggaacaaaagagccagaaaaatggcttgatgtattagatgaaacattagctaaagaatcggaagaagtcgtcataaatgaactagaacatgcacaaaaattgttgcggagaaagttaaaataaaaaaatagtaagcattattcattgtttttgtccagtaattgttgtaacaattactggtttttttgtattttttacgtttttttaatagaatttgataaaaatcaaacatttttttccttttttttatggattattgcagtaaatattacagaaaacgtgttttttattcaaaaataaaaaaacacagaaaaacgattactttgcttatataacaacgatctgatggttttacatcaaaaaaatttttgttcaaatgttacaaatattaaataatccgtcattttgtcattaaatgtcatgattcttttacctatgaaatatttctaaatgataaagttaatagcgtcgaaagaataaaaaacggagaaaaaaaggagtttaatatgaattcatttaagaaaattgttttaggtacaacttttgctgctggtgctactgcaatgtttgtaggaactacaaatgctcacgctgatgaagtttacacagtaaaatcaggtgattcattatctaagatttcacaaaaatttgcaggagacaactcaatgatcgatgcaattgctgaaaagaattcaattgcagacatcaaccgcatttatgttggtgaacaattaacaatcccaacttcaaatgattcttcagcaacaacagaaagcaacacaacagaaaatacagcatctacaactgaaacagcaacgcaagaacatacatacgttgcacctgttgaaacagttgaagtagctcctgctgccccagctgttgcaacggcgccaacttcaagctctgcaaaagaatggatcgcacaaaaagaatcaggcggttcatacacagctactaacggacgttacatcggccgttaccaattagatgcttcatacttaaacggcgactattcagctgccaatcaagaacgtgtagcagaacaatacgtaacatctcgttatggttcatgggatgctgctaaaacattctggttagcaaacggttggtactaagccgataaaagaaaaatgatgaaaccgagagtcttgtttattcaagttctcggttttttttatgaaaaataaatgatttgtttccctctgcacagcagtacaaataaaaactcggataatgtataataaagaaaacgctttttttgtttaggggatgaggaggagccatgagtacaaaagagagtctcgaactagagaaaatcacaagtgaaaatccactgttatccagtattcgatccattgttgaaacggcattctacggtaataatgtgcaaaaagtttttgacagggaaacagcttatcaactagcaaaagggagtccaggaacgatcatcacagatttaacggtctcacatgctgaagaactagatttaccagctgacgctaggacactagtattcaatgatgggagtattgtaggaagaacagcaagtgctcggcgtatctttgaggacttggacaaggagcaaagtaaatatgagaagatcttgagagaagccgtgtatcaaagtcgaaagcgacaattttatcatacaaaagtaatcgttggtctatctgaagaattttctgtacaaagtcatttgttgattccagaaggatttgagaacaatctgtattcttatatactgaattttcagccagcgaatgcgaagattttggctacttatcaaaaatctgtgtcctttgacgagggagatctttatatcttttgtgatcccgaatggacgcatgaagcctttcccaatggactcgttttatttgattctctccataatacagctgctgtgctaggattacgttactttggggaattaaaaaaagcgactttgacgcttgcttgggcattggggagtcgcaatggttttattgcctgtcatggcgggatgaaacaatatactagtaatgatcagacttatacgatggctgtatttgggttgtccggttctggaaaatcaacgatcaccttagcacaacattcggaagggcactctgttacgatcctacatgacgatgcttttgttatttctagaaaaaatggttttgctactgccttggaaccttcttactttgataaaacacaagactatccgtctgatgacccggccatttcttttttccttacttgtcagaatgtgggcgtgacatgtacaagtaaaggagaaaaagttctagtgacaggagatatacgaaacggaaatggacggacagtcaaatcacgttatgcgacaccagaccgagtcaatcatcttagcgaaaagatcgatgctgttttttggatcatgaaagatgattcacttccgccaattatcaagatcaatgacccggttttagcagcgtcttttggtgcaacattagcaacaaaacgatcagatgcggaaaatatcactacaaaaagacagctagatgagttagtcattgaaccatttgctaatcctttccgtgtctatcctcttagggaagactatcaagcttttcgagagttgtttttgaaacagcaaacagcctgctatgtcttgaatactggatacttcgatgataaaaaaattaaacctgaaacgacattgtcaatcgttgaaagaatcgtgcaagaaacggcagaattcaagtcgtttggtccgtttgaagatatccactatttacctataccagattttcctgtttcttttgaggatacatcctataaaaatctggtgaaacaacgacttgatattcgtttacgattcattgaagctcagataggaaaaaatctcttgccagatgaagcaaaagaaagtttggagaatttgattcagaaattgaactaaaataacagctttttcaagaagtaatctatgcgcaatatcgctcgggattcttacttgaaaaagctgtttttctatgatggatttttcgtaatataggtggagatgtccttttgataatcttccgtaggccaatgaccagtatttaagaagttggctaatagatagccgatataaggacctgtcgtcaaaccagaagagcctagaccgctagcagccagtagacttgggtcatctggcaatacgccgaagaatggggaaaaatctgacgtataggcacgggtgcctacacggaactcgtatggccagttttttatctgatctgaatcagccaagaactgttctgtactcttagtcaatcccttataagcttcgctagtaggagccaaatcccagccttgatcgttctcatgggtagcacctaaaaggatctttccgtccatgaaaggaatgaaatcagcttctccgtcaagcatagcaacaggccagtcttgactcatcttataagatgtctgaaatgctaaaagctgccctttttgcggacgtatatctgcagaatagcctaaattttttaatagaggcttaagtgcaggaccaggtgtcaagattacgcggtcagctgtgtattctccaaatggtcccttgatgagccaagaatcgttcttcttatgcaaggtgacttttgcctggatctgctcgatttgtttttgtactaaacgctgaccaagatgttctaaatatgcttttccatccagacgaccgccaccactgatacgcagtgaaactgctggcttcaataacggaagagcttgggatgtctgttcaggtgaaagccattcgatgtttccaatttctggtgcttcttcttttcgtttctccgcaagaacagctaattcagctaaatctttttcaggtcgaagcaaaagtgtccctgattgtgcataaatcgtttgatcaagttggaaatcttttatgagtttagggaaaaaagcagcgccgtctttagccagacgataccattgtttgtttctgcgttttgacaaccaaggggagatgatcccagcgcttgctttcgttgcctgtcctgtcccttcatcaaacaaagcaacatcgaatgttgatgtgtccaagtaattggctagggtcataccaatgatcccgccaccgataatggcaattttttccataaaaaagcctccttttacaaacaaccattttcacacaaaaaaacggcagatgcaacacctgccgtatatggaaactacgcttttttagcaaaaaacagagaatagacgaatcgagcaaagctgataagaagcaacagcaataagacgcccaatgccgcttttgatcctaatgtagtagacacttcgtaactatgggaagtatgatgctgaacataattgataataaccgctactaatgaagtagccacagcaccagaaaactgttgcaaggtattgaacattgcattcccgtctccttgcagttcttcattcagtgcattcattccagtcgtcatcatattgctgtaagacaatcctataccgaccatataaaaaacatgacaggcaatcaatacacccaatgaagcgtgtccgataagcaggaataatgctagccaaccaatcaaagaaaggatcagtccagcaaaaattggcttcttcggaccatattgatccagcattttaccagaaaaaggagaaagcaaagcaccaaccgctgcaccgggaagcatggctaatccagcgacaaaaggactgcttccttgaacgatctgaaggaaattcggtaagacaaaagacacaccaagtaataaaaactgataaaccaagaaaccaatcaaaaacaaacggaatgttttatttgaaagaatggacagtcggatcagcggatgttccacttttttacttcgatagtaaaataggaaccagccaatcccgccaatgatcaaagcaatccaactagaaagtgttcccaacgtactcaaaaatgtcagacttccactaaacaaaagaaagattcctaaaacgctccaccaatccaaataaccatttttttgtactgccatctcgggaatagcaaaccagccgataatcaaagaaaggatcaaaatgggcacaagaaacaggaaaatatgattccatgtaaaatgggaagtcataatgcctccgtaagtggggccaatcgctggagcaatggccgttgtcaaagtaccgacacccatcatcgcgcctcgtcgattgaggggggcaaatgtcaagataatatggaacatcaacggaagagcgatacctgtcgctgccccttggagcaatcgaccaaacaataggaccatgaaggtaggagagaagaagtcgatcattatacctgccaagaaaagcagatttgaagctaaaaagagttttttgagactaaaattgcgattcaaataagtagatagcggaacaatgatcgaaatcatcaaaagataaatcgttgttacccattggacttgtgcggtcgttaaatcaaactgtctaataagagtggggaaagttacattcatggccgtctcgatcaatacgcccgcaaaagacatcatccctgttgcaattactgcaggtactaaaagcagctgtttttgtttcgtcatttacatcacctctaaaaaatttcgtaaaaaaagagagtgatttctattataaaaatagaaaccgcctctctctcgacacgccgaaacgtgttatctgtacgatttatttacttaacttattctagcacaaactgaaaaatagtgtcaacacgattagccaagtcactcaaaaagaggtatgataataaataactaaatggaatttctcggaggaagaaaaatggaaaaaatcgaatggcgtaaagacaagagctatagtatgaaaaaaagcccgcaaatactagaggttcctaaaaaaccattctttagcatcagagggatcggggacccgaatcaggaagactttaaacgaagagtagcctgtctatatgcagtcagctatgcaatacgcatgtcgcctaaaaaaaattggctgattcctgattatcagctgtatactgtctatccattggaaggacaatggggactgcaagaaaagtatttgcatgaaccagtgatgaaaaaagaacatttttcttatcaattgatgatccgacagcctgactttgttacagaagcgatagcacaagaagccattcagcgttctctgagcaaacttccggaagacttgagagaacaagtagcattcggaaagatggaagaaggtctttgtgcccaaatcttacacatcggttcctatgatgaagaaccagaatcctttgagaaattagaagcattcattgcagaagaaggctatcaaagaacttctaaagaacataaagaaatctatatcagcgatccacgaaaatctgcacctgaaaaaatgaagacgattttgcgtgtcaaaatagaaaaaggatagcaacctgaataaaaccgaaaaaataaaagtaaaaaataccaaaataagaagaaatattacttgtcttttgctataatcaatattgagaggtgtctaatatgaaaaaaaaacagcgacaagcattgatccgccaaatgattacagaacaaccgattgggacacaggaagagctgcttacacggttgcatgaagcaggtgccgatgtgactcaagctacgatttctcgagacatcagagaaatgaagttagtaaaaagccaaaatgaaaataaaatagtatgctatacattatttaaccaaccatctgtttctttaaatgaagaacgtttgcgtacggcaattaggcgtgaggttttacgtatacagtctgttcaattcatggttatcgtattgactgaacgaaatggcgctgatgtggtaacgaattggttagacgaagttgcttatcccgaagttgttggaacgatggcaggtgtagatacattcattattatttgccgctcagaagaagaagcacagcgatttgcggaaaaattagaaaaaatgagggaataaatgaggaggacttttatatgcaagatatgaaagcgctacaaaatggatcggatattcgagggattgcattaccagttgaaggtcatgaagtcaatttgacgacagacagggtagaaaagatcggctggggactagcaaactggctaaagaaaaagaagaaatcaactaatccgactaaaaaatggacgattgggattggtcatgacagcaggatcagcggaccagcactaaaagaggcgttgatccaaagtctgaaagaacaagggatacatgtcattgatttcgaattagctactacgccagctatgtttatgtccactcaatttgaacaattctcatgcgacgctgcggtcatgctgactgctagccatcttccttattattacaacggaataaaattttttacctcagaaggaggagcagaaaaagaagatattgcttatatcctgtcacaacagcaaaaaataaacagtgaacaagtaggaagtgtggaaaaagcagaccttttgataccttatgcgcaagatttagtcacaaaaatcaaaaaagggatgagaacacaagatgacaaaccactaaaaggttggaaaatcatcgtggatgctggaaatggtgctggaggattctttgctgaaaaagtattgaatagcttaggcgctgatacaacaggatctcaatttttggaaccagatggtcgatttcctaatcacatccccaaccctgataacaaagaagcgatggaaagtatcaagcaggctgttttagcaaatgaagcagatcttgggatcatttttgacacagatgtggatcgttcagctgtggtcagtgcttctggaacagtcatcaatcgaaataatttgatcgcagtattaagtacgatcgtattaaaagaacatccagaaacaaggatcgtaacgaattcgcctacttcttctcatctacaaaaattcattgaagaaaaaggaggtacccaaattcgttatatttccggctatcgaaatgtaatcaataaagcattagaacttaatcgtcttgggaaagatacacagctagccatcgaaacaagcggacacgctgcattcaaggaaaattattttctggatgatggtgcatatgtcatcgcgaagatcctgatgcttttgccagaattaaaaagaaaaggtatcacattagatgaacaaatcaaagagttgaaacagcccgtagaagtacaagaaatccgactaaaattgttcagcgatgaaccacgcgaacaaggaaacaagatattagaagaaatgaagcgactgctggaagaagaaaaagggatgaacttcgacccggcaaatgaagaaggtattcggtataatctgcaagaaccttatggaagcggttggtttttgattcgtttaagcttacatgagccgttgttagtattgcagatagaaaatgacgaaagcggaaagaaccagctagtgttagaaaaactagcaaacttattcggacatttttctgatcttggatcattaccagcagaataaaccaaacttcttgaaaggtagttgcttggacaacaaaaaaagtggtaaggttaaaccgagtgctggtaaggtggccagcaaaaggaggaaaaaaatggtaacgaatatggttatttttttaacagtattggtctatggggtcaactttctggtatatatgtatcttaaaatcaatcatataaaagattatttagaaaagattgctatttattttggaacgaatatgaccctgttgttcacgagtggcatctttttgttttttggaaaaatagtagaagacggtattctggtatttgaataagcagaatttttgtagaaagcgccttacttgtcatacactataactatagcaagtagcaaatggtcaatcgaaaggagcagtacaatgaaaaaagcatacgaaacagcaatgattaaccatggcgggcgcaatggagaagtcgaggcacccaatggctcgatgcatatgaaaatcactcctccgggaatccatgcagaaggaacaaatccagaacaattatttgcagcaggttatgcttcttgtttcaatggggcagtacaacatatgatcaaagaagcaggaatgaccgcagagtccacagtaaaagcacgtgtctctctttataatttagatgatggcggctataagatcggtgtagtattagaagtgcatatcgatggcatcagcgaagaagaagcccaaaaaattgcagaagatgcgcatgaattctgcccttactccaaagcaactagaggaaatatcgatgtagaagtaacgattgtttagaagaataaaggaaatcgaaccagactaaaaacgtgaaaggaccgctttttgtctggtttttttgacaaacaaagcagatgatttggaaaatagacgattatcggttatcatatttttgtaccaatcggtaggtaaagaagaagtgagggaaaaaggatggaaaaatatcaaaatattgtgatcggttttggaaaaggcggtaagactttagcgaaggcgttagcttcaaaaggcgaatcggttttagttgttgaaaagtcaacacgtatgtatggcggaacatgtattaacatcggctgtattccttctaaatcattgattttcaatggagaaagaggaatcgattttacagaggctgttgctcggaaagaaaaattgacgggcatgcttcgtgccaaaaattatcatatgattagcgatgaggcgactgggacagtgatggacggcacagcacgttttctttctaaccatcaaatcgaagtaacgaataatggtgaaaaagtgattgttgaaggcgaacggattttcatcaatactggttctgaaccaatcattttaccaatcaaaggattgaatacaagtcgctacttgattgattctacgcaagcaatggatcaggaacaattaccggaaaaattagtgatcattggagctggatatattggtctggaatttgcatcaatgttcaatgaatacggatctaaagttgtcgttcttgatgcccatcctgaatttcttccacgtgaagatgaagacattgcacaaatgattttagaagatttgacgaatgcagggatcgagttccacttaggtgtgactgttgatgaagtagcagaccaagaatcaacagctgccgttacctttacagaagatggtcaaaaagtaacgattgaagcatctaaagttttagcagcaactggccgaaaagctaatacagcttctcttggattagaaaatacagatgttaaactgactgatcgcggagcaatcgctgtagatgaataccttcgtacagatgcggaaaacatttgggcgattggagacgtcaaaggcggactgcagttcacttatatctctttagatgattatcgaattatcatggatcagttgaaaggcgaaaatacacgaacaacgaataaccggaaagctgtgccttacagtgtatttatcactccgactttatctaatgtaggattaacagaaaaacaagccaaagcacaaggcgtcaattacaaattattcaagtatatgacaagcggtgttcctaaagcacaagtattagaagatcctaaaggggtattcaaagttttagttgatcctgaaactgacttgattctaggcgcaagtatctatgcggaagattctcatgaagtcatcaacttgatttcgctagctatgaatggaaaacttccttatacgttattgagagatcaaatctattctcatccaacaatgagtgaagctctaaatgatgtattaaaataaataacgaatggagaatttagcatgttcaacaacaaaaatacagcagtagttctaactgacccgcaagtcgagttcttgaaaccagcaggcggtggctttggtttgacaaaagatatcttagaaaaatacaatacgatcgaaaatatgatcgaaatggtgaaacaagcaaaagaaaaaggatacaaactctttatttctcctcattatttttatccacatgaccataaatggcaatttggcggtgcaggagaacatatgatgcttgagcagcagatgtttgctagaaaaagtcaatatgaaccagtggaagaaggttcaggagccgattttatcgaagaattgaaaccatatttggatgaaaatacgatcatcagctctcctcataaaatctttggaccagaaagcaacgacttagcgcttcaattgagaaaaaatggaatcgacacagtaattctcggtggaatgaacggaaacttgtgtagcgattcccatatgcgtgaattggtagagagtggattcaatgttgtggtagcgacagatgcaattggtgctcctggccaagaagcaatggatgcagcgttgacgaactttggttttattgcagatcaagtgatgacaacagaggaagtattagagcaactatcataagataggaactgcttttgtcctcgcagttcttgaatcaatgaacatctagctacaagagaacagttttatagtgaggactgtgtcagataatttggcatagccctttttaaacgattaggaagataaaatgatgaatttattgtataatataggactatgagagatgaaaaaggagaatatcattgaaaacaaaggaaaagatcttggaagcgaccaaagatcttatttataaaaaaggctatcacgaaacgtcaatccgggatattctagcagcttctgatacggggaaagggcaattttattattacttttcttcaaaaaaagaagtttgtctagcggtgatccatgcgcatatggacatgtggcagacagagttgtttgaagacatcttaaatgctggaaaacagccagaagaagcactagaagaaatgttggattggattttcgctgatcatgaggcacaaatcacttatcatggctgtcctgtggggaatttgattattgagttgagtacagtggatgaagaattccgtctattgctactagaattagtcaatcaatgggtcaagtatacgaaacaaaatatcttggcactttctgaagaaaaactgtccgatgcagaggcagaccgtcaagccaaagcgttgattgctgaaatccagggcagtatcttattgttgaaagtcacacaagatctatcactacttagacagaattttcaattgatcaaagaaagattgttaacttcgcaaaaggttctttaataattagaggttgtgacagaagtggtcagcttcaagaaataagaaggaattgacgaaaattacttctcaaatttttgtgaaatttcggcttatttttcgaagaagctacttctggaacaccgtgaatcagaggttgcgaaaaagctgtcctgcatcaagtaataagaacagccaaacaaaaatagcttctcatatttttcgtttggatgggcttattaccgcagatgcaagcttttgaacaccgtttaagaaagaggttgcgaaatcagcggtttgacctgagtattagagaaacaaatggaaaaatagttcctcatattttgccatttgttgagctaataccgagggtcagctgattgaacaccgtttacccagaggtcggaaacttgccgtttcactctgagtcacaaggagtaatttcaaaaaaaagcttctcatatttgatggatattgtgacttgtgaccgaggagttggcaggagaaaaaagtttactggagagtttgtcacaacttttttaattctccattcattgaaaacgttttgttggtgtgaacttcttgttgcagtgtatgatagataaaaagatgggggaggtattaggatgtgtggtcgttatttttttaatctagagtcggagctccttcagaattattatcgagaagcccagaagaaacaaccggaacaggcagcagaattagcagctggagaaatttttccgtcaaatcttgttgtgacattaagaaaaaaggaagaaaacaatctcactccggaaatcatgaagtggggatttaccggatttaaaaaaggacaattgatgatcaatgcccgagcagagacaatagaagaaaaaaagacctttcatcaaccatttttgcaaaatcgttgtgttttcccaatgagcggcttttatgagtggaatgaagaaaaagataaatttatgttttcaaataaggaaaaaatagtgtatattggcggcttttatcgtagccatcacgatgaaaaaacagcagaatcgatcataatgactactgaacctaatcgcacagttgcaccaatccatgaccgaatgccgcttgtcttgaatgaagaacaaatcgaaccttgggtaacagatatttcttttgcgcgaaaaatcattactcagcagatgcctgaattagtaatggagaaggtataacagaatcgatttttcaaagaaagagcggcaaaaaacaaaaaagacttcagcacagatcccaaaaacaaagagaacagaagaaatgctcataagctgcatatactgcatctatagagtcacattcgaccttatagcttctatttgttttttactcgtgctgcgagtcttttttttgtttatacctaacgatgtttatcattacgactctttgaattcttggaatctaaaattcaaacttaacgactggttggcagttgtatattccctgaatttatagataagaggttgccatttatacacattgatatgagttggatcatgtaaaatcccttcttctcatccttagtcgtcatcagcacgacgggaaatccgtaatagaaacttttttccatttttttaaacataatcctcacctctgaatatagtatactaagcttattcctcgatgctcatcgatgtgtgaaaggatagaaaaaatggctggatttcctgatcttcagcaaacgactaaactcttagcagatcattcgcgacttgagatccttactttattgatggatggaaggttccatactgtacatgaactagcaaagaaagcaaaaataaaagatcacacggcatcttatcatataaaaaaacttcattctcttgattgagtgaggtcttataaacagggaggaaatgtctattatcgattattatctctggaaatcgctgatttgttagaaaatcttatggtagttagtccggttaaatcgatcaaatcatttaatgaaaacaaagaatatagtgaattaaaagcaggaagatcttgttatcggcatttagccggtgtgataggtgtagtttttttcaactttctccttcacaactgtcacttttctttttaaatggcaaaaatttcaatctttaaatggcgaaaaacaaagagcgtgaaaccctatccttatctcacgctctttgcctatttttctaacaaatcaagtatttcttgaggagaatcaataattatatctacactttgaaatgattcaatgtttttagcaccccatttagctaaaccaaaagtgactccacaagatttcgcactttgcatgtcatataatgaatcaccaatgtaaatcgtctcttcttttttcatgcccaattcatcaattgccttttgtatggggtccggaaaaggtttatgcaacttagtatctgaagctgtaatttgtatatcaaaatactgatttaaattaaatcgatcaaactcatttttcatttcttcttttgttttagatgtgacaagtcctaattgaatcccttttacatgcaatgtctgtaatgtttcttctatatgcggaaaaacttgagcattgtctgctaataaaagtacgttttcaccccattttgataagagagtttcctcttcttcttcagtatttacaaactttttaatagcttctcttccaggaatacctaaaatataatgtaattctttaatcgggatttccttctctaattcttcacgcaatgttttttgcagagaatgtgtcataacatattctgtatcaataatcgttccatcaacatcaaataatatcgttttaatcatagctattctcctttgtgtagatgattttgctctttcctattctaacggctaattcttcaggaatttttttatcggttatcaaataatcaatttcttcaaacgagtagacaaggtaattatgtgataaattgatttttgtatgatcacatagtaatacgattttgttacttttctctctaactacctgtttcattgcgatgtcttcttcatgggcataatagattccctgattatttatacccgcacaacttaagaaagaaatatcaaaccgatacttagttaattcccagattgggtatccaccagtaactgaacggctttctttatttaatgttcctccaagaatcgtagtagggattgaagtggtctttaagaattgatcggcaatgtcaatcgagtttgtcacagccaagtttatgtttctattcgctaaatattgaggcaaaagtgagattgtggtcgacacatctaaatatacggtttgcttttcaagtaatagtttacttgcttctttagcaatttgctttttcacttgaagttcttgatctgttcttcctaaatatccatctattttattaaacgaatttgctaaactgatacctccgtaagttctaatcacaaggttgttatccgctagttttattgtatctcttctagccgtgtctctagaagcacctgtaagttgcataatgtcttgtaaagttaacgattgttctttttttagtctttccattattatcagcaatcttttttgttgattcacctattgaactcccatcaaaaataagtaatcttaagtatatgaatataatagcttaaaacaacttaaatgtacactagtatgaagtgtacataaaatcagctttttttcattagaaataagttcctattaagtaacatatagatttaggtatttatcagcataaattgcattgggcgttttttttgactaatttacttttagatgatattataatcccacatcgtgaccgatcggtcacgatatgggatattatagaaagtaggtatgaaatgtcagaaacgattatgacgaattatgaacagtggctaaatatggctgaaatgccagagaataagcggaaaatattagaagctactattagactttattcaaaacaaggaatatccaacacttcaaccagtcaaatcgcgaaagaagccggtttttcaaaagcgctaatttttaagttttttacaaataagcatgatttaacgatgaatttacttacacctattttagatcatatattacctgcttttacttccgatttttttgaagattttgaaaaaaaagcagaagtaaaagagattattcattacatcgtttttaatcgttatcaatttctaatggaaaataaagagattgtcttaattttcttgtccgaaatactaataaacgaagagttacaacaagattttttctcatatattgattccaataataagaataattggacaagagaacattcccttttttcgaaaatagatgaaaaaatcacgttaacgagcttgttctcagcgattgccagtcagattcttatgttgtttgttcaatgtctgatttttaataaaaaaatgactgaacagcaacaaaatcaacgtttagaagaaattgtagacttaatttacaatggagttaaaaatagaaaggaataaaaataatgtatcttgcaataaaagaaattttacacaataaacttcgttacagccttgtcctagttacagttttccttatatcgtttatggtcttctttatgacaagcctagcaattggtttagttcgagataaccgaaccgcagcggataactgggattcaacaggagtagtactctcaaaatatgcaaataagaatctaacagcctcctttattactgaagataactataaagataagttgtcagatgacgcggtccccctaggatatatgtttgctgtaacaaatctaaaaaatgatgatacgacagtgaatatctcaatttttgctcaaaattggaacagttttattgcccctaaacttattgaaggtcattatcctgaaagtaagaatgaagttatcattgatcaatcgatggaaaattataatattaaaatgggcgatcagatacagttaaatggaagtactgacgaatataaagtcgtcggtataacgaatgacagtaaattttttaccgtgccggtcatttatactgatttgtctacctactggaagttacagcatacggataaaacaaccaaaaccatttcagcaattgttctaaacaatgatgttgatgtctctggggagggcttagtacaagtaaccgaacaagatatgatcagtaatattcctggctacacaccggaagtaaatgtgtttatgggaatgattatagctctggtagttattacttgtttagtagtcggtattttcatttacattatcatgattcaaaaactagggctttatggcattatgcgtgcacaaggtattcaatccaaaacaattatctggtctctattttgtcaaatattcgttttatcaggtatgggtgttttaatggcacttattggcgtatgggcagtaaaatttgttttaccggcaacccttttcttttaccctagctggctagcctattcacttctaggtttagcaatcattataatggctcttttgggagggctaatctcgttgcctaagattttgaaaattgatcctatagaagcgattggagaataaacaatgaatttagtagaaatgaagaatgtcaccaagacatatggaagtggacatacattaacacaagctctattccctaccaattttgaattaaaggaaggagagtttactgctattgttggtccttcaggatcaggaaaaacaactttcttgacgacactaggaaatttgcaaacaccaactagtggtcaaataattataaaaaataaagaaacaacacaaatgactgaaaaagaaaaaacaactttgcgttttaaggaatttggctttatcttacaagcatcaaatttgattccatttttgaatgttcaagaacagttagatttaatagatcgtttagacaagccaaattcaaaaaaaatgaatcgtgaagaactattaaatctgctggatctaaacaaggtattacgatcttatccgaaagatttatccggtggagagcgacaaagagcagcaattgctcgcgcattatataataacccaagcatcatattagctgatgaacccacagctagccttgatacagaacgtgcgcatcaagttgttgatctacttgcacgaattgctcacgagtataatcgaggtgtggttatgataacccatgacatgcgtttacttgataaagtcgaccaagtttacaccatgcaagatgggaaactgtcacgtggaaatgctttacaatataattgataataacgtatgatattcacataaaagtaaaatcccctcaatgatgcgttgataagatataaaactccctaactactatatagggagtttttatttgtatataagtgcatctttttgtcttcaggaagaaaaaaagtaatcccaaaattgtcgtaggatttcctagtaaaatagcagcagtgaagaataagtaaaacctatcctatatttatttgctttatattcattattttgtttctatactgaatgaagctcataaatagagtggacagaaaatcaggcgtttctgaacagtctatttttttatcttatttctataattttgattctattatgtgttcataaacccatatcaaaatctatgttcatttataccatcggtataaagttatgttacaataaaattaatgagggagtgatttttttgaaaataggatacgcccgggtatctactggtttacaaaatttggatttacaagaagacagcctaaataaatttggttgtgaaaaaatttttaccgatcatatgagtggggcaaaaagtaatcgaccaggattagaaatggcgattgattttgttcgctctggcgatacacttgtcgtttggcgattggatcgattaggacggaatatggaagatttgatttcaattgtcaatcgattgaatgaacgcggcgtaagttttcatagtcttcaggaaaatattacaatggataaatctagttcgactggtcagctaatgtttcatttgtttgcagcattcgcagaatttgaacgcaacctgattttagaaagatccgcagcaggacgagcagcagctcgagcaagagggcgatttggaggacgtcctgaaaaattaaaagcacatgacttagaattattaaagactctagttgatagtggaacacctattaaaactattgccgaacgttggaatgtttctcgaacaacgatttatcgttatttagataaaatggagggaaaagatggaaaaacaaacgctcactagtttttcagaacagcaaagaatagatgcgatgaaaaaatataaaattattgagccttatcttaataaacaaaaaacgataaaagaaatagctattaaaaataaagtacctactcgtacactctatcgctgggtacaaaaatatgaacatgatggtctagttggtttaattaggaagatacgaactgattttgagcaaattagggtttcagaagaagttagacaaaaaaatgaataaaacctttattgaaacaaaagaatataaacgatttgctgaattttgtgacgcatgtattaaatataagtatattggaatttgctatggtgctcctggcgtaggtaaaacattatcttcgaggtattactgtaattgggataatatagaaaaacaaattgcctagcatcgtgctgatgatattggaaaaaatgcaacagatgaaatattaagtgtaaataaagttttttatactgcaccaactgaaaagatgtctcgtgtcagttctgatattaacacaataactagtagaataggtctgactaaagcaatgcatatggtactaaaatacaatcaagaagatccttctgttcctaaaacctatgaagcaattgatttaattattgtcgatgaaattgatcggttaaagcttcagcatttagaacagctaagagatatttatgatagaaatgatctggcaatggttcttaacggtatgcctggtattgaaaaaaggttgtctcgttatccgcaactttactctcgcataggatttgctcatgaatttgataaccttagtaaggatgaaacacatcatattttggaatacaagtggtcagacttaggaattgatattaagttagaagatttttctgattatgaggctatcacaactatcattaaaattacaaaaggaaattttaggcttattcatcgtttatttgcatagattgatcgtattttaagaatcaatcaaatagataagattactgtagaagttgtcgaagcagcaagagatagtttagtgataggtatataaaaagctaccaaaaattggtagcttttgtcatttaatactaaaaatttttgccatttaaatagaaaagtgacattcacaacaactatcttgtgatggaaaaccatcatgtggaacttacagaagaaggcgtttgttatttcaaagacttaggaatagatattgacgcactgaaaaaacaatctggagcatttgtgaaaccttgcttagattggacagaacgaacatttcatttaggaggaaatctcgggaacgcgtttttccgatggtgtaaagagaaagaatatatcacattggatccagaaaacagaggtgttcgcttaactgctgaaggaaatttatttttcaagaaatttaaagcgagccaataggaaagtcgtttctaatacaataaaaaggttgtgacaaaaatcttgtcacaaccttttttcttatttcttgaatggaggtgtcccatacatttttggtgttactggttctaattttggtgcagcgccttcgatcttaggttctttcaaccattgatattcgccttctccgtccagtgctttgccactagcccaagaaccttcactactttggtctccctctgagaagttatagaagtcataagcaatgtcttttcgttctttgtcacgtgggaaagtacttgggactaagatcgaaccttctttttcttctaattctttcactgcacattcccatagattttgatgataactatctcttgcaaggagaacagacagcatgtcttttacgccacgatcatcaatcatttcgtaaatacgtgctacttgaagtcttccttgtgattcggcatttaaattagctctaaaatctgctaacaagttgccactcgcaatgatataggcaccgctccatggattgcccacgctgtcagcaggacgaggtcctaagccagctacgatcgcgtgctgtggattcattccagagataatggcaccaattgttggatctttttgcattgctgcttcttgatcttcaacaggcgcaccctctaataaacgagcaaccattgtcgccaacatttccacgtggccgatttcttctgttgcaatgtccatcagcatatctttatatttttcttctcctcggcagctccaaccttggaacaggtactgcatagctacactcatctcgccatattggccgccgatcagctcctgcagatatttcgcgattaatggattcggacgatctggttttgcctcaaactgcaattctttctggtgtctaaacatcaaaattcctcctaatctttttttaatacattctcattctgctatgaaaaattaaaaaattcaaagaaaacgctcgcgaattatataaagtgttggtatcattaataatttttcgatgatcataccttataaattgttattttcagaacaaaatgatatcgttatattaaaaccgatatcggttacattaaaatttggaggtaaaatatgaaaaaaatattgtttacaggattgttggcaagttcagcattgtttttattaggaggatgcggatcaagtaatacaagcgatgccagctcaagtgcagcaaattcttctgaaaaaacaagtgatggaagaaaaaatattgatttctggtccttttgggggtcgggcgcacgaaaagaagccatcgaagaaatcattgaggatttcaaccaatcacaagacgagatccatgtaaattataagtatcagccatggggggatatttggaccaaatctttatctgcaataacggctggaaatgcacctgatgttattgtacaggacataaattccgttgcgcaaagagcagaagcacagcaagcaaccaatctctctgagtatgtagataaagacacttctaaggatttttatccgcagctttgggatacagtagaatataaaggtgatccttatgccatccctttcaatacagatacacaagtcattttttataataaaaagttatttaaagaagctggaatcagcgaacaagatctaccgacaacttgggatgaattagaagaaacagcacgtaaactagataaaaaagatggaaaagagtttacgcgtatcggtttttatccattatggaatttaggcgcggatgtatgggcgctaaacgcagacaacgggactagttggtttgataaggacgaaaaagtcaagattgatactaaaaacaaagtggaagccttggaatggattcaagactggcaggattattatggaaaaaatacaatcaacaaattagaagcagaatttggttctggtgtgtctgatccatttatttctggattagtagccatgcgcgcccaaaacatcaattattactctagcttgatggaaaacgcaccggatgattttgattttggcgtgatgcagcttccagaaaaagaggaaggttcaggtcattggtcatggggtggcggattcgtcttggaagtaccatacggagcaaaagatcctgaagcctcttatgaattcatcaaatatctttcttctccagaagtacaagaaaaattcggcgaaaaaagttttgacatcatggcaagcaagacagccaacgagaatttagtgaataatgacaacctaacggacaaagggaaaatgatctatcaaatggcggacgaaaactttaaaaatacggtgatcacaccagttcctttagatgcaccggattatacgacattagtgaatgaacagatcgaccagattcttttaggaacaaaatcagcaaaagaaggattggcagatgcacaaaaagcagtagagaacttagtcaagcaaaatcaataatccgtttttgactgtctaggtaaagaggaggcaagaaaatttgaagcgtttatctatccgaaagaaaaaagaagcaagatgggcctatttatttatctcgccttttattatcggttttttaatctttatgctagggcctatgcttttttcagttattggtagtttcaccgattataatttgacatccaagatgaatttcattggtctagcaaatttcaaaagaatgttcgttcatgacgatttattttggaaatcgttatacaacaccgtttatttcgtcatcttcaatgtaccgctgacgacgattttcagtgtgtttttagccacagtactcaatcaaaaaatcaaaggaatcagtgtattccgtacagttttctatttaccggcagtcttatcaggagtagcagtctacatcttatggatgcagctgctttctccatctgcaggattgatcaacacatttctgggctggttccacatccctggaccagcttggttgtttgatccacaatggacgaaaccagcgttgattttgatgaaaatatggagttctggaggagcaatgctactttacttagctacattacaaaatgttcctagatctttatatgaatcagcagaaatcgatggagcaggcgtttggggaaagttcaaaagtattactttgccattaatcactcctattattttttacgatgtgatcacctctacgatcggttctttccaaatttttcaagaagcttatgtcatgacgaaaaatggaacaggtgggcctgcaaattccttgcttttttataatctgcatatgtggaacaaggcgttcgtcgcttttgatatggggtatgcgatggctatgtcgatgatcctatttctgatcgttttggttctgacttttgtcaatttgaagcttgcacctaaatgggtctattattctggaggtgacggcaaatgatggattattttaaaaagaccagtgtgaatcggcaatcaaaaaaaatgctaagctatgtgcttatgacggtaataggaattattttgctcattccattgctttggatggtatttacttcattgaaaccaatggaagaaatcgttcgttatcctccgacctttttcccagaaaaaatcgtatgggaaaactatctggatacgattgccgcatttcctttttggcgctatgcaagaaatacattattcatcactgtgctagtagtgattggtaatgtcctttcgaattcttttattgcttatggatttgcgaagcttgattttcctgggaaaaagctgatgtttgctttggttctttctacgatgatgatcccagggtttgtaacgatgattcctcaatatgtattattctccaagatcggctgggtaggtacttatttgcccctgatcgttccatcgttcttcggcaatgcgttcaatatatttctgatgcgtcaattttacttatcgatcaataatgaattgatcgaagctgctgaaatcgacggagcgaatcatttgtatatttggagtcatttgatgcttccattgacgaaacctgctttgatcacgattgcaatcaattccttcaatgcggcttggaatgatttcttaggtcctcttttatatatccaagatcaagaaaaatacacgttgcagattggcttgcaagtttttcagaaccaagcgacgacacaatggaattatctgatggcaggagcaacacttgtcttgatcccgacgatcttgctgttcttttttgcacaacgttatttcattgaaggaatggatttgacaggaggatcaaaaggatgatgaatcggtcgattggtaaaagagccaatgattatttcttagaaatcattgaatggataccacgtcttatccagttacagctactgtggttcctgtgcgtcttgcctgttttcacattgggatctgcaagtcgaacagttctgtatatgatttattattacaaaaaaaataaagagaaaaagctcagttcattatactggaagaagttccgtgagaatatttctctttatggaaagcaagatagtttagcaagtagttatttttttcttttattcatcgattatcggattttccattattggggtgggagaattggctatacattgatgtatactacgttgtttttgcttctattaagtgcggttctttttagttacaaaatcttgcttcaactggaaaatcaaaaagaagtctcttggattgcagcatttttcttgttttttaatgattttaaaagtgcacttttttatttagcaggcacgtcgatacttctgattgtattatggtttgcaggaccaatctaccttgctttattaggttttagcttcttgttttattttcaagtcctgctttttatccatcgtacgcaagaaaagggtcttaaaaaggaggaataacatgctgcgtttgattgctaaaatcgatgatcgtattatcaataagttcgctaagcaacgagaaacggacaatcggaaaatcaatttcttgaaatttatcagtaatatctctaatggcggttttatttggctgctccttgctacggttttagttttggtacctgatacaagagaatatggtctagctattcttataggcagtctaatctatttttttgttggtctacttctcattaaaaaaacgacaaggcggaaacgaccctatgaaaaaaatcgtcggcttatcctttacacaagtaaaccgaagacttcttcttttccttcagggcatacggcacttgcttttttatctgtagcagcgttgttcgagttaagtcgtattgcaggaatattagcttttctatttgcttgtttgatcgcttattcaagaatttttttacttttacattatcctactgatgttttaggaggagctattttaggaagtgttatcggcatcttgtgtgctgccgttatctgaatcaattgcatgaataaagcatgagtgcgtaaatacgcattcgtgctttatttttttgtttttcagggaaacagtcggggattatttacctgtcttaataacttaagttctgttaaatgagaatgttataaaactttataatctaattttaataataaatgttgtataattggtgttttttaactaaaatggatattatttgatttaaagttaaaattaaattagattataattagatagacgttgtttttggtgtttgttgtgaaagaagacacatgttttagaaaggagtataagaatgtgaaaggggtaaaattgaagcttttgcagttagcagctgtcagtctgctatttggaccgtatttccagtctgtctatcatatgacagcattggatgtagctgctgagtcaacagaagtgaaggaggatgaggtatttctagatgaggattatgcaaaaatcgaagggaggtatatcgaaaaagaagaaacgtttgaatggcatctggcttttgaaaagaaagagagtgcgaacgaaggtagaatacgtttagcaatcgatacagctgctgccggtattggtaccgtaaaaaacgttcggggaacaggtctctcctcttacgatgaagatggagaagacttaaaagtcgagacaatcgatggtcaagaatggtatgtcggaaaattttattcaaaagaagctgagaccggcacattggtttttgaaacagaaaagattccagatgtgaatgaaggggaactacctcttcaagtggtggtcgatgaaagaatagctaatcaagaattacaagaaaatgaaacagatacagaggattccgctgaaaatcaacgtagcgaagaaaatgaaacggaagagctggacacaccaatcgtgcccagcggtcaagcactccaacgcattcaacgccggttattcaacggtattttagaacgtcttggaccaacagctacgcaagatccatatgaatatatctatcctagcggaatagctgaaaacgatcagcaccgctatccacgatttacaacgaatgactatacaaaagtattaggaaattggtcacaaagcaatgaacgctatcagggagaaaaaggctcaccatatgatggagagaacttgatcgatgatagtgattacacaatcgggggagcgaactggcgaaattatgactatgcggctgataatggatcaactgcaggtgaagaagatgtaaatgttccggctcaaaccgttcagctttggggagatgaacggaattttgaaaacagttacttggattataacggagcgtatatcaaaaaatgggtagaacctgttctatcaaacaacccaacatctgatctacatcctgaagatgcaacgacactttataacgtttatctagatgtgattggaagtgagaaacaagaaatcagcccgatcgatatcgtttttgttctagataaatcagccagtatgaatgaggggacactagaaggcggaggccagagtaaaaatgcggcactgatagaagcagtaaatgaaattagtgaaaatctgctatccgacccaaatatggatattcggatcggtatggtgaatttttatcataatagtacagtcatcaataaccaggaacaaatcagttcggacatctttccgttgacaaatgacatcaatcgtttaacgggaagtgagaatacagcactaaatcgtacacccatcggaggaacgccgcttacactaggacttaaaaatggctatgaaacattgtacgcggataatggcggagaaaatagaaatcccgaaaagatcctgatcgtcgtaggagacggaacacccaccttcagttatgctccaattgaaagaagtaacagaccagattttaccaactgggcagttatgaataatatgatcgctcgagatacaggcgatttatttaaaaactttgaaacatattctggaaatacatcaggggcaggttttagttatcctgttgtctatccttcagaatttaatcgtccagaagatacgtgggattataattatcgttacggagaagtaaaagaaggtgatgataaagcgtttcactgggttggtactggtgctgctagcaatggtactacaggagaaccggatacccaagaaaaatcatctgccatcaatactgttgcatatcatcattggctgaaaaacaagtaccaagagaacccaccaagtattttctccattgggttaggcattgacggaagtgttgccggcagacagcggctcgatgcaattggacgaaatgtattaaaaaacattgctgatttaaacgatgatggcacaacaccgcgttattacgatgcgaacaacaagaatgacatcattacagccttggaggacatctcctctactttcaagaaaacgatccaacaagccacactttatgatgaaactggatttaatgtttcaccgtttggagctggcagatcggcggatattcagttttaccatctagatccaggagaaaatggcatgaagtaccaagaaccagaaatatgggatgtcacacgtcatgggcaagcaccgccagaagtagtggcgacaccgacaacgtatgtcggacgagaaaatcaagcctataaattttctccgatttctttaggtgaaggggaaatggtcaggatcaagtatcaagtaaaactggatgcaggtgcacaagacgggaatttctatgctgtaaataatcaggcatatatccaaaatctggaagataatgataacgatatcacatctggtcgaatgtatttcccaacgtcctctattcgttatgaacacaaagaccgtaatttgcaagttagcaaaacagggcaaaatggggaacctttagcaggagtcgaatttgctctatatgatcaggacccggatagcggggatgtggaaccgattgaaacgagaacaactaccaacgatggactcgcaatctttgaaacgaagatccctgtgctgggggatgaaacaggtgctgtcagtgatattttctggatcagagagatcgctggaccgccacgttatcagttagtggatgagacgtatcaattccaaatcaaaaaatatagttccagcggagatacagcgcttggtcactatgagttggtagcagcaaatacttcaggagtaagagttggtggagaagaaggtagcgatcctgattcttattatgaaggcgaataccacaaactttcaattgttcaaaatgtcaatgaggacgaaacggattatgaagacttgtatgtcaaactggaaatgcggaatgaattcaagccagtccacatgaacatcaataaattcattgaaggaagcactacgccaatcaatggggcagagtttgaactttatcaaaccgatggaagcggacttgaaattggaacaccggtagctaaaggaatctctggtgcaaatgaagcagacgaagagaaaggaatgctcacgttctattcagtaaatgaaaatggagaatatttgctcgtggagggtgagaaagtcattcatcctattggagaaccagattcatttattcatacggacagtgaagaaaatgccaactatgcagaatacaaaatcgttgaaagtcaaagcccagaaggcttcaaagaacctagcgaaaacgacacatggatcttgcgactttacgacaatgaaacaggcatcatccagcttagacgaacaggtgaagcaagttggcaatatctcacccattcaacagacgaagagggccgattatgggtggcattcactgcttacaatacgtttgattaccgggagatccgggttagaaaattagatcatgaaggtaatcctttagatggtgcaggttttgacattaggaaaataggagattcttccttcccgctgtatcgagcatacacaggcaatccattagaaccagaagaaacgaaacgtttgtctggaatcggttacttctatctttatacgatcggtgtagagaagtacgtcgatttagaatacagtcaaccactccgtttgtctatcggtgaatatgaagtttcggaatctgttgcaccaaatgggtatcaattgtctgatcaagtattccagtttgcactgaatgaagaagggaaatttgtcattggagagacagtcatcgaagacgaaactgatccgttaccggagggttatgacatcatcgatggtgtattacaagtaaccttagaagatgaactagcaccaatcgatctggaacttttgaaagttgacagtatgagtagtcgacgtcttgaaggcgcagaattttcaattgagaaacaaaatagtgcaggagactatgaactcatcgacggaggcttggcaccagatccaaacgattcttccctattcaatgctttggatttgacggaaggattctatcggatcaaggaagtgaagtcgccggacggctacaggaaacttccaggctactttattttagaaattagttatcgagaagaaccagaagtggaaaatgatcgggtcgttccaggaaaagaagccgggacactaaaagttgagatttcttattatccaaacgaagaagcagagactcctgatctgcagcaagaattagagtatgaacttttggatacgaaccgaatcaggctacagcttagtgtcgggaatgatcctgaaaatccattgcctgctacagggggatctggacgattattctatatcctgattgctgcattcttcgtggcacttgccggtgcagcctatggtttgtatgtcagacaatctaaaaaggagggggcaaggtaatgaaaaagctgttgtgtttgatgcttcaattacttgttttactgccatttgtagcagtccttcttcctcaaacgatgtcggcagaagaattaggggaagacgttgtggaattcgtattgcataaacggatgattcgagatatcgattataacgaccaatttgaattccatgaaaatgacggtctggctatctctgaggaagcgggaaaaacagcagatatcatttcgcagacagttccgctaaatggagcgacattcgccgtttacgatatgaccgattattatcatgacaaaaaagctgctgagaacatgacctctagagaattcgtccagcaaatcgctgaaacgagcagaaacaatatccgtcagttaatcacagaagaaagacttgctcaggttggggaatcggtaacgactggaaaagatacggttggtggattaggagatgggattgcacgcatccaagtacctaagaaaaaccaagatcgagatgcagtttatttgatttttgaagaatcaattgatccggaaatcgggttgaatgtggatatcgatcaaacagcgatcccgattgctgctgttttgccaatctatcatccaacagaaccaaccgaggaactgcaagaaatccatatctatcctaaaaatgtcggttatttaagagatccatactttttcaagtatggacgacaaagaggaacaactgaaaaaggacgccccttagaaggtgctgtttttgctctgtatcagataatagaaggcgaaaaatattatttagacatggctcctgcgaatgacttgaaaaatcaatggatcaaaccagcaaacaacgatcctttgaatgataaaaatgtaagcaaattcatttcagataaagacggtctagtcacgacaggtcaacgattcttgccctctggtacctattattttgaggaattgaaaagtgtagaagggtacgaaatggacgaagcaagtaagcaaatcgaggtcattgtccctgaatcttgggtggatgcagatggacagccgcaatatgtaatggtcaatgggcagaagatggctgaattggaatccggaaaagttccagcctctgcctatgaatcagcaacaccacgcgtgtataacgagaccataaaagaaacaacggacaaaccgaaagaaccaagtggaccaagcaatccaaatcaacctgtgaaagggtccgtatttccacaaaccaatgaagcaagaacattgatttctttgttaggaatccttttgttgttaggtgctgttttattaataaaaaaagaacggggagaaaaaaatgaataaaaaaatgatgaccatggggatgagtgcgctgttgctcgcagctgtaggtttaggaagttttggaaatggaaaattagttcacgctgaagaagtcacggaaaaaccaagtgaagtgacaatcacattacacaaaaaagcattcacgactgtgcctgaagaacgaccgaacagcgggttgatatcagatgattttggcaatgaaaatcttccaggcgtcgattttgaaatgtttgatgttacagatgtctattataatttgctgaaagatgaccctagaacaactgacatagatgatgatgggttagaacctgccgctgcgattgctttgatccaatcagatcacacagcagcatggtttgtatcttatggtatcgaaagtatggataagcagacgactggcgaaaatggtgaagctgtttttgaaaaggtacaggtaactgaaacaacgggagaattaagagataaagtctatctcttcttagaaacatattcaccagctcatatttcaagaatcgcgtctccaatggttgtcatgatgccagttatgatgccagatattattggcggtgtatgggatggaacctcttggaaagatacgtacaacaccgatgtacacttgtatcctaaaaatgaaatccaagattcttccaaagaaatgaatgtagatgaagcggacgttagaacagtgacgattcgcaatgaaaatggtgaagaaacgatccgatatgttgacttggaaaaaggaaaaacagtttcttatacaataactgcaccgattccttactttattgatgaaatcaatgaggacaatagaacagtcatcacgcatttcacgatcacagatacgccaacagaaggtttgagttattttgatcaggatatccttgtacaagcaggagatacaacactgataaaagatactgattatacagtaacaaaagcgggtaacggttttgtcgtggagatcattcttgaaacaggaggtataccgaacagagcaacgcttgaaaaattagggaatcatcgcggcgggaaattaactgttacctatgacttacaagtcaatgcagtcatcaatgcagacgaattccataacaatacagcgttgatcgaaatcggtagaggtgacgagtatgactacaacgaacgtcgcgtaccaccagaagaagtaacgactggcgggagaagatttgaaaagtttgatgcttcaagtaatgctttactagacggtgcaagatttgaattgtggaacgaagagaaaactgcttatgctgttttctataaagatggcgtacgattacctatttatgagtcaggtgctgatgcagaagaaatcacaatcgattggataagtgataatagtgtagaggcaacagaatttgtctcaaatgaccaaggatacttcgaagttgttggattagattacggaacatatttcatgaaagaaacagtagcaccagaaggatatgttttaccaacaggtgaagcagctttcacagagttcaatgtagaacttggtagctatgatgatgaacttgtgattgtgggctatgagtatccaggagcagcacgcgtaccaaacgtaagacaaggatttcttccttctactggaggaaacgggatcttagcattcttgctgatcggtctaagtttgatgattggggcctacagctggtaccgtaaatctaaaatgaagtctgaagtataagcaacaaaaataagctgcagcaatcggtttttctaaaggttgctgcggtttttttaaataagaaggtgaagaaaatgaaaaagaaaacagagaaaagacctcaaacaaaaatcagtatattattacaattattcatggcagtgatgttttttacaggagctgcagtttttacatatccatttttagctgatgctctcagcaattatttggaccaaagaaggatcgagaattatcaaaaacagcttgcacgagagaaagaagaaaaaaatgagcaacgattagcggtacaagaaaagaaaaatcaggcgcttgctcgtacggcagccatcccaggaatgggtcaagtcaaagatccttttgaacaagcggttagagatgtccgaaatccaggaaaagaatactacgaaaaacatatgatcggagcaatctatattccgaaaatcaatgttagcttgcctttattcgatgaaacaaatgatcttttattagatagaggagcgacagttctacaaggtacctcttttccaattggaggagaaagtacacattccgtcattaccgcccatagcggtgttgctgagaaaaaattgtttacagatcttgaaaaaatggagaaaaatgaccgtttctatcttgaagtatatggtcgtatgctcgcttatgaagtcgttgagaaaatcgttgtccttccaacaaaaacagatacattagcaatcagagaaaaacaggatctggtcacacttattacttgcacaccttatactgtgaacacccacaggttactggtgacaggaaagcgagtcccttttacagaagaagcctcttcgaagatggaaaagacaaaaagataccatctttatcgattacttgcgctcttactaggggtattgttaatactaactcttttcggttattggggttatcgaaaatttaaaagacaaaaacaaccaaagaaaaataacagatgatagaccaattattaagaataacataataaatttcagctgcttggaagagacaaaagcgattaaatcgcctattttcagttttttttaacgttttctaaaatggcattttacaggtaagccaacttgtttcacaaaggcttctttgatattgtagaagcaagaagaaagatggagggattttttatggcaaaaatcatggtagtcgaggatgaagaaatcattcgacaattgattatggaagaacttgagaaatggcaattcgaaacctttggaacgaccgacttcaaccaagtattttcagactttgaaagagaagaaccacagcttgtattgctagacatcaatcttcctgttttggatgggtattattggtgtcaaaaaatacgtgaaatatcgaaagtaccgatcatttttatctccagcaggaatacgaatatggacatgatcatggccatgaacatgggagcagatgattttgtgacaaagcctttccaaatcgatgtactaattgccaaaatcaatgcgttgcttcgccgttcttataattacacagaattatccagtgaaatgatgagccataatggtattacgttgaatgtcgacaacggaagtatggagatcaatggagagatcattgatttgagcaaaaatgaataccgcctgctatttattttgatgaaacacaacggaaagatcttaagccgtgaaaaattgctgcgagcactttgggatgacgagcggtttgtagatgacaatacattgacagtgaacatcaatcggttacgccgaaaaatcgaacaggcaggtatccaaggctatatcgaaacaaaagtaggacagggatatatcgttccctgaaaggatgatcggttaagatgaatttctttaaatatttgaaagatcagtggacattaatcttgggatggctgttttttattgccttaacgatctttgtgatgtggctagccccaaatatcaaagtggatttgagcacgattacttatttagctttgatcgagggcgtctttctgattttttatctgctaggtggctacttgagcaaaagaagatggtgggggaagttagctgacatacaaaaaacatctcctttgcaaaattatttgagtggcgggcggacagaagaagaaaaactggtggaagaatatatcaatcagctgattcgcgaacatcaagaagtgatgcaatcagcaatcagcaatcaacaagaccaaaaagattatattgactcatgggtccatgagatcaaagtaccactttccgcttccaagttactggttcgttcgatcgagttcgatattgacgatcaaaagtataccttactcgaaaatgaattatcaaaaatcgacgaatacgtagagcaagtcttgtattatgcaagactcgacagtttctcgcgggactatcttatccaagagtatggattgaaaggaatcatccagcctgtgatacgcagtcaggccaattattttatccaaaaaaatcttcgctacgaaatcattggtgaggatcatactgttctgactgatgctaaatgggtcgcttttatcttcaaccaactgcttagcaatgccatcaaatatacgccggatcacggaaatatcatggtgagcataaaaaaggaagcgcaaggagtcagcctttctgttaaagattcaggaatcggtatcccggaggaagatttgaaacgaatctttgataagggatttactggaagaaatggacgacttagtaaaacgcattcaacaggattaggcctgtatttggcaaaaaatctggcagaaaaattaggtatccaattgacggctgaatcaactgaaggaaaagggacgacaatgactttatttttcccaatcttaaatttttataatgaaaaacgttagaaaatcgttagaaacgaaaaaaaacgcttgtgttgttaacgttttcgctgataagtttcttatcatgtgaaataaaaggagattggttatggaaattttaatagcattagtccctatgttggcatggggtagtattggtttagtaagtggtaaaattggtggcgatgccaatcaacaaacactaggaatgacgattggtgcatttctgttttctttagttgtctttttcgttgttagtcctgtaatcaccccttggattttcttgatcggatttttatctggcttagcttggagtgttggacaaaatggacaattccatggaatgaagtacatgggtgtttctgtagggttaccattgtctactggttttcaattaattttgaatacgattgcgggagccgttttcttccaagaatggacacaaacgaaagattatgtatacggtattattgctttagctcttcttgtaagcggtgcgtatttgacggcacgacaagatgacgaaggaaaaatagatacagttaataaaatgcttgattttggtaagggctttagagcattgatcttctctacgattggttatggcgtatatacgatcattgtcaactgggcgaatttggatgcgatgtcaattatcttacctcaaagtatcggaatgatcttaggcgcaagcttctttgccttccgtaaagttaaagtagatcaatttgtatggaaaaacatgatctgtggattattatggggcttgggtaatatctgtatgcttcttacagtcaaatcccttggtttagctgttggattctcactttcacaaatggggatcattatttctactttaggtgggattttcatccttggcgaaagaaaaacgaaaaaagagctcatttatgttattgttggttgccttttagtcattttaggtggtatccttttagggtacatgaaaacagtttaatcactgttttccaacctaaaatggggaggaacttcaatggatttgtttcgtaagaaagagatcaatctcaatcatacgagtgagatgaaaaaagaactaaaaacgtctgatttgatcatgcttggaattggcgcgatcatcggtacgggaatatttgtggtgacaggggttgcggccaatcaaaatgctggtccagcactgtcactttcatttgtcttagctgcaatcgttgtcattttgtctggactgagtttcgcagagtttgcttcgcgagtgccagtgatcggtgggccatatgcctatctgtatgttgtctttggtgaatttgctgcctggttgacagggtggttgttgatcggggaatttttgctagcagtttcctctgtggcttccggctggtctggctatatgcaaggtttcttgaaaagcttaggggccgaacttccacaagcattaactggcgggtacaatccggaaaatggtacatacattgacttgattgcggtgctcgtagtgatattcgtcacttacatcgtgtcgcttgaagccaagaaagcattacgtttgaataatgtcatggtatatgtcaaatttggtatcatcgcgttgtttatcattgtagggatatttttcgttaagcctgataattggcagccattcatgccttttggtttttccggtgtgctagatggtgcagctcttgttttttttgctttcttgggatttgatgctgttgcaatggcagctgaggaagtcaaaaatccacaaaaagacgtaccaagagggattattggttcgatactgatcgctacggtcctttacattatcgtgacgctgattttgacaggaatcgttccttatactgaactaggcgttaatgatccagtggcctttgccatgaggtatgtaggacatgggacagttggcgcagtgatcgctgtaggggcaatcttgacattgctgacggtgacgatctcgatgatgtattcactcgctcgtttgttgtttgctgtcagcaaggatggtttgctgcctaaatttatgacagaaatcgatcaaaagcatcgtacaccgaaaaaagcgacttatgccgctggtgtggcagccatattctttgccggatttttcccattgaatgtattagcggaactaacgaatatcatggcgcttgcctatttgatgctagttagtctaggcttactgaagttaagaaaaatgtttggcaaaccaaaagcaggagaattcaaagtgccattcgttcctatcttgccaatcgtctcgatcttgacttgtatcgtcttgatgcttcgtctgcaaacggtgacttggatcgtgttcggtatcgtaatggttattggactgatcatttattttggctatggctatggacacagcaagatgaacgagaaatagactccaatggagaagttagaagaaagataagaaaaacgcccaccaacagtgtaataaactgttgatgggcgtttgttttagtaacgaacgaaaaatggtctattgggttaaatccaaaagtttttgtttcagatcttcttccatgtgtccaagttctacttctgcatgacgacgtttttcttttccttctttttggatacgcaaagtttcttggatcgtttcgatcaaatcgttttgtgtagtttgcagggtctcaatatccacgattccgcgttcgttttctttcgctgtttcgatggctgagattttcagcatctctgaatttttcttcaataagtcgtttgttgtttcagagacttggcgttgagcggtcactgcatctttttgacgaagcaaagtcaatgcgatcacgacttggtttttccacagcggaatggctgtagcgatagatgcttggatcttttcagctaaggcttgattcgtgttttgaatcaagcggatttgtggggcttgctgaatcgtgatctgtctagctaggcgaaggtcatgtgtacgtttatccagacgatctaggaattgtgtataatcgttggcaatctggacatccatctggtcaccagtttcttctgcttttttcattgcttctggaatgatcgttgattgaagttcttccattttcaattctccagcagcaatataaatattcaatgcatcaaagtagtctttgtttttttggtaaagctgttctaacatcagattatcttttaatagtccgtctttttctttatctaatttcactgagatcttgtcgatttgtgcaccaattttttgatattttgctgtcacttcataaatcgattgtttgaccttaccgaagacacgttggaagatatttccttctccggcacgcagttcgtcagggttggcttcttggagacggtacattagttcagtcaacgaatctccgactgggccaatatcttgagcttgtacgtgattcaacattgattgtgagaactcacttaatttcgcttgagcagctgagccatagctgatgacagactgtgcatcattggcatcgatttttgctgccagctgttttgcttgttcttgacgttccgccggtagtttgtcaattaagcgagcagctgtctgctgctcttggagctgatcgatctccgcttgttgtgaagtggtcagcgtatctgttggggttgaaaacgggttgttcaataagtcttcaagtgtatcgttaactggtgtgacatcttttgtttcagtcggtttatgatccataaaaaattcctccttgtcgaatctgttctcgattcttacatgaatatctctactttagaaaaagtactcgaaacaaccagacatcatctgaatgttccgagtcttttttatgaacaaaagagttactctttttgttctggttcatgtttattatcacgctttaagctttgtttcgcaacagatatctctacgtcgatgtcgtctaggtcatcagcgacgaatttttgataatcttgtgcgatcaaagctgacagctggtcgatgatctgcgcgctttcttctagcttttcataggtctgtttgtttttgatctcatggtcattgatctcattatacttatttgtcaaatcaactagattcggcagatgcgtataaagaaactgacttgcttcatgcagtcggtttggttctttcaccaattctttgaataaagcttttgctgctttgactgggtcatggcggagatcgattgctttaagtttggctgtctgctgcatattcatttgcaattgattgatctcattttttgtttgattcattgtttgtcgaaaaaatgagatttcattcgctgtcataccgtttttttcatagtgagtttcaagttcgtcagtcagtgcaggaatttcttcttgttttccctttttcctgcgcgaaccgaagagcccccacaaaactaaaactacgcctatcaataatagtcctagaacaaaagaaaaaccattatttcggacaaagagaaacagcaagaccagtgctagtagccacggccaatttcgttttatcataataagccctccaagtcatttatcattgagtattgaattctttccgttattcgattacattcttattttagcatactgactactagaaagagtatcggactaaagaaggattttctatatttagagaaaatctaaggtttatctatggtaaactaatagggagttttcgagaaaaattgaaaaatgaaaaaaaagcagttatgattacaaagaaagcaggagaagatatgctgaacaatgagcaatttgaagaaaaaacaatcagtcgcaaagaaatctatagcgggaaaattatcgatgttgctgtagatgaagttcgtttaccagacggaggaacttcgaagagggaactggtatttcatcctggcggtgttgggatcattgcttttgatgaacatgaccgcctgctccttgtcaaacagtttcgaaagcctttagaaaaagtgatcttggagatcccagctggaaaaatcgatccaggagaaggaaaaaatcctgaaatgactgcagccagagaattagaagaagaaaccggctatcgtgcgaagtcgctgagccatcttacttcgatgtatctttcaccaggttttgcaaatgaagtccttcatatttatcatgcacaaggagtagagaaggtcgagaatcctttagctcaagatgaagacgaagtactggagctgtatcatctaactcttgaagaggcacaacaagcgatgaaagatcagttgatttgtgatgcaaagacgatttatgcgattcaatactgggaattattgaccaaaggaaagtagagggatcggcttatggccaaaggaccgcttattacgcgaagcgaacttcgcaagcgacaacaagcacaagcaagcgagtcattaaaaaaacagcgaaaagcagaaacagcttatcagcaagaagaaaaaaagattgccagcttttatcgtaaagaaagcaaaaagaataaaccaatcacgaaaacaaggatcagtgaacgagaaaagacgaccaaatggaactcttttttgatgaaatctcttattattgttatcctaatgttatgtgtggtttttttagcaatcgcatttatatagaaagaaggaattaaaaagatgaaaatcggtattatcggcgcaatggaagaagaagtaaaaattttgagagagaacctaagcgaaccattatcatgggaacgcgcaggcgctttatttatttcaggttcattaggtaaccacgaagtgatcgtcgtacgttccggtataggaaaagtcttagcatctattaccacaagtctgttgatccaacaatacggcgtgaacatggtgatcaatacaggttcagctggcgggatcggtgaaggtttacaagtaggcgacattgttatatcagacaaagtagcttactttgatgcagatgcaacaggatttggctacaaaccaggtcaattaccaggaatgcctctatattatgaagcaagcacatatttgcgcagtgaaatggctaaagcagcaaaagcaacggatttgaatgcaaaagaaggattgatcgttacaggcgatacatttgtcgactctccagataaaatcaaagaaatcttaacgaatttccctgaagctttagcttgtgaaatggaaggagccgctgttggacagacggcccgtcagttcaatatcccatttttgatcgtacgtgcaatgagtgacacagcagatcactcggcgacacaaagctttgacgaatttatcgaagacgcaggcaagcgatcagcagaaatggtgatcgaatttgtcaaacatctcgtataaggaggactaagatgaacgcattgatttcgattgactatacctatgattttgttgcagaggatggaaagctgacgactggtgcagcaggtcaagcaattgaaaaaaagctgactgcccacacaaaaaagtttatggagcaaaaggattttgtcatttttgccattgatgcacatgatccaaaagattctttccatccagagaaccgcttatttcctccgcataatgtgataggaacgagtggacgggaattgtacggctctttaaaaaatttgtaccaagagcatgagcagcaggaaaatgtttattggatagacaaacggcattattccgcttttagtggaacagatctagacattcgtttgcgagaacgtcagatcacagatgtttatttgtccggcgtgtgtacagatatttgtgtgttgcatacagcagttgatgcgtataatctaggatacaaactccatattttcaaagatgccgtggcaagttttgatcctgtcggacacgaatgggcattgagacattttgaatccgcgttaggtgcagagattctataaaaaaacaaaactttttttaaaataaaaatcaaaaaataataaaagaagagcgtaaaacgaattacattgttttgcgctcttcttttatttgttattttttatcaaaaatataatttcaactataataaatccctttattattaacaactaaagttatatttttctttttataaaatatcacttattataattttgttttttattgacagcaaaaataaattaggtaatactttaggtaaacgctttctaacttgtttcaggagggatggacttgataaaaaaacgaataaaatacagcgcactaatgatgaatatcctcatgcttagtacctcgattttgacttctgtcgttgaagttgctgctaacgaacagactgtgaacgaacaaaatgcacacgtgaacagcaaagaaacgtcaatattggaggaagaatcaacggctagtgaagagaaggatgtggaagaaggaaatgatcctatgataaaagaatcagaaaatgaaaaggaagaaaagcaatctgatgaagttcctgaagagtggaaaggggtagttttcggagaaagcacaagtgccagtagatatgcgattgaaccattagaagacggcgtgcggctttcttccacgaataacggtgggaaattccagtcaagcggatcagatggaatgacctattattatcaagccattccgaaagataccaattttaggatacgggcgacgattgaaatagaatcttggacctatacgaatgctcaagaaggatttgctttgatggtgagagacacagtgccaaaagatcatttgtttgggcaagcattttattcgaattcatttgctatactgggcagtcggatcgaatatgtctgggactcggatagacaagaagtggtcaacacgaacggcagtaaatatacgatgcgacttggattggggacacgggcaatcacagggatatcatctgaagatcctcaagccgcacctgctcctgggagtgtctcagtggaaacaacgcctttagagacttcagcagggctcttagaaaaagaagcaggttcttataatatattcggaaacggtcatgggaatctgtttccggctacggattcgattactaaactagatgtagagatgaaaaaaacgaacactggtttagaggcatattattacgatcctgaaacaggggaagaactagcttctaacatcatgtatgactgggaaaagctatatgcttccgatgaatcggttatctatgcaggatttgctgcagcaaggaatatgacgatcaaggtagaaggaatcgaagtggcttactcagatcctgcgacagatcctcctggacaagaaaggcccactcgcttgattgatccgatttacactgtgacctctagtaatcattcaggaaaccaagaccatactatgtcctttagagcaaatgctgacggattattaacaatcaaaaatcaagcaacaggagaggtacttgagaacgcgaaagacttggcaatcactacaaatcgggaatttgattatcagacaaaactgatggaaggaacgaatttactttcagttttacgccagataaaaactatccgccagaagaatacgtagagatggctagttatgaaacaaaggagatcctgcatacagttgactaccataaacctaaatactcgacagtttatgtaacaccggaagggtcagatacaggaagcggaagcagacaaaatccgttatctctgacgcaagcattgagatacgcatatgctgggcagacaatcgtcctggctcctggaacttattcctttgaaagaggattaacgattccaaaaggagttaacgggactagagaaaacccgattcaattgattgcagagaaaaatcaagaaaacaagcgacctgtacttgattttaaaggaactggaaatgggatgacactgtttagtcactactgggttttacgtgggtttgacgttacaaatagtgctgctatgcaaaaaggattgcagatttctggaaaccataatttgattgaagagattcatgcttatcggaatggaaatacaggaatccaaatcagtggtagctcaaatgatcctttcgaagcatggccagcgcataacttagtcaagaactgtacatcttttgaaaatgctgacccgggatttgaagatgccgatggatttgcggccaaactgacgacaggagaagggaatgtatttgacggttgtatcgcttatcataatgcagatgatggttgggatctttttgctaaaaatgaaacaggttcgatcgggaaagtagtcatcaaaaactcagttgcttatcgaaacggttgggtaccgggagttgaaggagaagggaacggcaatggattcaaaatgggtggttcctctttatcgggccctcatgaattgatcaatagtttgtctttcgaaaatcttgcgaaaggaatcgattccaatagtggaacagatattatcgtcaatagcagtacaagcttcaacaatggttcctataatgtggctctttatacctcttcggcaagaaacacagacttccatgcttctggtatcttatctttccgaacagaaaatcttgagatgagagagcagatccgcccattgaatcaaaacgaagatcaaatctatcactcgttgaactactattggaatgaacgagagaaacaatcagaaaatactcttggacataccgtatcaaaagattggatcgaatctctaaatacacattcgcaagaagggcagcagcctgttacgcgctatgcgaatggaagcatccatgtccatggattgatgcaaatcaaaccggagaatcgtcaaacagaaaagggaagagtagatggtcttccactatctgtaggtgctacttttgacggagaaacctcaccgtcttcggagtatccagaatatgcaatcgtacaagaaccaaatcagacaaaaccaaacgaacaaaataatccaatcattatccaagaggcaaatggtgtgacggagaatacagaaggaaatatcatcgaactgaagccttttacagtatctgtgtcaacattcacaccaaatcaaggaacacctgtctttgaagatatgcgttatttcccagaaaagatccaaatcgttgaaacacagtcaagtgctcaattttctaatcataccgctattttttcagcaccctcaaaaggagaatatacgctagaagtcacttatcgttcggaaatatttgatggtgaaaaatgggttgctcatacagaacctgttacccagcaaaaagcgatcacagtgcgagaagctgtcagtgtgccaccaggaactgatgaaccagaaggggaaaatccagggaatggatcgccaaatgaaaaaccttctgatccagatggggcagcaaaagaaagggaaaaagatggcgctcaaggacttccacaaacgggagagtctaatagcccgttgttagcagtagctggaggaattttgttaatcggtgtagctgcttatgtcatgaaacagcgaaaaaaataaacgcactgtatccttttgataaggtagaacaattagttgaggaaagtaaaaaaagaaggaagtgagacgtccattcgttccacttccttctatcatttttatagatgagatcccacttgctgtgtttgtttggctgttcttattacttgatgcaggacagctttttcgcaacctctgatatacggtgttcaaaagcttgcatctgcggtaataatctcaaccaaacgtaaaacatgaggagctatttttatttgtctgttcttattacttgatgcaagacagctttttcgcaacctctgatatacggtgttcaaaagcttgcatctgcggtaataagcccaaccaaacgaaaaatatgaggagctatttttgtttggctgttcttattacttgatgcaggacagctttttcacaacctcttaccagattcgcactcttttttctggcgctagatacatagcatcttgttccgtgacaccaaatgtttcatagaattcgtcaaggtttttgggttgcacatttgctcgtagtttagcaggagcatgaacatcgatttgcagtaaaagttgttggtattctttttttgcttttgtacgccaaatcgttgcccaattgacaaagaattcttcgatagaaagatctgattctgtttttgctgcttccaatgcacagcttagaccgcctgcatccgcaatgttttcagaaacggttaattttccgtttacttttccgtcagcaaaaggcagaccatcaaattcttcgatcattgcttgtgctttgttttggaattgtgcaagatcttcttctgtccaccaattgttcaagttgccatattcatcaaacaaagcgccgttattatcaaatgcatgggaaatctcatgagcgataacagctccgattcccccgtaattagcagagcttgattgttctagactgtaaaatggagcttgaaggatggctgccggaaaaacgatcacattccggaatggatggtaataagcattgactgtatcagcgctcatttcccattctgaacgatccactggtttattccatttgctgaaacgatctttcaatgtgagtttgctgaaagcaagagtgtttgaaagcaaagtaccaccttgatctgcaggcactgttttgaattggtcgaatagtgctgggatcttatcggggtaaccgacttggatacctaagttatttaattttatgacggctttttcttttgttgcatccccaagccagtcattttcttctagccgttttttataaacggcaatcatttttttcaccatttgctctacatcttttttagcagcttcgccgaaatattttttcccgtagtaatcaccaacgacttgatcaaattgaccagaagcaaggtaataagctgcttttttctgaggcattgcttcatctgttccagacaatacgcgagaatagattccgctgacttggcggaattcttctgatagatacccactaagagaacgtactgttttaatgatcatccagcttttgaataaggggaaatgaggttctgtcaggatgtcattcaaatgatcaaagtacactggatcagtgacaatcactttatctggggttgtcccaatcaaactagtgacaagttttttcaagtcaagtttatctgtgtattgaataaatgtgtcaaaagattgcggattatacattttgctgtaatctgcgttttcttctgcactttttacatgaggagcaatcaatttatcaaattgcactgcttgttctgtgattgcttctgcctgacttttttctttgccagcaagctccaataattgaactgccatatcaaagaaaacgcccattagttgtgcaccgttaggatgttctggtgcataatacgtcttatctggaagaaataaagaaggcggataagcaaagaaggcattcgtctgtgcattcttcatatcagcatctacatctagattaaatggcaatggtagtgtatccaacaaccattccgggaattgctcattcaattcgtcgaaagactgcaatgattcaactttctcgattacaggctgaagtggttgagcatgcaactcatttcttcggtcataatcgtttgccaattgataataagcaaggaaatgtttcattttttctgaagatactttttctggatgggcaagcagatcgtctgtttctcccatcaaaagttggtcgattccgtcaactaagtcttggaaaccgcctgtagctggtttatctgcagggatttttgctgttttttgccattcttcattgactgcttcatagaaatcttgtttcaatcgttctttgttcattcatcgatcgctccttttttgtttcgtgtgcccattatcttacaaaatgaaggaattaacaaatagaacataaaaaaatttgaaaattcggacaatcaaactgatttgtttttttcaatcgttcacttataatgaaaaaaaggaggcgatcccaactgaaacaagtagtggataaacctttctattttaaaatagataaaaaaatcaaaaaattagccagcacccagcaactacagtcaaaaaaaagcgaacggctttttttagcactgatttttgaagatcaaagttatgtgatcatcgatcaatcaggacatccgacagaatattctccagcagaatatacctatcaagagggcatttctcgtagccaatggagactgctcaatgaagcaccaatcgagttctctcaatggatcaacggaaaagaagaggtgcctgttttgatcgaagaaaaaaggtcaggaaaagaactcgtaaattgttgggtgggattgccagaagaacgttttttaaggtataagaaatgggctactccttcaggttatctttgcgggacttatgcggcggcagttttacttgcctactatcaagactatcgtaaagagtggatgcttcccctagagatccgcaagaaaaacacgtctaactcgatggcattgacaaaggcgttgcgtagccaaatccaaccactaggccttcctacgatcccttttcaagtcagtacagggatttctagttttttaaagaagaatggcaatcacgagcgtgcacgagcaactcttctaggttcatggcagcgagccacaaaacgtatacgtgaaggcaagcctgtgatgattggaatcctgaaagtacttggtagtacttacggcaatcattgggtgacggcgtatgcttattttgaaactgaaacaggagaacgttattacaaagtacacgacaattggggggactaccataaagttattcctgccagttggagtaacggaacagtttcacttccttaagaatttgctgaaattaacagaaaatcttgggaaaatatgttaaactatcgaagaatagagaagttttggggaggactacatgagtaataagtatcaggatgacacgttgaagatttttagtttgaatgggaatcgtccattagctgaaaaaatcgcgaaagtgtttggaacagaattaggtaaaagcgtcgtgaagcaatttagtgatggggagatttccatcaatattgaagaaagtatccgtggggatcacgtgtacatcgttcaatcaacgaatgcacctgtcaatgactattacatggaactgctgattatgattgatgcaatgaagcgagcaagtgcgaaaacgatcaatgtcgtattgccttactatgggtatgctagacaagaccgcacggcgaaacctcatgaaccgatcactgcgaaattgattgctaacttgatcgaagaagcaggggcaactcgagtactgactttagatctgcacacggttcaagtacaaggattctttgatattcctgtagataatttatttacgatgccattgtttgctcattattaccgtcaattaggtctgatgggagatgatatcgtagttgtgtcgccaaaaaacagcggcgttcagcgtgcacgtagtctttcagaatatttgaacagtacattagccatcgtagaccatgcagatgatgcttcaacggagggtggttatgtgattggtgatgttcaaggaaagacatgtatcatggtagatgatatcttgaacaccggagcaacgcttgcacgagcagcaaatgtattaaaagaaaacggcgcaaaagaagtatatgcctgtgcgtcacatggattattgtccgatcatgcgaaaagcattttagacaatgcaccaatcaaagatatttgtatcactgattctgttttcacagaagaaaatcgtcatccagaaaacttaacgatcgtgacatgttcagaattaatgggtgaagcggtcaaacgcatccatgaaaatacaccgatgagtccgttattccgtctggaagaaaaagaattcgaataagaaaaaagacaaaaaacgagaagattaattagcaacgagaagagggactgtgacaaaagttgtgtcacagtctctttttccgaataaacggtgttcaaaagccagtttctcggtattaagccaaatttatgcaaaaatgtagaaagccattttcacaaaatttttcttactactcgaaactaaacgactttttcacaacctcttggtaaacggtgttcaaaagcttgcatctgcggtaataagtccaaccaaacgaaaaatatgagaagctatttttgtttggctgttcttattacttgatgcaggacagctttttcacaacctctttttcgctacactaagtgccttctaggtaaaagtaatctcttctttggtatgttcgctgttttatgctagaatgtgcttagcgataatttggaagggatgaatgaagtgaaaactatttatttggatcatgcggcaactacccccatgcatccgcaagtaattgaagcgatgacggcgatcatgcaagaaacgtttggtaatccttcaagcatacatgggtttggccgccacgcgcatgaaaaaatggaaacagcaagacaaatcattgcagatagtctgcaagcaaaacctcatgagatcatctttaatagtgggggaacagaaggggataatacagctatcttagaaacagcgttctcgcgtcaaaaagaaggcagacatctaatcactacagctatcgaacatcctgctgttcttaataccatgaaatatttagagacaaaggggtttgacgttacatatctgcctgtagatgaaaaaggaaatctgtcgatcgaagagatcaaaaaagcgttacgagaagatacgatcttggtctctgtgatgtacgggaacaatgaaatcggaaatttgatgccaatcaaagaaatcggtgaacttttagcggatcatccagcttatttccatacagatgcggtacaagcttatggaaaccaaacgatccatccagaagaattagggatcgatttattaagtatctctgctcataaaatcaatggaccaaaaggcgtcggtttcttatataaacgagacggagtaaatatccctgccttgcttttaggtggcgagcaggaagaaaagcggcgtgcaggtacagaaaacttagcaggaatctggggaatggcaaaagcagttgaactgctatcacctgaagaacgtgaagcacgtaacaacaaatatcaaggattccaacaattgattcttgatacattagaagcaaacgaaatcccttatcaagtaaatggtgatttaacgaataaactccctcatgtgttgaatcttcgcttgattggcgaagcaaatgatttgctactgatgaagcttgatctgaacggaatcgctatttctactggttcggcttgtacagcagggaacatcgaaccttctcacgtattagaagcgatgtatggagaagatacgccgatactaaaagaatccattcgtatcagctttggattagataatactgaagaagacatccattatttccttgatcaattagttcgtgctgtcaaaaaataactaataaagtcattctgatgtggacggatgtctgagagaacgccttcattttttagggaacttaactgaaaaacctagtaaaaatcaggataaacttttataataaagagaaactaattttatcgaggtgaaaatcatggcatttgaaacaacagcaactgtacttggcgcaccaatcagctatcgtttgcatcctgatgcaaaaagatatacattgcgcgataatgggtttacagaaacaaacggaggcaattatcaattgatccgaccattagatgcaacgccgcaaagcaaagaaggcttcaaactgaaaatcactgtatcaaaagatatccaaacattgaaaatgtcgatcactacagcaaacggactgaaagcagtcaatattttcaaagatccaaaacagaaaatgagtcaagataaattctattttttgatggatgggatgatcagtcgagggttattcgaaaaagtcgaataacctgtggatataaaaagacaactagttttgaaacggcctaatcgttagatctctaactttgaaaggacgacacaaaatagttgtcttttttattttttctgctgtaaatcagactctcgtccactcatcaatggattttccatgttcatccactatttccaaccaactatttgttccggcaaagtacaacagcaagcttgcctcattcacactttttacgatgatatcttcgatcgtggttgtgcctgaaatcttgtctttataatcatctcgtagcttttgcccatattttgcagcataacctaatgagccgtctttatttaaaggaggatctttgacgagcgtcgcgcctgctttgatcagcaattcatttcgtttgatccagtaaagcgttgcttgacttcccctgaaatcgacggtaaaaggaatctcactgacttcttttgaccagcgatgacgagcttttgctggttttttcttcgtatcttcagcggcagatggcacggaagaatcgattggataaccaaatgtacttagtatagcagcaatcttctcttggtgttctgccattttctttctagccgtttcaggaatcgaagggaacgattctttggctattgtaagaccagctttttctgcttgttcggttagcatgtagatcatataatcggcttctatatcccaaggaagctggatcatgatgacggtatcgattgtttctggttggactgttttcccaattgctgtacacaccttttgatgataaaagagataaaaagcattttctggaagcttaggtagtttgtggctgatccagatcgtaccttgtgtctgttcaagtacgattttgatttcttcaggggtaagagtggtctgaaagttgattttcatgactgatgccctcctagttttttcttagtttagcatgattgctgatttttttctgctaattttacttttttaccaaaactgaaaatatataacgatggtatttgaacaaacagctaggtttcaaggaaataatcaagtataattctagctacgtaaggacgataagtcttagaagaagtgggggaaggatatgggagaagaaaaggagccggttttacattggcgtaaaaatatcaacttgtttttgacaggtcagtttttatctggaatcacgagtatgatcgtgcaatatgcaatcatttggtatctgacgaaagaaacaggttcagcaacaatcttgagctttgctacgttattaggtatgatcccaatggttttgctgagtccgtttgctggtccgttggtggatcgttgggacaaaaagcgattgttgattttgacagatatcattgtcgcgttgtttgcaatggtcttggtagtagtcggtacgatttctgacacatttccgttgtggctagtgtttgtatcgttgttcattcgtgcaattgctcaaactttccagatgccgacgatccaatcgatccttcctacgatggtcccagaagaagagctgacacgtatcaatggacagctaggcatggtccagtcagcgaattttatcattgcgcctgcaataggtgcatttttatttacagtgatacctatcaattggctgattttgcttgatgtgctaggcgcggtatttggtgtgggattacttgtttttgtgacgatccctaaggttatttcgcaaggagaaaccattcatttgttgacagatacaaaatttggtgtgaaaaaattgtacgagaataaaggtctttggcatatcatgctcaacggtgctgtgttcacgttattgtttatgccagctgccagtctgtatccgttgatgacgatgggctattttggtcaaaatgtaggacaggcgggtcttgtcgaagtagtctattcagtaggaatgcttgcaggtggagcggtgattggcttttttggaaaatggaaagaccggatgaagccgattttcatggcttatgtagtcgtaggtaccacgattggggctagtggattgttgccggggacaacacagggattcttttattttcttttactgaatgccggggcaggttttgccacaccttatttcaataccttactgatggcgatcatccaacagagttatgaaccgaacgttttaggacgagtcttaggtgtattcaactcattaatgactttgccagggccgattggcttaatatttgccggccccttgacagataagattggtgtagaaaagatgtttctgattgcgggaattggtacgcttttatgtggaatcgttttatttttgacacccgttgctcgaaattatgataaagaattacagaaaaaactggcgaaagaacaccgtgaacaagaaaacgaatagaaaaggagcggtgataaaaattttcttcctacttgaaatcaagtggttttttcacagcttttttagatgttatgagttgctccgatcagcaattttgtttactctaaggaaaagggaggcaggagaaacatgaattattttacgagtgatatgcacttttttcatgagcgtttactaggagaaaatgactttgctccgcgactctttgcaaatgtagatgagatgaaccaacagttgatcaccagctggaatgcagtagtaaaagaaacggatcacgtctatcatctaggtgatcttgccatgcatccgcagtatgaaaaagcaaatgcagacatcttagaattagtcagtcaactgcaaggaacgatccacttgatcaaagggaatcatgacagtcgtgcgttcttccgttatttagaaaaaaacgatcctggactttctgatggcagtcccaaattttatttttatgacgtaggtgctatcgtgaagttcgatcatcagcaatattacttgacgcattatccaatgttactcggacctaacgacaccattcgaaaccttcacgggcatatccatcattatagtgtacccattgaaaatgtcgtcaatgtaggcgtagacgcaccagaaagagaccttctaaaagaaaaactgccattcggtacgccgttatccgagcagcaaatcaaagaaatatatgaagcaaagaggtcgtgaaaaagctgccctgcatcaagtgataagaacaggcaaccaaaaacagcttctcgtgtttttgatttggcagggcttgtccccacaaatgcaagcttttgagcctgctacccaattctgtgtcacaaggaacaaaacggaaaagcagttcgctgcatgttataaaagaattgaagtacctgattttcaaaaataggataaaaagtcgtccctttttggcgcgactttttatcctattttttagtaatacagtcatatgttgtaaggaggaactacaaaatacagtacacgaatttcccttgatcattaactgcttttctgaccgtggcagtaccatcattcaatttcctaacatcattatctatattagtggaatagacgatcagggtgttttcttttgtgtatcggtttagccagtcaatcgcataatccactgactgattcacgccgatatgatagaaataattcccataaatcgcttttgcttcgtccgtcatcgtgaaatcatgattgaagccataaccattcctgacagaagcagcagttgtgaatgaaccatggatccttagataagaggcgtggcgataggtaccattctctaattttatcaacgcatgataattattgtaaaaataataccagcttggtgtagctcgattataagaaacatctgcattgaaaggattcggtcgcgtcatttcatatttgtcatagatactgaggttctctgtatagtcaaatctttgctgagtgaaggcaggcggtgtatggacgacttggttgatctgataaggattgactggatgttttttcttcgtgatttttgtaaaagaaggattatatcttaagtgattgttgtcagtagagatattgttagaataaacgatctccaacgaacattgggtataggtattgatccagttcatcacatagttcggaacatcatgatcttcgatcgtctctggaataagcgggatattcctgtcagaaaatttggctcttgcttcgtctgttaaaagaaaacgggtgaacatatcgaattctacgacgatcgttccagaatgattacgcccgaaagtaagacgtgtacttgcataaggtctcccgttatttttgtccgtggcgatgaaataataatcattccttaaggtgtatgagttggaaccgcggctaaaaatgaaatcttcgccatctataggagtgccggcgttcgaccatcgtatgttttctgcgtaatctttataatttacgaaaaaaggattgattttttcgactttatcggatttttttatatcatttggagttacacccattccattaataaaatctgttctttctaaatcaataccttggaaactaggatcatttttattagttagttcatcgattctcctatcaggtgttgcgttcatataagcagcccaaattagataagagcaataccattcatttctagtggatgagcgatccctttcttttatctcgaaccagatatcatattgtttacctaattgtccatgcataaatgagatggctgcttttctttgtgctggtgtcgcttctggaactcttaaaataatcgaatcagtataatcgaaacgctcatcatccaagacaccgtaaacaacgcctccagcttttgtttcaagtataggactataatcagttgcttcgatagttcggatatatttgaatgtctctggttttccattgatgagatgtgtctcttcataaatgccttctacgatcatcacatgatgaagataacgcaaaaccatatccgctcgttttctttcaaaaatgatatctcctggttgaacgatattcatcagatcatatttatgataagtcggtactttttcaaaagtgatattctccaaagcatttccgatattgaatgaccagagaggcgggtctttggataattgttcggcttctttacgaatatagtgctcattgacggtgtttaggtagtcacgcaattggtcttcttcggaaatcgcggaattgaatggttgattgtaataattcgaggtgaactcttcaaatgtctgatcaaaggaagcgtattcatttttgaattcttcataatactcctccaatatctgctgggtatctgtatcagcatgtacagtagtgattgggatggcaaatgcgacggcgagtaaacaggtagtcagaaacaatttaatttttgatttcaatgtaatccctccttgttttatgctagaataataacatatgaatcagcatgatgatagcttaaaaataaaatatatctgttatttaatataggcgtatattgcacataacaccaaagagtaaaatcagctatatcgataattgagaactgttatctttaatggaataattagcatttaacttaagcttttgcgaataaaatcaaagacgttatattttatttggggttagatagtctacagaagatacaatttcttggtagggatgagtattgaacaggcgtgttgatttatatatctatttgttttgtttcgttattatattttttatttgtttatttttaaataacgaattttgagattttttatttagagtttttttgaagatagacaagtatcaatcaattagaaaggagatgtgtggatgttaccactaaaaagtaagacatgtacgatcatttcaataattttgctagtgctttgcatcatcatgactagtttttatccttcgacaaaatatggaaactatacaattcttgtatcaataatgttttgtaattggttatttggtgggataagtcttgttttttcgtcaaaaatcaattctaagtgcttaaaagcatgtgtcattttattaaatttgatatgtatttttggttggatcatttttgattgatgaaaaacgacagaacctttctgttgtgaggaaaagatgtttaaaatcacgagaagagaagaaaataaagttaaatagaatcggtttgtatatagctatatttttgtcacttagttgtttcattggtatctattcttactatataaatagtctctaaaatagagttttaatgtgagatattaagtctttattctttgagcaaaataaatcttgtataagcaatttgataaaaaacgacatgtatgaatactttgatgaaaaggagatgtgtggatgttaccactaaaaagtaagacgtgtacgatcatttcaataagcttgttgtcaatttgtttcatttcagctagtttttattttcatccttctatagaaaataatcttcagtttttagtgtccataatattttgttgttggagcactggtggtttgagtttggttttttcgacaaaaatcaattctaaaaggttaaaaatgctagttatcctacttgatttgattggtatttatagttgggtgatttatgctatgtaaattgttctgttttagtttgttgtttcaataaaaaacgaaaatgaggggaaataaatgaaattagatgtcaatttgatcggtttatgtgtatctatgttactgtctggctggtgtctcgggatagctcatttctattacggaaatagccctcaaggagtatatatgttacttatgatgatttttccaggattaacaggactatatttttctacaaaagtcaagtctgtaagaatgagatggttcctgataatactaaattatctaatagctacccatcttactatgatgcaattttatggtcatttattaagatagccatgtatcaatcggaaaggagatttgtgaatgttaccattaaaaagtaagacgtgtacaatcatttcaataagtctgctagtgctttgtatagctttgactatttttttcccttcaataaattataacgacgatgggactcgtatacgaataatgttttgtatttggttatttggtgggttaagcctggttttttcaacaaaaatcaattctaaatgtttaaaagcgattgttatagtatcgaatttgatatgtatctttaactggatcatttttggttggtaaaaaatggcggaacgtttctgttgtaagaaaaagaggattaaaaacaaaaggagaaaaaatgaaactaactatcaatttggtcgggttatgtatatctatgttactgtctggctggtgtctaggggtggctcatttctattatggaaatagtcttcaaagtgcagctttaatgattttcatatccttccccggcttagcaggtctttatttttcgacaaagatcaaatctgcgaaggtaagatggatgttgttagttatcaattatctatttgctacatattttaatgttttccaatttctatttattttgtttcaaactttttgaagtcagcaacgaagcaaacaattaaaaaggagcgagttgaatgttatcaatagaaagtaagaaaagtaagagggtatcggtggttctgttagtcttctgtatgattttgctcagcagtcatttgtatattcgtcatgaagtgatagggtttctaatcgtccagtattcatgttggattttaagtggtatcagtttagctttttcaagaagaatggattctataaaagtaaaatggctagtgattgctcttcattttcttttgacttgcggagtagggcttgtttacatcattgggtggatcatcgggtggataagtttacctaggtgggagttgttgttagtatgtgtgttgtattttggagcagtcgtaacattagactatcaaaaaaagaaaaaaacattctatctgttcggtctaggtctaccgatgctaatatcgatcagttcgcttattggaatccattacttgttggctttccattcaaatactattaaatcttggcttgttatccctttgttgcttttcatgatgatttccggcttgatgggtctctatttctctacaaaacttgaagataatcgaataaagtggctgctattagggatgaattatctatttgctacttattacaatattgttcttttgtttttcttatgaatcgaaactgccgttcctcttttgatcatgagaatcattggggcatgaggaaggcgatgtatgggtcaattaaaaaggagagagttggatgttatcaatagaaagtaagaaaagtaagcgggtatcggtggttctgttagtcttctgtatgattttgctcagcagtcatttgtatattcgtcatgaagtgatagggtttctgatcattcagtattcatgttggattttaagtggtatcagtctagcttttacaagaagaatggattccataaaagtaaaatggctagtgattgctcttcattttcttttgatttgcggattagggctgttttacatcattgggtggttaagtttatctaggttggatttgttgctaggatgtgtgttgtatattggtttagtagaaatattagaatataaacagaaagaaaaagcattttttttgttcggtctaggtctaccgatgttgatatcgatcagtttacttatttggatccattatctattggctttctatttaaataccgacaggatgtgggcaatcatcgctttgttgcttttcataatgatttccggcttgatgggtctctatttctctacaaaacttgaggataatcgaataaagtggctacttttaggaatgaattatctatttgctacttattacaatgttgttcttttgtttttcttatgaatcgaaactgccgttcctcttttgatcatgagaatcactggagtatgaagatagcgctgttttttccctatgataggttatgtattcgaacgctgataattaagggatgaaattttcagaaatatgacgtataatgtaaaatactgaaaagttgcgaccttcaactcgtagatgtttcagaatctaattgaaatgatggtgatatcatgacagacaacagccaaacacgcgttgtcgtagggatgagcggcggtgtcgactcatctgtaacagcacttttattaaaggaacaaggatacgacgtgatcgggatcttcatgaaaaattgggatgatacggacgaaaacggcgtatgtacggccacggaagattataaggatgtagcgaaagtagctgctcaaatcgggattccttattattctgtgaatttcgaaaaagaatattgggaccgtgtatttgaatatttcctagccgaataccgcgcaggacgtacacctaacccagacgtgatgtgtaacaaagaaatcaaattcaaagcattcttggactatgcaatggatcttggtgctgattatgtagctactggacattatgcgcaagtcactcgcgatgaaaacggtgtggtccatatgcttcgcggagtagacaacaataaagatcaaacttacttccttagtcaattatcacaagaacagctttcaaaaacgatgttccctctaggcggtatggaaaaatcagaagtgcgggcaattgctgaacgcgcaggccttgcgactgctaagaaaaaagattcaacaggaatctgctttattggtgaaaagaacttcaaacaatttttgagcaactatctaccagcgaaaaaaggcaatatggtcactcttgacggtgaagtcaaagggcaacatgctggtttgatgtactatacgatcggtcaacgtcaaggcctaggaatcggtggcggaggagattcgcaagaaccttggtttgtcgtagggaaagatttagcgacgaacacattatacgtgggtcaagggttccaccatcctgcactgtacgccacaagcttggatgcaagtgaaatccactttacgacgaatgaaccaatgccaaaagaattcaagtgcacagcgaaattccgttaccgtcaacaagatgttcctgtgacagttcgcttattggatgataaccgtgcagaagtcgtattcgacgaacctgtacgtgccatcactcctggacaagcagttgtattttatgacggaatggaatgtctaggtggcggtttgatcgaccacgcataccaagaaacaaaagttttacaatacgtttaagcgatatgaaatgaatcaaaacagctatggctaacaaaagaaacaccttttcttttggacagcatagctgtttttttgcaataaaattaatttttattcattttacgcttgtaattttagtggaaacagtccataatatccaataatatgaataaagttgcttttggtaagcaagagcagatgcaaaataaaggaaatattttgcaggtggtttgttcaattttataagtgaaggtgatggaaatggaaaagaaatcgacaggtattagtaagtggggtctggttgctctcgttgtcagttcgtcaatcggaagcggtgtgtttggaatcacgagtgatctggctagttctgccgcccctggaccagcaatcctttcatggataatcgtcgggattggtattttagctttggtattatcgctgaaccatttaggagaaaaacgtccagatctggatggcgggatttttgggtatgcagaagcttcatttggtaagttaggtggcttcattagtggctggggctattggttgtctgcgtggctaggaaatgttgcttttgcgacgatgctaatgagtgccatgggagaattttttccgatattcaaagggggacaaaatgttccttctattttattcgcaagtctttttatttggggtctgactttattagtaaacaatgggatcgaaggagcgagcgtaatcaatacgatcgtgacgatttgtaaattagtgccattattcctatttttaatatttgtatttatcgcatttaaagtgaatatattcactactaatttttggggcaacgtatctgataatctagtgaacggatcaggacagcaaggaacgatctggttgcagatcaaaggttgtttgatggtcatgatgtgggtctttgtagggatcgaaggtgcaagtgttttagctaaccgcgcgaagaaacgttcagaagcccagcaagcatccatcatggggctgctttgtttattatttatctatatccttgcttcgatcttgccatacggtgtcttatctcaagaagagttagcaactatttcacaacctgctatggcaaatattttaaaaggaatcgtgggaaattggggagcggcactgatcaatatcggcttgatcatttcgatcatcggttcttggttgtcttggacgatgctcccagcagaaacaacgatgttgatggctcgagacggtctgttgccgaaagcttggggaaaaacgaataaaaaaaatgccccaacttattcgttagttgttactgccatcttgactaatctattcttattgactttcttagttactgattatgcctatcaatttgcctattctttatgtacagcggcaatcttgatttgttatctgcttgtcggaatctatcaagtccagttttctttaaaagaaggaatcaaaaaacaagtagtgatcggtgggattgctgtagtttttgaattgatgggaatcactttagcaggattttcttatgtccttttatgtagtattgcctatcttcctggtttttgcttctactggatcgcttgtcgggaaaccaaccatcaaatcacgggaaaagaaaaagtaatgattgggctgatttgtgtggccgcactgctttcaatcgggttgcttactgtaggctggatcaagatataagggggaaagaaacatggaaatcgcaaatttcggtgtggaagaatggctaaataaatgggagaagaaagcggtatatgatattgcacaaagttcgatcgaagcattgacattagacgaactcgttggcttagacgggaccaacgtaagtgaatttttcgaaaaacgcaaaaatgaaccattggactatggctggatcgaaggatcagatgcgttcaaacaagaagtcgcttcgctttatcaaaccgtcgatccagaaaacatcttacaaacgaacggagcgactggtgctaatcttttagctctatacgcgttagtggaagcaggagaccatgttgtttcgatgcttcccacttatcagcaactatatgacatccctaaatctttaggtgccactgttgactttgttcatttgaaggaagaagaagattggcagtttgatttagaacagctagaagccttagtcaaacctgaaacaaaaatcatctgtttgaatagtgcaaacaatcctacaggcacattgctagatcggaaaactttagaaaaaatcgcagaaattgctcgtacagtagatgcatatgtattgatagatgaagtatatgcgcctttaacggataaaggtgaattcttgtcgatcgtagatgtctatgagaaaggtatagcaaccaattccctatccaaaacctactccattccaggtatccgtattggctggacagctactggacctgagttggcagaggtttttcgaaaatatcgagactacacgatgatttgcggcggagtcctgtcagatgatcttgctgtacatgcattgaagaacaaagaaaaaatcttggagcgaaaccaaaagatcattactgagaaccttgcgattttaaaacagtgggtagcaaatgaaccgaaagttgaactcgtcgctcccaattacgtctctacttctttcatcaaattaaccatcgaagaagatgatcagacattttgtatcaatttattagaagaaacaggagtactattagtaccaggaagtgcctttgatttaccgaagcatgcccgactaggttactgttgtaaaaaagaaaccttggaaaagggattatcccttttatctgaattcttgaaaaaacaggcctaaacaaaaacactgcaaggacagtctgtgacaactgttcaagcagtgtttttcatttacgcttattgtctatgagaaggagagtgccctgaagatatggagactcctgaagctttttcttctgcagtttcttgctgatggatctcttgtgtattgtgtcgtacaagcaagaagttgactaaaacaagaagagaagtcgaaagaaagacgccacgataaccaaatgcactggaaacactggagccaatcataggtcctactacgttaccagttgcttggaaagattggttataactgaagatccgtccagcagcttgatgaggcgaatattttgtgatcaatgcttggacagcagggagcagacaagcatcagagataccaatcaaaaaacgtaaggcagctaattgccaaacattcgtgacgaatgccattgggatataaaccaaaatcgcaaaacccaaaccaatcgcaagtattctttcactcccaatcttgtcacctaagcgaccaaatcttggagcggctatcaaagtagcaattccaggtatcgaagcgatgattccgctgatcaatgtaacattcccatgtccatgcagcaattgacgaatgtacagactgatgattggactgatggaattgttggatgcttggatgatcatcgttgtgacgaacataccgatgacgacgtgtggatatttcaagtctttgaaaatctgtttggcagaaaccatgttttcttttttcactgggacaaatttttcatggacgaaaaacagactcaacaagaagacgaaaaataagatgatccctgtaatgaaaaaggtagggcgatagccaaacgctgaagcagagatcccgccaagaagcggtccaagtaatgttcctgtaacagaaccagttgctaaggtcccaagaacttgaccacttttttcttttggcgtcccagttgcgacaagggcagtggcattactgatataaccagaaaaaatcccttgaagcagacgcaatgcaactaattgatacacactagtcacgcagcccatcaaagaaatgacgattgccattcctaatgaagcacgcaacagcatcaattttcttcctttttggtcggctaatttcccccaccaaggagagatcagcgtagtcactaagaaagtagatgaaaaagtcaatccgctccaaaagttcaattgtgccgtactataattacctaacgtatctatgtaaagtgacataaaaggcatgactaaactaaatccgataccagccataaatgttccaaaccataagacaaacaagttctgttcccaagtttctcttttcctaaataatttttcctttattcttgcagccaattagactccttctttctgaaaattttcatctacaactatttattataaactacattatgtagtttatcaatgaaagtctcttttttctcgttctttttcgtggtaaactgaaagagtgaaggatttattttatgagaggaaacatggaaatgaaaaaaagaaatctgtctcaagagaaaatcatcgactgctttcgagaactagcagaagagatggatgttcagcaaataacctttcagcatttagcaaaacgcttggatatcaaggctccctcgctgtataaccatttcaaaaatattcgtgatgtcaaaacagcgttaacagcaaaacttctgcaggaacttaatgaccagctgcgtcgggctcttgtggggaaaagtggtcaggaagcactgcagatctatgcagaaacttatcgatcctttgctttttcgaatcaagcagtgtatgagttgctgatcagtgtgccccacaccaatgaagcagttttattagagggaatccatgaaacgaaccagatcattttgcagatctttgaggcttttcaattaacgaaagaagaaaaagtccaccgaagcagagaattacgtagtatgatccacggctatctttccttgcgttttttaggatactttacaaaagaaccgacaatcgatccagaggacagctatttttggatgatcaatgactttatcgctactttgccttaaacaatcagattcattggtatcattttcaagatgttcattaaatgatccttttataagagaaaattcttgcaactttcttgaaaagtgactaagatgagtctagaaaagctgaaagaaggagcacgagtatgtatcaagtaattaccatgttcggggacaatgagccttggtggttttttgaagactgggaagaagatattgaagcagaagaaacattcgagtcttttgaagaagcacgacaagcgtacgaaaaacaatggatcgcgatccatcaaaattatgaatatatcaatgcgaaaagaaactttctcagcgccttttggaatgacggagatgagcgctggtgtgaagagtgtgacgatgatttacagcaatacaagggacttgcgttgttgaaaaatcatcagcccatcacagtagaaagcagaaaggaattttatgaaacaactaattctagcggaaaaaccaagcgttgcgaaagacctaagcaaggtgcttggtgctaatcaaaagcacaaaaattattacgaaggacccaaggtgatcgttacttgggcccttggtcatttattaggattgaaaatgccggaagatctgaataaggaatggcagagctggcaaatggacacgttgccgatgatccctaaaaaactaggaatcaaaccacttcctaaaacaggatatcaattaaaagcaatcaagcagctggctcaacgaaaagatgtctcagaagcagtcattgcgacagatgccggaagggaaggggaacttgttgctcgctggatcttagagtatgtgcatttcaataaaccagtgaagcggttatggatctcttctcaaacagataaagcaatcaaaacaggattcaagcaactaagacctgcaaaagaatatgatgcattgtatgaatctgctcttgcccgggcaaaagcggactggttggtaggattgaatgtgaccagagccttaactgtgaagtacgcggataatttatcagcgggccgtgtgcagaccccgacactagcattagtgagagaccaagaaaagaaaatcgaacagttccgtccacaaacgtatttcacgatcacgttgcacgctggaaaagaacaagccaaaatggttcaaaaaaatcaatttgctttaaaaacacaagaagaagcacaaaaacttgttcaattgatcagtacaagcaaaggaactgtcacagaagtccaagaaaaattaaaaacggaatctgcgccgctaccttatgatttaacagagatccaaagagaagccaatcaacgctatggctattctgcaaagaaaacattaagtcttgtacaaagtttatatgagacccataaaatcgttacttatccgcgtacagacagcaaatacctgacaaacgacatgaaaagtacgatgaacgaacgactgcaagcagtcagcgattttgctcctgaggtcaagcagtatttgaaaaacggagccatcgtccaacagacaaaagtattccaagacaataaagtgaccgatcaccatgcgcttttgccaactgaaaaccgagcacgttatgaaaaactaagtaatgaagagcaaaaaatctatcaaatgatcgtctctcgtttcttaggcttgtttgctcaaccacacaaagtcagtcagacaaaagtcacggttgaatttgataaagaacaattcattttccgacaaaatcgtgtcatccaagcagggtggaaaggcgaaactgaatctgaaacggaaacagtcaaatgggaaaaaggaatgcggatcaatcctgatttcaccatcaaaaaagaattatctgcaccgcctaaaccattgacagaagcaagcttgcttggacaaatggaaaaatacagtctgggaaccccggctactcgtgcagagatcattgaaaaattgatcaaatcagagttgatggaacgtacccctcaaggactgcaagtatcccctaaaggtaaacaattattagtattagtcaacccatctttagtgacaccggatctgacagaaagctgggaaaaagaccttgaagctattgctgcaggaaagaaacaagcaggaaccttcttgaatggaatcgaaaaagaaacaaaacgcttggtgaatgaaatcaaatcaagcaaacaagaatatcaagatttctcgattacccaaaagaaatgtccagaatgtggggccaatctgcgtgagaaaaacacgcgagacggcaaaatttatgtctgcaccaattcagattgcaactaccgcagaagaaaagatccaaaagtctccaaccatcgctgcccacaatgccaccggaaaatggaaatcatcgaaggcaaaaatggtgcttatttccgttgtaaatacgacggaacgacagaaaaaatgcttgataaaaaagagcagaagaagaaaatgaccaaacatgaagaacgtcgcttgctgaaaaaatatgcacaggcagaagaaccagaagaaagcccattagcagcagcactaaaagcggcaatgaagaagtaagaagatggaggttgtgacagaagtggtcagcttcaagaaataagaaggaatttacgaaaattgcttctcaaatttttgtaacatttcggcttatttttcgaagaagctacttctggaacaccatatatcagaggttgtgaaaaagctgttctgcatcatcctgcatcaagtaataagaacagcaaacaaaaatagctcctcatattttgtcgtttgttgagctaataccgaaggttagttgattgaaaaccgtttgttcggaaaaagggactgcgacaagatttttgtcacagtccctcttcatttaaaaaaatgtttacttcatttgacgtatattattggtgaggcttcaattcatttggcttcactttttctgtttctctaataatataaacaggacgttgcttcgtttctaagaagatttttccgatatatttcccgatgattccaagacataacagttggattccgccgatgaataggaagatcgagaccatggaaggccatcctgatgtaggatcaccaaacagcaatgcccgcaaaataatgaacaagatcgcaataccagaaccgacacaagacaaagcgccgataaatgaagcaattgtcaatggcgcatcggagaagttcacgataccatcaatcgagtagttgaacaatttccagaaggaccaagatgtttcaccagctacacgttcgcggttttcataagaaatatattctgttttgaatccgacccaactgaataaaccttttgaaaatcggttgtattctgttagttctaggacagcatccaccatttgtcgggtcatcaaacggaaatcacgagcgccatcgaccatttctgtatcgctgattttattaatcaactggtagaattttttcgcgaagaagctgcggattgcaggctcaccttcacgagtcgaacgccgggtgccgacacaatcgatatcagaagtagtgattcgttcaatcatctcaggaagcagttcaggtggatcttgtaagtcaacatccataacagtcactaaatctcctgtagaagcttgtaatccagcgtatagagccgcttctttcccgaaatttctggaaaatgagacaaagcggacataaggataagctgcagctagcttcttgattgctgctaatgtaccgtcttttgatccatcgtcaataaataaatattcgaactcatggggacctttgaatttttcaacctcatcaaaaaaaagaggaaccgttttttcttcattgaaacatgggacaacaattgatactttcatcgtttctttcctttcaatcgtatgtttatatatggtttacattcaaaatttaataaaccttaaataacaccttttaaatttgattttacgtaaaagaacaggtattcttttggtaaactaccgtatttagtttaccatgtttcctcggtttatcaaatttttaagaacaatttttagtagttggcaagtagtttcggacagagaaaaaggaggaagttccagtctgttgaccaggagcaaacaaaatgaaaatacacacacctatcggctttttatggttagatgcagatgaatccgggttgactgctgtatcttttcagccaatttcggaaagcaaatcagcgaatcagcaaattttaacgcgcacacaagaacagtttgaagaatattttacgggaaaaagaaaagaatttgaaattcctttatctataaagagaggtacgccttttcagcaaaatgtctggaaagctttgtcgaccattccttatggagaaatccgaacatataaagaagtagccgttgctgtcgctagtccgaaagctgtgcgagcgattggacaggcaaatcgaaccaatccattaccaatcgttattccttgtcatcgagtgatcgggcaaaatggaaaactgacaggatatatgggaaacgcaacagatggagtcgaaatcaaacgccaattgttgctattagaagggtatctgcaaaattaaaaaacagttgtgattcgaacattgttccatgcgagaatcacaactgttttttcgtgtttgttctaaagtttgatcagccaaataaatagtaaagccattactgtttggagaagcccgacagccaatccgtaagataagaaacgtgtaccttctttcatgaattttgcaaagtctaaacgcagcccaattgccgctaaagcagtgatctcaaaccagctactgataaaatgtgccgattggtcaataactacaggtaaagaaaacaagctgttgaccaaacaaaagatcacaaaccctaatacataccaaggaagcggtaattttcgttttttctgcgtatcagtcggtgtttcaaacagagctggttgtttcttgtgcatgaatttttcaaacaaatagacaacaacaacaagcatcatgatacgtagaatcttaaacaacatggcaaattcgacaacagaactgtcaagcaaacttgcaccagcgactacttgacccacagattggagtgtgccacctaaaagtgcgcttttttcaatgagatttcctccgaatagctgtaatccaagaaaagggagggtcaacatcatcatagtacctagtagattgaccagtgtgatgatctgtcctttttcttcctcttttgcatggatggaaggggcgatcgaagcaatagcagaagaaccacaaacagcgtttcctccagccatcatcaaagaagaagtatcgctgaattgcagtttcttaccaatcaagtaagcaccgatgatagtgactgacatctgtagtaacacaaaaacaattccttttacaccaatttgagcaatcgtttgagcggtgacagttgcacctagtaaaaaaacagagaattccaatagtttgctttcagcgaattttgtgccgattgctagaacaggctgtttaaaaaaagtatttcctaataaaatacccaataaaatagcaatagtcgctccacctaactgtggcagataaatagcaagaagccggctgacggcagcgatggcaaaagaaagcagtaatccgggcaaaatctcgcggaccgctgaatcctttacagattttattggatgtgacaatgatttcatttgattggttcctttcgtcaataaatactaaaagcatactcgaacatagtagcactaaaccagtattttgacaaaagaataagaggtcgtgacaaaagtcttgtcacaacctcttgtttcgaataaacggtgttccaaagccagtttctcggtattaagccaaatttatgcaaaaatgtggaaagccattttcacaaaatttttcttactactcgaaactaggcggctttttcacgacctcttggtaaacggtgttccagaagtagcttcttcggaaataagccgaaatgttacaaaaatttgagaagcaattttcgtatattccttcttatttctagaagctgaccacttctttcacaaccaatcgaatcaattatgaagcgatttttttagaaacaaattttccatgtttgctatgttctttagttaagaaacgtacgtaatgagcaagcacgtagaagacaactacacttgcaaacagacattccgcaatttttaagaaatctaatacgctactataaatacctaaactgttgaagtaatgaacagtagtaaatagagctgttgcagagataacaagtgggaatgtaaaggctgcgtagcttggataaaaacgaagcttgaacaagcgtggcagtatagacagcacgacgaaatacaatacttgagataaaacgaacaacgctacgacaagataaaagttaggttctgcaaagtttttcaggtaacctgtcaggcaaagagaaccaggtgctgcaacgatcgtaatcagcggacgtgttggatgagccatatttcttacgaaaaagacacgtttgatgatgattggtaataagaacgcatagcagaccaatgaaatccaaaagaagatttttccaataagtgggaagaagttcccagcagttacagtgatgaccccaaacccaacataaatgataaaccagcttggataaattgcttcaatagaaagatcagctttgatgacatggtgataattgaaataaaagacaagtatcacttggaaaataactgcacacaaccaaatgaatttgacaatcggtgcaatactttcatatgaaacaaaataagtacaaataaccatgagtgacatcgtaaaagttggtgaaacggaggcgatgatcggatcatgcaacgtttgtttcgtatgctcaaataagataaacaatttaacaaaaatgaatatcataagaatcattgagataccgccagttagattgcctaaagcaacatggtgatagtctttaaacagatttccaagggaagctaacccaagaatcaacccgcagatcgggatcggaataattttcaaaaagttcttcatatatattctcctttttatttaatagattttagtaccaagatgaacgaatacattgtaaaatgaataggtctgtatgattacgagcaaagcagacagctgattatcttgtctgagttactagttggatcagcaactgttttgttgtacatttctattatagatggttttttgtatatttaaatcaaatagtttttatagtaattatcataaaaagttatggaagtggtgccatgtttaagttattaacgacttttcgagcagtatatgaaacaagaaatttttctagagcagcagaagtactgtttttatctcagccagccgtctcgaatcaaatcaaacaattagagcgggagttgaatattgatctttttcagcgtaatggcagaaaagagatgcttccaactaagcaagccgatttattatacgagcggacgctggttttattagaagaatgggaagagacccagcaaaaattgctcaatgaacaaaatgaagaagaagtatgtcggatcgttgcttcccacacatttgctgtttatcttttgcctcagttgatgaaacatctgttcaaaaggtttcctaaagtgcattttgagatcgagatcgcaaattcacatgaatcattagaacaagtagcgaaacatgaatccgattttggttttatcgaaaagccattagagacttccggcgtacaaaggtactccttgatggaagaccagctagtcattgctggggacccaaaaagtaaattgtggcttgtaagagaagcaaattctggcgtttttcattacacacaacgttattttgaagaaatgaacatccaagataagaaaatgatcgtgaaaagcaatgatgtgatcgttgcgttgctgaaggaaggaatcggacgctcgattttatctgagcgctctgtgccaaaagacgtaccaatgattccgttgaatttccatcggtatttttatttcattcaacgaaccaatctggtttctgatcagctgttagagattgctgaagagatccttcgatacaatgaaagcacagaaatttctcacagcgaggagaatctcagctgatagataattgcatgtatcaaaaaaagttctgtgatacactaaagataagcagtaggcttttgccttccgtttgctcaagcagctgcacaaacggaaagttaatttttcccaaatgtctgtggaaagactttccattatctaactggaccgctataataatcagcagtatggtttttaagaaaagggatgaaacatggaaaaaaaattaaaagcttcgaacgataatcgtattgattatggcgtgattttaccagtctttctgttatgtttgattggtctgctctcattatatgtagcacttagccatgatccgaacaatccagcagtcttgaaaggcgtagggatgcaagttgtctggtatttagttggggcggcagcaatcgttgtcatcatgcatttgaattccaaatggatctggaaactgactccttacctttatggcttggggttagtagtaatgggactcttactggaattctatgacaagaatttagccgattctacaggttctaaaaactggttccgattcggtgcgttcaccttccagccagcagagctaatgaagatcgcgtacatcttgatgatggcgctgatcgtgaccaaacataatacgcaagtaaaagaacggacgatgaaatcagacttttggctgattgggaagctcttgatcgtgacgataccggtattagcattgatcatggctcaagatgactttggaacgatgcttgtcttccttgcgatcttcggcgggatattcttgatgtctggaatctcttggcgcatcatcgcccctgtagtgatcttagcagtagtcgttggtgcaggaacgattttcttagtgacgactgaaggcggaagagacttgctttataaagtgggcttcaaatcttatcaatttgcacgtattgattcatggctggatcctttccatgatacgtctgggatgagttatcagccggcacaaggacttttggcaatcggcaccggtggcttgtttggtaaaggattcaatgtaagcaatatttatgtgcctgttcgtgagtccgatatgatttttaccgttatcggtgaaaacttcggctttatcggtggtgcattcgtcattttcttgtattttattttgatttatcgtatgattcgggtgtgtttcgatacgaacaatgaattttacgcctatatcgcaagcggtttgatcatgatgctgctgttccatgtctttgagaacattggagcaaatatcggattacttcctttaacagggatcccattgcctttcattagccaaggaggatcttcgattttagggaacatgatcggtatcggattgatattatcgatgagataccaaaatgaagcacctgcaagatcttcaaggaggtaagaaaattgtacaccttttactggtacccgaaatgttcaacatgcaaaaaagccaaagcgtggttagaccagcatggcgttagttatcaaactgttgatatgatcaaagaagtaccgaaggcctcaacgattgagatttggctagaaacgagtcaagtaccgatccgtcgcctgttcaacacaagcgggatgaaatatcgggaacttggactgaaagatcaagtaggcgagtttacggcttcaaaagcaagccaagtcttatcgacagatggcatgctgatcaagcgaccgctgatcgtgcaagaggaccagcttgttgcaattggattcaatgaaaaaatttatgaaggagaactgatataaaatggcaggcaaacatttgaagaaaaaggacaacctttggatcttatttaatggaaaagaatactgtgttggtttgacaaatgaagcgcaagaagaacttggagacatcacgtttgccaatttgccaaaagcaggacaatcgctaaaaaaagatgaacctctgatcgaagtcgaagcggaaaaagcggtcaatgaatttgctagcccgctaacgggtacagtttcttctgtgaatgataaaatcggtgaagatatcaatatcttgaatgattcagatgaaatgaatgcgtggatcttaagtttcaaagatgttgatccaaaagaatttgacgaattataaaatcagaaaatcacttgaaaaaagttgacactgattcttccagttgctataatcataagcaatcctatatgaaacgagaaagctttgaaaagaagagtacatgtcacggacgtttgaagagagccctgtttgctgaaaatgggtaacgaaaatgagatggaagatggtcttagagcagagtaagcgagcgtaagcaaacttactacgggagtgcccgttacagcgcgacagtatacggaaagaagctaagtccaagtactggaagaggctgttattgcgaagtaacggtaaatcaaggtggtaacacggaagttcaagctttcgtccttttgcttaaggcaagagggcgaaggcttttttgtttgaaaaatcataagagaaagatgtgaatggcatgtcattaatccaactaacgaatgtcaaaaagacattcaatgggaaaaacggaaacatccaagccgtcaatgacgtttcactaaacgttgaaaaaggggatatttatggaatcgtcggctattctggcgcaggaaaaagtacattagtccgtctcctgaatggacttgagcttcccacgagcggcgaagtgatcgtaaacgatcaagatatcacaaaattaaaaaacaaagaattacgtacattccgaaagaaaatcggtatgatcttccagcatttcaacctgttatggtcaagaactgtacttgaaaatatccagctgccgttggaattagctggtgtaccaaagagcaaacgcaaagaacgagcagaagaattgttgcgtttagtcgggttagaaggacgcggacaagcgtatccttcacaactttccggcggacagaaacaacgtgtcggtatcgcacgagcattggcaaatgatcctgagatcctgctttgtgatgaggctacgagtgcattggacccgcaaacaacagaagaagtattagacttattgttagcaatcaataagaaattgaatttgaccatcgtcttgatcacacatgaaatgaatgtgatccgcaaaatctgcaacaaagtcgctgtgatggagttggggaaagtcgtagaagaaggagacgtgttgactgtcttcagacaaccgaaaaaagaagtaaccaaacgttttgtacaacaagacatcgaaccagaagctgattcgacagaactattagctgaactcatcaaagaaaatccaagcggccgtttggcaactttgacctttagcgaaagaaatgccaacgaaccagttatttcccaagcgattcgacgctataacattgatgtcaacgtcgtatacgggaaaatcaaacaagtaaaagaaggttcctttggttcattgactgtcttgatgacaggtgaaaccaaagaattagatcaagcagaagtgttcattaaagaacaaggagtaggaattgaggtgatccatcgtggataaaagcttttcagaaacatatctagattttaaacaaatcaatccggaaacgatgaatcaggctatccttgatacactatatatgacattgatctcaatggtcttagtgacgatcatcggattagtcttgggattgatcctttactctattgggcgcaaaaacaaaccgtatgctcgaatcatttacgggatcgtatcgatcatcagtaatattttccgatcaacaccatttatgatcctgatggttttgatcattccatttactaaagcaatcgtaggcactatgctaggtgcgcaagcagccattccagctcttgttttatccgcggcaccattttatgcccgtctagtagagattgcttttcgtgaagtcagccctggcgtactggaagcagcagatgcaatgggggcaagttactgggaaatcatctggaaggtcttgatacctgaaagtattcccgcgttgatttctggattaacagttacaacgatctcgatgatcggatttactgcaatggccggcgcgatcggcgcaggtggacttggtggtcttgcttggcaggaaggctaccaacgtggtaatctgacagtgacattcgttgcgactttaattattttattaatcgtatttatcgttcaaggaatcggtgatttcttaactaagaaaacagacaaaagataataggatatagggggatataggatatgaaaaagaagatttttggattagcagcagcgcttttgctgactgtaggattagcagcatgcggtaacaacagcgacagcaaagattcagcaaataaagcagacgacacgacattgaaagtcggcgcttcaccgacaccgcacgcagagattttggaacatgtgaaaccattattgaaagatgaaggaatcgatcttgaaatcgtcaaattcgatgactatgtattaccgaaccaatctttggaagaaggcgatatcgatgccaattacttccaacatattccttatttgaacaaagaaatcaaagaaaaagggtatgactttgtcaatgccggtgctgtccacatcgaaccaatgggcttgtactctaaaaaaatcaaagatgtttctgaactaaaagatggtgcaacgatcatcacttcgaattctgaatcagactggggacgcatcatcacgattttacaagatgctgggctagtcaaagtcaaagatggagtagatctggaaacagccacattcgatgatattgcagaaaaccctaagaatttgaagttcaaccatacgatcgacccatcacttttagcttctacgtaccaaaatgatgaaggtgacctagtcgcaatcaatgcaaacttcgcttatggcgcaggattgaatccattagaagatgccgtattacttgaaaaagacaactctccttacgtgaatatcattgcgactcgcaaaggtgatgaagacagtgacaaaatcaaaaaactgattgaagtgcttcaccgtaaagaagtccaagaatggatcacagacaaatggggcggctctgttaaaccagtaaaggctgatgcaaaataaggaatgaaacaaaaaagatgagaaataagtttgtaacggcttattcctcatcttttttatacctattctaatttagaaatcaaaattgtttaataatcaataaaagatatttgattttagtaaggaagatcattgcgcttcattctcaattagtctaaaatgagtgagaacgaaagagaatttgggggtataatgcatgtctgtcttagaaataaaaaatctacatgtgtcgatcgaggaaaaagaaatccttaaaggcgtaaacctaacaatgaaaaccggagaaattcacgccatcatgggacctaacggcacaggaaaatcaaccttatctgccgctatcatgggcaatccaaactatgaagtaacagaaggcgaaatcttgtttgacggaaaaaatgttttagacttggaagtagacgaacgtgcacgacttggtttgtttttagctatgcaatatccaagtgagataccaggtatcacgaatgcggaattcatgcgtgcagcaatcaatgcgaaacgtgatgaaaacgacaagatctctgttatggcatttttgaaaaagttagatgaaaaaatggctttactgaatatgccagaagaaatggctgaacgttatctgaacgaaggtttttctggcggggaaaagaaacggaatgagatcctacaattgttgatgttagaaccaacatttgcgattttagacgaaatcgactcgggtttggatatcgatgctttgaaagtcgttgctaaaggagtaaatgaaatgcgtggagacaatttcggtgcattgatcatcacccactatcaacgattattgaactatatcacacctgatgtcgttcacatcatgatggaaggtcgagtagtcatgacaggaaatgctgacttagctaaacgcctagaagcagaaggttacgctggaatcagtaaagaattaggaatcgactataaagaagaagaagcgtaagggggagcaagaatgaaagaaaaaaactggctcgattatcttgacgcggtaaatgatttttctttaagtaaaggcgaacctgattggatgagaaccttccgtcaagacgcactaacaaaagcagatgaactgccattgccgcatatcgatcgggtgaaattccatcgttggtcgttattcgatgtgaaagaaacacaaactatcagtgaaacaggcacgattccagcatttgatgcaatgaaagacaatcctgtgcttgtccaacaaggttcatggacgatttttgaacaactacctgtggaattagcagaaaaaggagtcatttttaccgacttgttcactgcaatgatcgaatacccagaactagtccaagaatattatatgaaaaaagcagtaaacctggacgaagaccaattgactgcactccatgtagcttttatgaacagcggtattttcctgtatgtgcctaaaaatgtcgtgatcgatgaaccactcgagtccttattcattcaagatggcgcatccgatgagcacttcttcaatcatgtgttgatcgtggcagatgaacatagtgaattttcttatctggaacgtttccagacaaccaaagaacaagtagcaaaatcatcaggtaatatcatcgtggaagtcatcgctaaagctggttcaaaaatcaaatattcagctgtagatcaattaggagagaatattacttcttatatgaatcgccgtgggcacattttacgagacgcttctgtcgactgggcaattggtgtcatgaatgacggtcatgtgatcgctgactttgattcagatttagcaggagaaggtgcacacgcagaagtcaaaatcgtggcgatcagctcgggcagacaaatccaaggaatcgatacacgagtaaccaataaagcacctcatacgatcgggcatattttgcaacacggagtgatccgagaaaaaggaacattgacctttaacggtatcggccacatcctgaaaggagcaaaaggtgcagatgctcaacaagaaagccgtgtcttgatgctttctgacaaagcacgtggtgacgcgaatcctattcttttgatcgatgaaaacgaagtaactgctggacatgctgccagtgtaggacgagttgatccagaagaaatgtactatctgatgagtcgaggattgcataaagaagaagcagagcgcttagtgattcgaggattcctcggttctgtcttaacggcaatccctgtagaacaagttcggaaagaattagtcgaagtaatcgaagggaagttgaatggatgatcgatgctaaaaagctacgcaatgattttcctattttatttcaagacgtcaatgatgaacctttcgtttatctggataatgcagcgacgacccaaaagccaaaacaagtactccaggcattagcgcactattacgaacacgataacgccaatgttcatcgcggtgtccatacgttagcagaacgcgcgacccatgagtatgaacaagcaagagaaaaagtacgagcgttcatccatgcaaaagaaacagcagaagtgctgtttacacgtggtacgacgacaagtttgaattgggtagccagaagcttcggcgaccgctatatcaaagcaggagacgagatagtgatctcttacatggaacatcattctaatgttatcccatggcagcagttggcaaaacgaacaggtgccgtcctgaaatatatcgaactaacagaagaaggcttcctggatatggaggatgcagcgaaaaagattacggacaaaaccaaaatcgtctccattgctcatgtatccaatgttttaggtgtcatcaatcctgttcaagaattagctgaacttgtccatgaaaacggtggggtcatcgtagtagatggtgcacaatctgccccacacatggccattgatgtccaagcactagactgtgatttctttgctttcagcggacacaaaatgtgcggaccaacaggtattggtgttttatatggtaaacgaaaatggttagaagaaatggaacccgttgaatttggtggcgaaatgattgattttgtcgaattatacgacagtacatggaaagaactaccttggaaattcgaagcagggacaccaaatatcgctggcgctatcgcattaggccatgcaatcgattatttgcaagaactcggcatggacaatatccatcgatatgaagaagaactagccgcttatatgttgccaaaattacaagcaatcgatggattgactgtttatggtccgcaagacccgaaatttcggacaggagttgttgcgttcaatttggatgggttacatccccatgatgtcgcgacagctttagacatggaaggggtagccgttagagcaggtcatcattgtgcgcaaccgctattgaagtaccttgaagtatcagcgactgctcgcgccagcttttatttctacaacacgacgcacgacgccgaccgtttagttgaagcaatcatggcaacaaaggagtttttccaacatgggactatctaaattagacaatttataccgtcaagtgatcttggatcattcttcccatccgcatcatcgtggaagcttgaccgactcgacaagcaagattgaattgaacaaccccacatgtggagatgtgatcgaattgcaagtcgatgtaaaagacggaatcatcaaaaatatcgcctttgacggcagcggctgctccatcagtacggcaagtgcctcgatgatgacagacgccgtcattggaaaatcaatagaagaagcagaacatttaactgtagactttctacagcttgtccaaggaaaagaagtccaagatcccgaccaattaggcgatgctgctatgcttggtggtgtagctaaatttcccgctcggatcaaatgtgcgacacttgcctggaaagcactaggaaaagcaatggaaaacgatggtaccgcagctttccatcattaccacaaggaagaggagtgagaacatgggcgtaccagaattagaagaatataaattcgggtttcacgatgatgtcgaaccggttttcagtacaggagaaggcttgacagaagaagtgatccgtgagatgtcaagaatcaaaggcgaaccagaatggatgcttgaattccgtctgaaatctctagaaacattcaataaaatgccaatgcaaacatggggccccgacctttcagacatcaatttcgatgccatcaaatattaccaaaaaccaagtgacaaacccgctcgtgactgggaagacgtaccagaaaaaatcaaagatacatttgaaaagattggtatcccagaagctgaacgagcttatctagccggtgcttccgcacaatatgaatcagaagtcgtgtaccataatatgaaagatgaattcgaaaaattaggaatcgtctttactgacactgactctgctttgaaagaataccctgaattattcaaagagtacttttcaaaacttgtaccgccaaccgacaacaaattagcagcgctgaattcagccgtatggtcaggtggaacctttatttacgtgccaaaaggcgtcaaagtcgatgttccattacaaacgtacttccggatcaatgcggaaaacacggggcaattcgaacgtacgctgatcatcgttgacgaaggagcaagcatccactatgtcgaaggctgtacggcacctacttattcaagtaatagtctgcatgccgccatcgtagaaatctttacaagaaaagatgcgtattgccgttacaccacgatccaaaactggtcagacaatgtgtacaacttagtaaccaaacgagcaaaagcatacgaaggcgcaaccgttgaatggatcgacggaaacctaggtgcaaaaacaacgatgaaatacccaagtgtttacttagatggaaaaggcgcacgaggcaccatgctctccatcgcctttgcaggagcaaaccaaatccaagatacgggtgcaaaaatgattcacaacgcaccaaacacttctagttccatcgtctctaaatcaatctcaaaagacggcggtgaagtaaactatcgaggacaagtaacctttgccaaaaacagtgcgggttcgatctctcatatcgaatgtgacacgatcatcatggacgaatggtcgaaatccgatacgatcccattcaatgagatccacaacagccaagtctctttagaacacgaagccaaagtctcaaaaatctcagaagaacaactctactatctgatgagccgaggcctgaccgaatctgaagcaactgaaatgatcgtcatgggctttgttgaaccattcaccaaagaacttccaatggaatatgcagtcgaactcaaccgattgatcagttatgagatggaagggtctgttggataacaactaattaattgatcgaaacgtttatattaaagcgtttcgatcatttttttatttatcagtatattaacttaaaacaaacgaccgtccagaaataatgaactgaacagctaatattatccatttgtctgatgaatctaaagacttgaatgtttactactagattgttcaaattctagtagtagctcaagcaacattttttagtcactactttgagtgcgaacgacaataataaaatgtatgaaagggaatggggataattttcttccctttttactaaatacattcttttccgttattagagaggactgagcactcaatataatcctattcgttgattatgatgccaaacaaacttgcgaaggctgagcttgctagtgagtaacctttttagaaatggagcgagataaattcacttcttccatttgttcgaactaattgggccgtcggtaatgagtatcacgattagaataaacgattggattcactttgacttggcgggtagcgagtctagcacttaacatattatttactgatcctgcattaagcttgaatttaatggactaactaatgatagcaatatcgtgataatcaacaagtagtaataaatgaattttctctgcgggaattctaaactcaaaattatctgtcagccaatttcagttggcttttttcttcttatttggagataaagaatttttcaacatatcctctttataattttttggttaatttttccgtatttttccaaagttttctagccttggttgctgctatttcttcacaccattgcgtcaggtatcactatttggatttggaactgtactcccagaattaatgggtacctttaatttgattttttatcaaatgccggaagatgctgtctttaaagcccttggggtagaatagacaactttttattaagctaatatcttcagaaaattaatcaatgaacttaacttcatagtttaaacagaaaaaattaattgcttaaataacttttccatttgctggtttgaccacgtaccaatctatattacttactagattagtcgttaatctattcggatcgaatgggcaaaatatttttgtgtatgttcgtccttgattatgattccaaaaagaatcattgggaggctgtggcgtaaatattatactataagccagaaatacctatatttagttatttctggattttttgatagaaaaataacagaagaataatacaaatagcctaatactagaatagttagtcattttttttacctatcattctgaacttttttatttaggaactttcatctcaaagctttttcaattaatttgtacccctgttttttttgataagatcatgtgcattgttctatctctacgttcatctcctacttaatgcctatctggctcctgagggcttctttttaaggcgtcgtcatagtcttggctgaggatttcttggtaatctgagggaatggcttcccaagagagcaggcgaacgttcatgacgtgttttcctttatgtttgattacagcatgattcttacctttttctacctctccagcgtgaaaagagagccatgtaccatgaccaaagatatcattacatacccaatgttcgatggaattttccacgtatcctacagggagtgtggtatagccgatttgtggtttcaaaaaaggattgaatcgatcaaccgtttcatttttgtattgataattgataagaaaaagatagaccaaaaaaaagacgagaagaaagatagtgcctttttgagtgataatggtggttttgatgaataagatttcttgttaacaagaggttcgtctggcaatgttggttctattgattcggtagctgattcaatagaaggaaaatcaatcggcagacctaaagtctgatgtaaaagtgacagcatttcaagatctggcattgtacgagaattttcccaactagaaatcgttttatcggaaacaccaattttttcgcctaattctttttgcgtaaggttacaatttctgcggtaagttcgtattttttctccgatgttcatcttcttctcctttcgattctacagtatatagatttattctacatgacctatacacttgatagatacgtttttttgatgaaaaacggtatgattttatcaaagaatcatttaagtaagggagagtggtgataatcaaaaaaaagttcacagttttactcacaatcatagtgaccggtatcatgagtggttttgccttggttagtataaataaacaggtactctatcggacaaatgaatttttccatcaaacagatacttatactccgattcgattgccacaacattttattgggcaagaagaatatgagcagctaatcatggtatttgaaaatgtctcatcagaaactgagctttcttatatgaaaaaaacagtaaatgaatccgatgaagtagatacatcttggaacttcaagatacagccaaagcttgaaatgacattgtattatcaaggggatgtcaaatcttctcacgagaaggtaccctattctaatacctcctttcgagtaacgtccattgaagaatcgatcaaaataaaagattttgaaggtgaatttttcttgatgacgagagaaaaagaagcctatgaacggttcattttactatttgtggaacgatacaatcaagcatttcacactgattatgccactaatatttttgaagactttgaaaatagctattcgtattcggttatttcaagtacagacgtatataattatcgagtgtatttaactattggattgattcttttattccttttgttatcatcctttttcttattgatgaataaagaaatcagtttattgttgaataatggcttttcattatatcaagtattgtggtgtttattggggaaaaagaaaatcattattacattcataattgcaggaatcattggtggttttatttttatgtattataaggagcaatttctttatttgttccagatgtacgttttcttgttcagcggaatatatggtatctctttgatttctcttttattagttgaaaaaatcgcttcgttaagagaagcgttcaactatatccaatacattctttttacatttggattgttattttctcttcttttgaccgttgccaatgtcgaattagcaactatcgttttttcttcttcacagttagctgtttcccatgaaccaccaaaagaaatcgctggtgaggactatcatgtattttatccagtaaccatcgggaaaaaccacgtggattttatttattccaatcgttttgcatcagcagcagatcaggaattatatgaaactttgaataaaaacggaagtatattagtcaatgtatcagattacttgaatgaagaaaacgaacagtttggcagagggataaaaataaatctgaattatcttaagaaatttcctttgattgatgtctctggaaggttgatccaaataaccgaagaagaaacgcaccctgttatattgatccctgaacgatatagacatacagatttaaaaaatgacttggcgcaaataacagaatattatcaagaaatcagtgaaaaagaaccaaaatttctatttataaaaaacaatcaacccatttatacatttattccttctatcccctggatcgaacattatccggttgttgaaatactgacattgaaaaacagtacgtattgggaaagaaatattctcagcggagaaatctatccactgttaaagatcaagataggctctttgtcgaaagaaaggttatttgagctgattgaagaaagtcagttacgtgataacttgcagttatcatttccgtatactcagactgaagagatagctgtcaaagtgttaagcagatcatttcattacttgatacagatatttttactcactttcttttctttcttcttgttgagctatgtcatgttatgcatatattttgtctacaattgtcggaaaatcgctatctttcgttcaagtggttattcgctctttgaaacgtataaagatttcttcatgatgaacctcatcaaatggggaacgacaagtgtaatcttcctttttcttatagaaagagagcctaaatatctttttaatatttttttctttagcttcattgattttattctttcagttgtttttattttgtctacagaaaagaaaagtcagttattgctgatgaatggaggttaacaattggagccgttgatagtgataaaaggtgcgaaaaaaatcattcgaaacaaaacgattcttcatttggatcgtttcactgcggatgctggggatcttgtgactgttgttggagaaagtggagcaggtaaaagtacgttattgaatatattaggattgaatgatcagttcagttcaggacaattctatttgttcgatcaagagatgaaacaattaactggaagagagaagcgcttgataaaaagaaataccatatcttttctttttcaagattttgggttgattgaatatgaaacaatcgattttaatttagatattggattgaagttttcgaatttaaatgtttcagataagcgaacagcaaagtttgaggcattgaaaaaagtaaatataaacaagaaactaagtacgcctatctacacattatctggtggtgagaagcaaagaatcgcctgtgcgagagtcttattgaagaatagcaaaatcattttagccaatgaaccaactggatcattagataaacgaaataaggagcaagtcgttgaaatcttatcgcaacaggcttcccaaggtacgttagttatcgtggtcatgcatgatccatatctgaccaaaataggaaacaagaagatcatgctttagaaaacaaatgaaaaatcaatttttttcaataaaaacaacaaaaaaatgtctggaaaatcgaacataaaagtgtctgatttgaatatcccagcagcggaagaagaaaaacaaaatcgataacatttgttctaagaattagttacgttaaatacggaacgcaagataaacttgaaaaacggtaacaaaagaagtagtatattaaggtgtgatgtgctacttgacatttattctgctgagcgaactttctggattgtgtagccttatatctattcaggacgtatcgagcagattagtaaaggtgttcttgatgattttcatcttgaacacctttgtttttagcaattcgcaaaaaacgaaaagtaggagaattgataaatgaaaaaaagatttttagcacttgccatcgtactaggcactggcttattgtcaggctgtacgaatgccggtgaaaaaacagccgttagttataaaggcggtacaatcagcgaacaagaagtaatggatagcttgaaaaaaatgcaaggagcagattccgctgtgcaacagttgatcgtttatcaagtatttgaagataaatatggagatgacgtatcaaccaaagaaatcgattcccaatatgatcaaacaaagaaacaattgggtgattcatttgattcacaattgaaatctgcaggttacacagaacaaacattcaaagacagtatcaaacaaagtctagcctttcaagaaggtctaaagaaacatatcaaattgaccgatgaagatttaaaaacggcttgggaatctttccatccagaagtggaagctcaaattatccaagtagcaagtgaagatgatgcaaaagatgtgaagaaagctgctgataagggagacgatttctctaaattagccaaagacaagtcaactgatactacgacaaaagaagatggcggaaaagtgaaatttgattccactactacaacggttccggcagaagtcaaagaagcagcctttaagttgaaagatggtcaagtttctgatgtgatcacttctaccaatgcttcaacttataatacggaatattatgtggttaaaatggtgaaaaaccaaaacaaaggcaacgacatggataaatacaaaaaagaattgaaagaaattgcaacagacacaaaattaagtgacagtaccttccagaataaagtaattggcgaagtattgaaagacgctaatgtaaaaattaaagacaaagactttgaaaatgttttgagtacattcacttcagattctagtacagcaagtagtaaataagcggtataaataaaaaatatgaactatttaaatcaataaaactgttcatctaaatctttttattagaactaaatcaacagtagtttaattactacttgatttagttctttttattttaaaaattttttttacttagaatccagcgaccctagatatttttctgtataatcttaaataaagaaaacaatatcaaaaaatgcacgtagaagtagataaatggagtggttttgcaaatttcttttatttctagaagttattcacgtatacggatttgtttttctcacaaataaaaagtcaggaagtacaatggatcatttgtatataaaatatattcatcaattttccgttttggtgttaggcacactaattatagcggggattgtcgcatttattattcaaggtcgtgacatattaacagtacatcaagagtttttcagttatgcatttggtattcctctgatcgctataaggtctgataacaaaaagtggaagaaacgctattacattctcttgctatttttgtgtttttatctgccacctaagatttttattttattaggtatacaatgcctatcattttcttttatttcctatatcattgttttaattttcctcagtttcatattatgggtgttttatcttgtcaaaaaataaatgaatgtttcatgaacagtacttcatcacagcctaatttttttctttatgctatcgttatattaaagaaatcaatcagaagggaaagaaagtgatgaaaaaagttttattagtggtaaaccccagttcaggcggtgaacaagcaaaggaatttgagcaattagcgatagcaaaattggaatcggtgtttgatgaagtggtcgtcttgcatacaaaaaaagcaggggatgcaaaaaactttactcgcgaagcggctacggaagggtatcatagtatgtttgtcatgggcggagatggaacagtcaacgaaggaatcagtggaatcgctgaacaagaacatcggccaaatttcggatttttcccattgggtacggtgaatgacttggctcgagcattagggataccgctagaacctgaggaagcgatcaatcatttttcgattgaatcagtcaagccattggatattggaaaaataaatgacgactattttatgaatgtcgtcgcaattggctctatccctgaagcaatcaatgatgtagatgcggagaagaagacgaaatttggaaaactagcttatttcatgtcaggaatcaaacagttagcttccacacaatcctactcgtttcacgtagaagttgatggaaagaagaaagaaattgagagcagtaccttgctgataggactaactaactcagtcggcggttttgaaacattacttccaaatgcaaaagtgaatgatggtaagctccatttggtttatttaaaagattcttctttgatcgatacgcttaaaacattgccagacctattaaaaggagtagatgaatctacgaaaaatctagcctatcttacttgtgagcaattagttgtgtcattagctgatgatgaagaattgacgacgaatgttgatggggatgaaggggataaattacctgtgataatcaaagtgttaccctcacatttacaggtttattgttaaaatggaggttgtggccgaagagttgtcaggagaacaccacttgttcgggataagggactgtgacaagacttttgtcacagcctagactgtgacaaaaatattgtcacagtcccttattctgaataaatggtgttctagagacagcctattagccataaggcacgattttgtaaaaatatgagaagctatttttcaaaaatcacttcttatcgctcctgcggttactcgtcgcaatttctttgttagagttctcatcatcgctcaaggctgaatgtctctttcacaccctcatttttgcgtaagatcaatttattcgaaaaattctccgtatacatcttctacacgttggtctgggttgatcacgatgtacaagttacctgttttttcgctgatttttgtagattggtattgattgtctaatccttctgttcctttatctagatatgggaagtatacaagatcaggtgttccattgcggtaaaggatttccattcgttcgatatcttcgtatttcaatgcacgattaaacatgcccatttccagtccacctaagttgatatcatgtgtcgcaactgcgtccccctcatggaaaatttcgattttaaatccggcacatggatggatttcaacaaattcactgccgttgatccgtccaaaacttgttgtgatttgtttgatccaaagatcgccgatgtgacggcggttaatcgtccatgtttctccatttctaaaataaaattttagcgctgtcatttctttactcattaaaaagactcctttatgatgtaatttattcttgtacttcctcagtttagcacaaatttatgtaagtggtcacattttatgttttttcttctaatgacgtatctgcccagtttaagtagctagccaagctgagcagatacagtctagcgttttttaaatcaatttttctttcgataaaaaatccaaaacctgttttttatcattttctattctttgttctacgacagctttttcagctgattgcaaagcttcactaacccacttaccaggtttttttccactttcttccagcaagattttaccatctacagctaattcgcttaatgacttgataggtaaacgatcataggattcttctacgacatccatctgtggtgtttcatcaaaataagtcattaattcttctacttgcaatgcatgctttttgcctaagaagtataattcgaacggttctaaaactccagtttttcgttgacgcagtccttgaacaagtgcttggacatccttgatcatttgattggaacacttccacgatttcaaaaaggagcgaatttcattttcttttagatccagttgactgattaataatgtccatgcttgactctcttctttcaatggaacggaaggtaattcagcaaaacgtaaaagtgcttcaccttcttctctcaaaccagggcagcaaatataacattctgttttaatgaatgcatggattcctgcagaccgttcatttcccaaaagcatcttgatgaattccaaatttatacgttctacagatattttgcctaatagctcgtggttttctttgatggcgtagaaggtttcttcctctaatttgaatcctaattgactgacaaaacgcaacccacgcatcattcgcaaggcatcttcatggaaccgctcatgaggattgcctacagctcgcaagatttgttcttctaaatcttgcagaccatcgaacaaatcgatgatttcgccgtcttctttcaaagcaaaggcattgattgtaaaatctcttcgttttaagtcttcttccaacgaacgaacgaattctacatgatctggtctgcggtagtcttgataagttgattccgtccgaaatgtagtgatttcatattgttcatcgttttctaataccaatacagtcccgtgttcaatcccgatatctatcgtttttggaaaaagctgtttgatttcttctggaaatgcgcttgttgcgatatccacatcatggatcggctggttcagcaagatatcacgaacacttccacctacaaaataagcttcatatcctgcattttctaattttttcagaactggaattgccttttggtattccagaggtaattgttttaatttcatttttccaacctttcctgcgtgtttcttgtactgagataagtactcagttgcatgatgcctgattgataagtccgttttagtagcttcaaagcacaaaccactttttttacttgtccttacgttcaaagcggttatggtctctttgattgaatttttccatatttttttcaaaaacatcagttaagtcgatattcaatgaattagccatgatcatcgtaacgaataaaacatctccaagttcttctgctaccgagttatctggttccgaagcttttttgcttttttctccataagcgtggttgacttctctggccaattcacctacttcttccgttaatcgagccagttgagctaatggagagaaatacccgaccttgaattgttggatatattcatctacttcctgctgcatactgtataaagaacgtttttcatccatctttttccctccaaaactatcttaccaaaactttaacgcaaatcctagataagagcaattgagaaaaacgaatttccgtgctacatttaggaaggaatttctaaatggagattctgtgaaaatacataattgaaagctgggattcatatggctacacggaaaacagtaaaagaagtactttttattattataggaacgagtatttacgcatttggacttgtttatttgaacatcgctaatcacttagcagaagggggcgtctcagggatcaccttgatcttgagagctttattcggaattgatccagcttatacgactttattaattaatatcccgttgattttactagggggaaagatcctcggaaaacgttctttagcctatactgttctaggtacactctctttgtcattctttttatggatctggcaacgggttccgctagaaattaatttacagcatgatctactgatcgtttctctacttgcgggtttggttgcaggggtaggaagcgggatcgtctatcggatgggtggaacaacaggcggaagcgatattatcgctcggattttagaacaaaattacggcatctccatgggacgttccctattggcattcgatatcatcgtcttgcttgcttccttaacctatatcgacttgaaacgcatgatgtatacgttgatcgtttcctatgttttcagtcgcgtgattgattcgatcttagatggcggatattctgcaaaaggtctacttgtcgtctccaacaaaagtgaagagattgcaccgctactgatgaccggtctgcaaagaggtgtgactttcctttctggagaaggcgcattctctggtaattcaaaaaaaatcatctatatggtcgttagctctagtgaattaactgaagctaagaggatcgtccacgagattgacgaaaaagctttcctttcaatcatcaatgtgcatgaagtggaagggcaaggctttacttatttgaagccacagacaagattactgaaaaaactataagaaaaaagacaaagattggctatgaggaaagattccacatccagctgacctttgtcttttttagtactatactgtttttaactaattgttatgttcacttacccggttacttttcttttgtgtctgcaaaaggatctttcggttaacttcatcagataatttcaaaaaagcatccctatctccatcttctagcgcttgatcgatttgagcataaagcatatttagttttgctgcttcttctttttcttgaaaatatcgctcgatcaattcagtatcttcttcactaacagaagcatcccaagaagaaaatggattatcttctaagatcgatagatattctcttgtctgccaagcattctcaaatagacattccacatataagggtttcttccaattcaatcggatctcatgaaaaatctgatctgtatccgtaaattcttttccctgcaaaaacaatttcattggttccccttcaacagatagatcactgatttgcagacctcgatccgcaaaatttgccccttctacaaagtggacattacttaaaatcgcttcatgattggcaagataattcaagatccaaaaaacttctcttcggctaaaagatacatgattgaccatccacgttaaaaaattcttcttttcccgtacatcaattagcatttttctcacctctctgttagatcatctaataatgacagtgcctccatatctcctggttcaagttttaaataatgagtcaataattcttgcgctctttttagctgtccttcttctcttaagaaaaaggcatattctttcaagaaatctggttcatgagatagttcatgataagcttgttcatagtgtacagctgcaacggtgaagtcttctaattcattataagcatgcgctagattccattccgcatacggattagcagtttcttccatctgattgatcacttgtatcacatcttcatatctttcatcatccaagtaaagattgcttaaagtaagtaatgtttcatcttgtttatctcctacttctaaagctttcagcaagagttcctctgctcgctgtttgtcgtgcagacgaaaagcattttcagaggctagatgataaagttcaacttggtaaggattttctttgattccttcttctaacactgtttgcgcttcttcaaccatttcttcttcttgaagagcttgtcctagatatagatataatgattgataatgtggattaacttctcgaagctcttccagatagttgattgcttgctgattttcttttaattggagattcgtaaaagctagctgaaacagtcgatcatctgtcttttcttctttcaatgcttcttctaaaggtgcgatagctgcttcaaattcaccttgcatgcttaaggattgccctaaacgttcttgcatcgagattcctgacatctcgtttattccacttgccaacaatgtttcataaattactgctgcctctttgaaacgatcgactgaaaaatacaattcagctagtgcaaactggatcaatggttcatccggtagcaaccctgccgcttctttcaattttgcttcacttacttcaggaatcccgatgacttggtacaaatcagctatcgccaataagctttgcggatagtaatcactttccttatccactttttccaagtattcaaaagctaggtcaatctcattgtcttcgattgcaatttctgctagcgggatgtttagtccgtcattttctggatattggttgatcaattgttcaaaaatctgttttgcctcgatcaaaaagccaatagctagcaattcttcccctagttcagctaatatatctgctggatcttcctttaatgctttttctaaaaagagttgtgcttgtgccagatcttcatctgataaagcttgcaacattttttcgctatttgtattcatttcaattccctcttatctcgctgacgatttgttgaaataccgtcattgttctcaacaattctttttcgtttggtcgttggtatccgtctattatacctattttttctaaaacaagtatttttttgcttttttctgccaagaaaaggactttttccaaatactccatctttgaaatctgttccaaccattggataggatagccaagcaagtctagccatacaaaaaaattttttagttggaaatcaaacggataggcttggagattccacacgaaatgaaacatcatccctaagaattttttcatactagcagaaagcaagtgtccattttcagtcagataaaaagcttgttcaaatagtttaccataattcgacagattttctgcctctaattgataaaaataaatcatttcttcgatcatcccggcaaatggccgggtcgttaattgctttttatttggatagtttttatacaaattttgtaaaaaacggtgatcacaaatcattccgcaacagataaaagtcaaaaagtcaatctgttttccgtccacttgccgctcgctgatcgtttgatcataaacgatgcgttctggcatgttgatggtttgtagcacgacacgattcggtagctgcaaaatcgttcgctgtggagttaatgctcggctcagcgaacggatcgagacaggaatcagccaaagtgatgaatcaaggattgtatgtttttgaaaaaaacctgccagatccatgatcccttcatttccaaatccgataacaaacatggattgattttcgggatagcgtttggtgaaatcaagcaagttcttcaattctgttaaatgattgcattgagtattggcacaaatgtaccagtcattatttgcctgatttgcaaataatgggttgatcttatctgcaaacaaatcataataacgctgatttgttaaaaacaagatgggttgatcgatcgaaagtgctcttagttgactgacaagcgtttctccgtagaacacttttgtcaatgcttcttctacttgataatcaagttccatacgcatccctcctcttcttatttttattttaccattagtaagcaaaatctagaaaagataagggcaaagtccacctcttaacttggaaataaataaaaattaaataaaatacatgtgttttttatgtatgacatacggattcgaaatttttgtctcttaattgactttttctgctaggaaataaaaagaaaagcacttgtagccttagagccacaagcgcttttttactgtcttatttaacagcgtcttttaatgctttacctggtttgaatgcaggtactttgctagctggaatttcgatttcttcaccagtttgtgggttgcgacctttgcgagctgcgcgttcgcgaacttcaaagttaccaaaaccgattaattgaactttttcgccgttagctaaagcatcttgaatagttgaaaatacagcatctactgctgcagttgcatcttttttagttaaatcagtagctgaagcaactttttcgattaattctgctttgtttgccatggatagattcacctcctccacaagagatatgatagaaatatcatttagttaaaactttctgagtggtccagaagtttaaaaagaaatattgattaacttcaatattctgttatcacgatatcatatgaaccgcttaatagcaaggtttttaccaattttcatatgctttttttagtcatagaaacgtaacaaacaaaactatctttttcttttgaaaaaaaaacgttgatatggtaaaatgcctattttcttctacgagggatgattcgaatggatgtcccttcaaaagtaaatgcttttctgatttgattttctaagaaacgctcataagaaaagtgcatcaattcctcttcattgacaaaaacaacaaatgtaggcggtttgacagcgacttgtgtagcataaaagatcttcagccgttttcctttatctgtcggtgttggattgatggctacagcatccataatgatatcattcaaaacagcagaagagatacgaagattctggttcatacttacttgttcgatcatttcaggaagacgttccaaccgttgtttagtcactgcagaaacaaagacgatcggtgcgtaatctaaatatcggaattcatcacggatctcttgttcgaaatcacgcatcgtattggtttctttcttcacaagatcccatttattcacaacgataatgacaccacgaccagcttcatgagcgtaacccgctactcgcttgtcttgttctcgaatcccttcttccgcgttcagtaccatcaaaacgatgtcagaacggtcgatcgcacgcatcgcacgcatcacgctgtatttctcagtattttcatatacttttccgcgtttacgcatgccggctgtatcgatcatcaagaatttctgtccactttcagaaacaaagtgagtatcgattgcatcccttgtcgttccttcaatatccgaaacaatcacccgttcttctcctaaaatcgcgttgatcaaagaagatttaccaacatttgggcgaccaatcaaactaaacttgatcgtgtcgtcatcctcttcttcagtctcttcagagaaatacttcactgcttcatctaaaatatcgccaattcctagtccgtggcttcctgaaacaggataaggatcgcctagtcctaaagaataaaattcatagatatcatttctcatttccggattatctactttattgactgctaaaatcactggtttattacttctgtataaaattttcgcaaccatctcatctgcgtctgtcacgccttcgcgtccgctgacgacacagatgatcacatctgcttcttcaatcgcgatttctgcttgatgtttgatctgatccataaaaggttcatcgccaagatcaattccgcctgtgtcgatcacgctaaattctcgacctaaccattcgccttttgcataaatacgatcacgagttactccaggagtatcttcgacaatcgagatacgctcaccagcgatgcggttaaaaatcgtagacttaccgacgttcgggcggccaacgattgcaattgttggatttgccatattatttcctcctcacaagtttccaatctcacttagtttaacgaatgcaatgccaactttcaagcatagattgtcaattaaacgaagtatttttattccttaatgaaatactaaccgcttttcaaaagaaaaactgagacaaaagcagctgctttcatctcagtcacagatacaaaatcaattatttttcagaatcatcggttgctttttcttctacttcttctttcaacgcatcccctaaaatgtctcccatagtgaatccagtattttcttctggtaattcataagactccacattttttggttcttcttctgaagctggtttttcttctaaagctttgatactcaatgcaatacgatgttcttctggatggatctccaatactttcactttcacttcgtcgccttcatgaagtacttcgtgaggtgtggcgatatgtttatgtgagatttgtgagatgtggactagcccttctactccagggaatacttcaacaaaggcaccgaaacttgtcagacgtttaacagttccgtccaatactgctccaactggggcttttgtatcgatttctgaccaaggtccaggctgtgtatctttgattgacaaggaaacacgttcttgctcagggttgatagacaacactttaacgtttacttcatcattaacagctaacacatcacttggttttgctacatgactatgagaaatctctgagacatggactagaccgtcaattccgcctaggtcgacaaatgccccgaaatcagtaagacgtgcgacacgtccgctaagaacatcgccctcatgaatcgttgaaaggatttcttttttcttttcttctctttcattttcaactaccgctttgtgcgataagatcaaacgattttctgatggttcgatttcaatgattttaaaactcaatgttttgcctttataatctgaaaagtccgcaacaaaatgatcttccaccattgatgcagggacaaaaccacgcacaccgacgtcaacgactaaaccgcctttgacaacatttgtaacaggtgcttcaattaccttaccgtcttggaaatctctttcgatgtcttcccaaacttttttagcatctaaacggcgttttgaaagaagatagctgccgttttctttatctttgccgatcgtactgataacaactaagtctaatacatcgccgactttcactacttcgttgatatcttctactggtaaagttgataattcttttgccggaacgacgccttcaactccggccccttcgattccgataattacttgtttgtcttcgataaccaaaacttcgcccttaacaacatcgccaacttttacttcttggacgcttttcattgcgtcttccattgactggttgttctcttgattttgatcaaattctgtcataacacttgtcctcctaaccaacattctgccgtaagtacggtactgtttttagtttaattgattattcaaaaaaaataaagcgatttcgttcgttttccttgaaaaaacaattgtttttcagtttttttcttcatttaaaaaagaagatatcccttttccaaaacgacggcttttatcgctgcaacgacttctggaatggatttgccggtagtatcaatacgaacagcgtcctctgcttgctgcagcggagaaacttcccttgttgaatcataatggtctcttgcctgtatctcttttgttaatgtttcaagatcagttgggatacccttttcttggttctctttgaatcgtctttctgcacgctcacttacgcttgctactaaaaagatttttacttctgcattcggcaatacagctgtcccaatgtctcttccgtccatcacaacgccaccgcgttcgcctattttccgttggatagcaactagttcttctcttactttcccatgagcagagacttctgaaacagcttttgtgacatctggctgacggatttctagtgtgacgtcttttgatgctgtgaatacatgctgcccatcttcttgttgtgaaaaagagataggatactttttgatcagtgaaactagtccttcctcatctgaaaaagatacattattcgtaatagctagataagttactgcgcgatacatggcaccggtatccgtataaatataatttaatttttttgctaagattttggcaacggtgctttttccagatgaagcaggtccgtcgattgcaatactgatttgtgtcatgatataactcctttttctcaaaaaaaaagccgcaaagcgcggctattattatttaattcttagctcttgaccagggtaaagcataaagttgtttggatctaagccattcaattcaaacaattggtcaatggtgattcctgcacgctcagccacttgttttggaccttcgcctgcttgaacagtcgttgtcgtaccggctacagctgaggaagaaggtgttgtttctgctgcattgctgcttgaatcccctgcttgataagttgtgtcacttgaggaagaaggtgttgtctctgctgcaatactgctttctgacgttacccctgtatcttgagaaacagtagattcttccgccattgtactagattctactgttgaagtctcagttgactcctcttttgttgtacttgtggaactttctactactgatgtcgaagtttcagaagaagatgctgctgttgcattgttgcttgatccgtttctgatccagaaataagcacctgctggaatagcgatacataagactagtaaaatcaaaaatagcgaaagaaataatgtatttcctttcttttgttgtctctgagaacttcttgatgaaacctcatcatctgtatcatagattggttgttcccatggttcttgtgtttcgttattttctgtagattgatgtctatcttttctgctcactgttttacctcctaaactctatcgtgtgtattataccataggaaaaagtgtcttgtcctaaaaaatcaatgttccatgttttttttaaataaatttagtaaaatcgattcccaatgaagcggttcagtcttagaaaaagcctttttctttggtagaagttctacttttgcgccatcaatatcacaacaattctgcggcttttcggaaagttcttcaccaaaataggccaagatgaattttctgcggcagtcttcttcatggatataacgaagcatctgctgtaggcggaattctttttctttttcctggcgtttgagccgttccacccaattttctggtttttcagactgttggatcaactccatccattttttttgcagctcatcaaatggcgcttgctctgctgcatattccaaataaagctcaaaactttgtcgctgttctctagaaagttgattaaagaaataatgaatacgttcatctccactttgatataaaaggattgctgcactttcttcttgatctctgcctgctcgaccaatttcttgtacatagttttccagactgtctggcaaatcgtaatggatcacataacgaatatcagatttatcgatccccataccaaatgcgttcgtagcaatgagaaactgcagctgattttttacaaactgttgctgaagctgtcttctttgagctgtgtcaaggccaccgtgataatatccaactgaaaagcgctccctgaataaatgatacaagcgttcgacttctttttttgttgcacaataaataattgccgcaccttgtgctctttccatgaattgttcaagttcttgttctttttgctgcgtcttccgaacaaaaagcgagatgttttgtcgattgactgattgtctaacctcttttggctgtcgatcaaatagcacctgacgtatatctttcgctaccaaatctgtcgctgtcgccgttagagccaatgtgactgggtttcccaaatgctcgcggatttttcctaactgttgatattctggccgaaaatcaaccccccattgtgatacacaatgggcctcatccactacatatagcgctatatcctgttttttcagctgctctaatagagaagtgttagtcaacatttccggactcaaaaataaaaatttatattgcgacagatgacggagaacatatcctctttcagctcgtgaaagcaagctattgaaagcagctactcgtttttcccctcgtttttgcagttgtgttacttgatcttccatgagtgaaagtagcggtgacacgatgaggaccatcccatccattaaataccctgttaattgatagcataggcttttccccgttcctgtaggcaaaatagcgagagtatcttctccatcaagcaacgcctgaataatttcttcttggccgggtcgaaatgaatcgaatccaaaatatttttttaattcatttattaacattctgtatcgcttcctttctcaatagatagatttgatacaaacgaaattctccataatctaattgtccatctacattccattcgctgaagcgccactcgcgcacggaatccttatttggttccaaccgttcgaccgtttcttgagagagaatccgctcgtatggaaaatcatcaaaaaacaaggcccactcaataagatgatctgttaccgtccctttttttaaatgacggattgccataatctggtcaattgtctgaccattcataaacatctgcttggtgatcatcatgctttgattgaaattttgctgtaataacggatcaatcaacacataccatagcgaatctggccgttcttctatttgtgcgagcaaaagatggatacatctgctttgttgtaaataaacagctgactcatcattggtttttgctagctgatatggcagaaggcctgttcgatcatttccagagaattggttagctaaaaaatcggctgctccttctggtatctccgaaaacagttgcgctaaactttcatacgcgctatcaatcaaaattccacgtgacaatctgcttccactaagccattttttcagttgaaaagtataaaaaggacttgtctctgctggaagataattttggttcccagatgccagattagaaatcacttgaacagcaaatttgatgagccgccaactagtttccccagttcgtccatatcggtcaaaacgcaaaccagtatattctgtgtgaagttcagacaacctatctgctcctgcagacgttagttttgcttcattttcatttatttcgatccagccttgctgtgcaagtttttgcataatctgagaaaacttgtcctgtttcaattctggaaaactgttatgagcaaataaaagttcgtgagtaaatccgaaaataagtactgaagtcgttcgttttcccacaaggagctggtaaagagagctgactcgcagcttgtttcttgatgaaaatagcgataaaataaaaacaatcatattattctccttaagttaggatggttagaaatgtcactactatgtaaacttgtacctgaacgctgtattgcatgcggtctttgccaaatcgaagcgccggatattttcgattatgatgaagaaggaatcgttttatttgcccaagaaccagaggctcatcaacagttcgtcatgccggaagaagaagcgtatgtaagaaaagcgtatcaaaaatgtccagttcgggcgattttattagaaaacaaaatttaagtcaaactaagctttaaaaatgaacactagattttctaaacttgaaaataagccgggatctgtttctcccattccgtgaaatcccgacttattttgaaagttatatttattatctatttatttgacttgttttttcatagaccctataggacccatttcggttatttcaactttttcagccagttttccaatgtattgacaatcacagtttgctgatctgcgttagaaatttctgcttctccatctcctttttgctcaccatagctaccaaagcctccgtggttcccgccgttgattgatacatactctgttctttctggtaagtactgcttggcttcttcataagctttctgattcaatactttatctttagttgctgtaatggataaaactgggacagctgattctttcaatgttccttttttatcgggatagcttgccatgaagaataccccttttaaatgactgtctgaatgattcttattcgcatatcgacttgccatgacaccgcctaaagagtgaccaccgatcacataatcggaatccggaaaatcttctttgatcttatccgctttgtttccacctatcactgctagatcaagaggcattttgacaatagcaactgagtagccgttttttgctaaatcttgcgcccaaatactataactttctgggtctacgagagcaccaggataaaaaataagtaatggagactttgcctggttctttttctctccttcaaaaaacaaataatcttctttgtttcttccttcttttaccaccttttgtgcttctgacgatggttcgtacgtattttgctgtatatagtaataaccgcctccgccaagtaatcctaaaataatgactaagccaattagtattcgtctaaatattttcaatttctcccaccttttctatctgagtttataccttcttctcaatcaagtatgattataccttaaaaaaaataagagaaaaatgcaaactttccagcaccaaataaaaaagacggaatatccatttgaatatccgcctttttatatgattattttttatttagcgcacaaacgatacactgcttctgcataaatttccattgctttatacatactgcttaattcccatcgttcatttgcctgatgcatgaagtcaggagtatcagggaacatcgcaccgaatgccacacactggttcatcgtacgggcaaaggtagcgccacctgatacaaatggttcagtcatgtctccagtaatctcgcgatatgtccccaataggtttttcactaactcactatccaatggcacgtataatgaatctaggaagtcaaactcttcataagacaactcatatttttctgctgttttcgttaatttagctactaaatcctcttttttgaatgtcacaggaattctcatatctacaccgatttttgtttgttctggtgtgatttccaaacttgcaaagttcatcgttagctcaccagattgttcatcttctgtcttgcccacgactgcttcaccagttgcattttcttgaactaattttcctaagaaattgattgggccaaaatcgaatacttctgaaagaacgattgccagacgagaaatagcattcactccttgtgcggcatctttcgcgtggatacttttaccaagaacgacgattccttcgccttgttcttcgaaatcgaatccgtgttttttcaatgcttcttttacttcagaaatcttttcaccagaataaggagctgcatcaggaacaacattcagcgccccgccagcttttacagaaaaatcgttcgttccagggcctgtcaagtaagcttgtaataagcctttttccgcataaattaaagggaattcagcgtctggcgcaaatccttgcgtaatgccttcttctttttcgttatatttttctaaacaacgccacaaattttcttcatcagtaccaaagataaaacgaatacgtgttttgaattccacgccagcgtccatcaaagcttttacagcatacattgccgcaatggaaggacctttgtcatcttgggagccacgaccaactaaccagccatcttttacggttggatcgaatggtttcgtttcccaattgttttcgtcgcctgccggaacaacatccatatgacacaagataccgaataattcatctcctgagccaatctctgaataaccgtaatagccttctggatctttaaatgttctaaatcctagcttttcactgatttccaatactttgtctaaagcttcaatcacttttttaccgaaggggtgtcctttccctgaatctgcttcatctagtacggaagggatacggatcaattcgctcaatgattctaatgcttgttcatgatgttgttctgtcacaaattgtttcatgattttaacctcctaatatgttaaaaagggttatgtcaaatgcctccgacacaacctcttcttctctaataatgacgttttaagcctgctccatcagcaagcagaatgttcttaacaaatgatgaaagaaaaaacactcactgaatggagcaatcgacttatccacgtgcttatcgatagccgtatatcggtttcttcactcttatgatagaccttgtacctgtatttgtctaggtttagaacattgctgctacacctaggatcacacagatggctacaaataatatcgcaattaatttaccagtaaatttccaccatactgaaacatcgaaacgagcaatcgctacagcacccattacgatagctgatgttggtgtaatcaagtttactaagccagacgcagattgataagcagtgataactaaatccttccctacaccggcaaattcacccataggtcccatgattcccattgttgcagcagctaagccagaagttgaaggaatcaagaatgacataggaatatagaaaataaatgtaatgatgatgaatacacttgaagataatgaacttaatccttgttcgccccagtgtaagatagtgtctgtaatcaacccgttgttcataactacttggataccacgagcaacagctactacgatagctacaccaatcaagtcagaagcaccagctaaaaattcagagacgaattcagattctttcataccatacgtgattgctacgacgattgacatgactaagaacaacatagtaatttctgggaagtaccagtcacctagtggaagcatgcttttacctaaaacagtacctagtactggaagatttgttaaccagtttgtcaacgattcaaaaattgtgaaattcgcattcaaggttgtccaaggaatcaaactgatgatcatgataccaaaagtaatgaagaacaatacatttacatgtttttgttttttcgtgattacttcttggcgaccgattgcttcgatatcgaaatgtttcatatcttctttacgttgattgtatactaatgattttgttggatctttttcgatttttgatgcatagcgatacacatatacaatagaaatagctaacaaaataacgaacatcaagaatcgaagaccaataccttcacccatcgaaatcccaacagcttgtgaagctacgcctgttgcgaaaggattgaccgttgaagctaaacaacctacttgagaccctactaatacgatggctactgctaccactgtatcaaagcctactgccatcataactgggatcagtaaagcatagaacggaatcgtttcttctgccattccataagtagatccgcctaatgcaaataacagcatcaatactggaataagcattttttcttttcctttgaatttcttcacaactgaagcaattccggcatctagtgcacctgttttgttgataatacctaaaaatccaccaacaactaaaatgaagaaagagattgggattgcagcaggtgtttctttagttagctcccccgctggtacacctagcatcccattgattggcgccatgaaaatatcccacagcccttgaggattttgttgtactcgttcatatgatccagcgacaatgttgcctgcatcgtctacactatagtgcccagctggtataaaccaagtaagtacagcgattactgcaataataatgaataagaccgtatacgctgaaggcatttgaaattttttcttctttgtttgttccatcttcttcttcctttcttttccgttagagacatcatttttggctctaatgttattttatcaaaaagagtaccagaacaaaaataataacacgcattttataaaacttttgttcaaaaagttcgttttttcctatttcctcccccttctcttaggtttttaaagctttcttcatttttattgtagcgtttccttttttatataaacaaacatttccgtcttttaaaaggagaaggatttcacatttcaaaagaaccaattgatttttatgcataaataaaaaaaatactcaaaacagacaaataaaacgtttacaatattgcatgtattgtatttttttccaaaaaaaaagatcaagaatttcttgatctttttgacatttatttaactgctgtatgacgttgttccaactgatgttgttttcgacttaaccatggaagaagttgcgcatgtagcactaaaaagacagcactcacgatgaatcctttgattaagttgaaaggaacaatcccaatcaatacataatttgctaaagacatccccaacatctgtgtcgcgttcagtcctaaaaacattaagtaaagaggcgtaataacgaaataattcgcgatactcatgaaaatagtcagagcaatcgttcctgtaatcacacctaaaaatttatttcttcctttatgctgtttctttacactaaagaagtaataaatcggaaaggtaaagatcgttgttgataagaaactagctgtgtctcccactaggttatctggagaaaaacctgtagtcagcagatgtaatactgaacgcaagaacgctgttgctactccggccgctggaccgaataagaacatactgatcaataccgggatatcactaaaatcaatcttcaaaaaactaaaagccggcatgatcggaaaagcaaaatactgtaaaactaatgcgatcgcagcaaacatcgctactgcaaccattttctgtacacgggtgttcttcatttgaaatcctcctgttaggactcctcttcagcgaactttttgacgtttctctccaaatgaaaaaactctattttccagggaaaatagagttagagttatttgatcaagtgtgcgtcaaataagccctatcttctttatccagactgtactgtcggtatcggaatttcaccgattcagctattttttgcaaaataggtcgtggactataaccaccggtcgggaatttcaccctgcccctgaagacgaaccttatataaattttgtttacatattcattatacatatctcttcagaaaacgcaacatttaacacttataaaaagtaagtgtttattttgaatggttcaataagctgctgacttcttttttgttcaattcacgataatccccagggcgtagaccttgtaatgtcaaatcaccgtatttttcacgttttaacttttgcacagggagcccaactgcttgaagcatatttttcacttgatgattccgtccttcgtggatcgtcaattccacgatactgtgatttgtcttaggatccactgataaaatttggaacttagctggagacgtttttcgtccttcgatctttattccttttgccaaaggtgcaagcattgattttgtcgcaatcccttttacttttgcgacataaactttatccacttcatgttttggatgtgtcaggcgctgggcaaaatctccatcatttgtcagcagtaagatacccgaagtatcgtaatccagtcgacctacggggtaaattcgttcttttaccatcggcagaaggtccgtaacgacttttcttcctttgtcatctgctacagcagaaatgactcctttaggtttgtataataaataataaccgtattcttcttgataaattggcacttcatccacttccacagtgtcatgttttccaacttttatccctaattctcttacaacttgtccgtttacttttacacgtcctgcaaggataaattcttctgcttttcgacgagaagtaatgccagcgtgggcaattactttttgtaatctctccatttacaattgttctcctttattcattccatcaaagaatagatctggtgacacatcttcttcaagtgaaatttccatttcttgtgtatcaggcagttcctctaatgatttcagcccaaaataatccaagaagtaaccagttgttccatataatatcggtcgacctggtccttctactctgcctttttcttcaatcagtttatgagcagccagacgctgtaccgctcctgaaacctgaacgcctcgaatctgctcgatctcagctcgtgtgattggttgtttataggcaatgattgctaaagtctcgacagcggcttgagataacgtgttcgatgttccttgcgcatatcgcttgagcaatggcgctagctcttttttagtcgttaatacataatggctttccgtttcaaaaatatgcaaagctgagtgcgggttttgagcgtaagagtctcttaattctttcactaaatttgcgacttctgcttcactgagattcaacagtccgcttaattcttcattactgattccttcctcgccaacaataaaaagaagggcttcaagttcacttaatttcgtcatgttcggtatctcctactgctggataaagcataattgattcatagttttctttttgttgcgcaataatctgtccttttttcatcaactctagcaaagccataaaagtagtgacaacttcacttttggaaggcgactcaaaaaaagagttgaaggtacagccatgcgtatttctttttatacgctcttcgataaagatcattcgttcttcgatcgttgtatcatccggcgtgatcgttttttccactttttgagaaaatttcttacgttccaaaattttctgcatggcacggatcagatcgatttttttgacttgtcctcgcttcaacggcttttcaacatccgccaatccatcgatgttcatagggtcttttgtgtaataaagacttcgttcctctgctttttctgttaatttttcagccgcatacttatacttacggtattctaaaagctgagtgaccaattcttctcgaggatcttcttcccatagttcttcatcatctgtaacaaactcttggatagggagcaacgtcttacttttgattgccatcaatgtagcagccatcactaggtattctcctgcaacagctagctctagtgttttcattgtatggatataattcatatattgctctgtgatcgtagcaattggtatatcatatatatcgatttccatttgctgaatcagatgaagcagcagatcgagaggtccctcgaatacatctaatttaatattgatctccgtcaactcattcactctttcttctttttctttgctagccactttccaatataaggctctgtgatttcagttgcacggatggagacatccggatacttttcttgtaattcatctaacatttggaagcccatattctcaccacgataagatggattcaaagaaatgtcatggatgatcagctgatcgttcgttgcccaataaacaccaatgattccttgaatgttggtcgaaccttctggcgtaaagaaaaaaagttcataatcatcttcagattcgtacgtatctatctccttcaacaaagaagacttacctgtcagcttcttatggaaactcaacagtcccatagcaattttacggttttcttttcggtaatgtgttaacatcttctcaccttcctatgactaagcccttggaaaatgctgcttataaacatctgtcatcctttttttcgtgatatgtgtataaatctgtgtcgtagagatatccgcgtgacctaacaattcttgtactgtccgcaaatctgctccgttttctagcaagtgggtggcaaagctgtgccgcagcgtatgcggcgttacttctttgtaaatcccagcctctcttactagctgtttcagatttttccagattccttgccgggaaagaccttttccgtgattattgacaaatacatgcatttcagatgcgtcctttacaagtaacggacgtgcttcgtctaagtagcgttccagccattggatcgcataatcacctaaaggaataatccgctctttatctcctttaccgactgtctgtaccagcccaagagaaagatgaagatctcccaatttcaatccaatcaattcactgacgcgcatcccagtagcatacatgacttctaagattgcacgatctcttatccctaacgtttttgtcgtatcaggtgcttcaatcagcttttctacttctgccagcgtcaatgtacttggtaatttctgcgctttctttggcgtatcgatatgctgcattggatcatgatccgtaacacgctcttgtcgtaaaaactgatggaatcttctgaggcttgagatcatccgcgtaacggttgctgtcgcttttttttcttcatgcagtttttccagaaaacggatgactaaaaaacgatcgacatcttgccatgaagcaactttctgctcttctagaaaatgcaagtattgttccaaatcacgttcatagctttgacgtgtattggcggataatccccgttcaatattcaagtagtggagataatcgttgatttgctctttcataataatccccctcatgcctctctatcatatcagataccgcttcattctgatagtctttttccataatctgagcaaagaaaaagccgtctagacactcagacggactggtttcttttttctttttcataacattcctgacagattccatggaacgtcagccgatgatcttttactaaaaaatgataacgttcttctactacttgctccacttcaagtaaaagatcctcttctacttcctcgatcgtgccgcagttcaagcatagtaaatgatgatggaaatgtttggcgccttcttttctcaaatcataacgggctaatccatcattaaaacttactttatcgacaatttttaattctgtcaagatttcaagggttctataaacagtagcaagtccaatttctggactcttttttttcactaaaaagaagatctcttctgcagacaaatgctctttctcattctccaaaagcacaagcagggtagcttctctttgcggtgtcagcttgaaccccgattcatgtagctgctgttttgtttttttcatcgccgaaatagcattcatgaccatttactcaaccccaacaatttataataattacaatttagaaaaacaatagcactgtgttaattaaaattattataagctagttaagaaaaacatgcaagggattctcaattagattttttgactaattttgtcacaccattttcttgtttaatcagtccttgtttcaaaagattacctaatgctcgcttaaaagcacctttgctgatgccgaaagctttcatgatgtcttctggatctgatttatctgtaaagttgatttgctgatctgcagaacgttctaaaatggttaaaatcatttgtgcatcatctgatattgcttcatacgctcttggtttcaatgaaagattcagtacaccatctggtcggacaccgatcacacgcccttttacctgctcgcctagtcgaggttcgttatatcgttcagaaggatggataaacccaagatagaaatcttcagtcaaaacatacgtacctgttaatttcaaacggtaggctgttcctatcacatctttgtttttcatttcttctgttccatacttgcttaaagatttgaatattttttcgtctgctaagctcccccaaacacggtcctttgcgtcaactctaagggaaatcatcaaacgatctccctttttaggccacagctctgtcatggtcggtaattcatcaagagatacgacaaagtctttatctggaagaccgatatcgacaaatgcccctaaatcctttcttgtagcagtaacgattccaaatgcatagtgaccgatgcgactttttggaatttgtgtagtgatccggttttcatgtttttgattttggtagccgaatccttccactgcctcaccgattttgtgctcgccctctgatttgcttaagccaaaggtttgcccatttttttggacaaagtaatttttttcattttcatcaataataatacctgtaaatatagttgctaataaatcgttcatttttttctccctctatagtgaaaggttttcttaatacatttctttgctatcataacataatgttatctacttgaatagctgagccttgctttggaaaggtgaaaaaaggagtatgacgacagttgtgtcatactcccctttttcgaataaacgatgttcacctgccaactcttcggtttcaagtcacactattcatcaaacatgagaagctgttttttgaaattgttccttgtgactcagagtgaaacggcaggctcacaacctctttcgtttagctaaaactaattgctcccatttcctccgaaccacccagttttacagttgatcgttacgatataaaatggcaacgcactttctccaatgcctttcatcaatgcagattttgttgaagtggcatatagattgtaatagccttccccattttcgattctggctttttctaatctgtatcctccttcaacgatatatccacgttggatacatgtagcaatcactttgctttggacacctggtgcccacgtccatgctggattagatgcatcggcaatatcacttgctctggcagatttgattggctgatttgctgagtttgaagaggacggggtcgaggatgccgcttcttgctgtgctgcttgtgcgaccgcagcttgttgagcggcttgagctgcagctgctgcttgagcggcttgttttgcttgttcttcagctgcttttttcgcttcttctgcttttttcttttcctcttcttcttttttctctttatcagtgagcatcttatctacttgtttcaattgttcattcaactgagcagatagatctgtatttttcaccttttctactgcttcttttgccgtcttgtattggtcgcgtgtcgctgaacccactacttttccgtctttaaagactatagctgttttttctttagctgtttgcaattcagcatattgatttttagcttctgtttgtgcttgttgaatcaattttccaaaatctgtgttatccgtttcgatcgtttgtatctctttatctgctttcaacttgatgtcatctgctagatgatcatcgacgatcacaggagctacgaaccattcattcactttctggatatcttggatcttagattggatatcttgataagttgtttctaactctgaatatcctttttcattcttaagacttgataaatcattttttagtttcgatagatcttgatgaatcatatctgcacgaataaattgatggtgatcatctgtataaaaggcagcaagtttcccgtgaaggtcttccatttgtcgctgtctttttgcttctgctgctacttcggcttctactttttgatgatggtcataataagcccagcctcccccacctagtagaagaactgctgctaaagcgagataaggcactttttttgattttttcttttgtgtcttatctagatcttttttttctaggtttgattcttgaggcgtttttacagtatttggcacgattgttgttggttctgtttctgcttcaatcagctcaggctggttctcttctttttctattttagcttcaagaacagtgctatcttcacttgcagattgactttcagcatcggcttcattatttatactatctgactctgttgatttcttgtctgctttttcgagcatttcttttttctctgcttccggcaacccattcgatttctcgtcttctgattgtttttcagacaatgtttcagttttttccgggacatccgtttttagatcattcgtttttactgattctttacctgcagcgtttactctactaatgtctttttcagcgtctttttcagcttcatgttctggttctactttgttttcctgtgcaattttttcactgatcattttgagcagctcttccgcgtgctcttcctttgtatcttcacgatgtgctttgatataggcggatagtatcgaattttcttcctcattctcgacgatttcttttagttcagctactcttcttttttgttttgattcaagggtttcctcttgattctttcctgatttttccaaagtctcatgaacagttactttcttctgttccattttttctttattggctactttatcgtgagtagatgatacatcgtcttctggttctgttttttcgaataattccatcacagattcgagaggtagatctttcaattccgaccattcgattggatcgtttaattctgtatcaggaaagactgcgtcttcagttgatttatcctgcatagtttcatctgcatttatttcttcgattgtttcttttgtttgctgatcttctgcagttagttgatgaccgcagtctggacagatattgttctcatccatttttttcgatccgcaatttggacattttttcatcacttagcgatcggctcctttactaggtttacgctaccatttaatctatcatattctatacgtcacgccaatagcttatttttaggatttacttaaaaataatgaataaattttttccctatagaaaaaaaaagcttgagaccgcgtagtcccaagctttttttcttttaaaataaaccaaaccattttactgatttctcttctgatcaatagttcatgcttattctaagaagtcttttaattgttttgaacgagaaggatggcgtaattttctcaacgctttagcctcgatctgacgaatacgttcccgagtaacaccaaatacttttcctacttcttccagtgttctcgtacgtccatcgtctaggccaaaacgtaagcgaaggacattctcttcccgatcagtcaatgtatctagtacatcttccaattgttcttttagtagttcatatgctgcgtgttctgctggacttgttgcttcttgatcttcgatgaaatcacctaaatgagaatcatcttcttcaccgattggcgtttcaagagaaacaggttcctgcgcgattttcaagatttcgcggactttttctgtcggaaggtccatttctgcaccgatttcttccggcgtaggttctcttcctaggtcttgcaacaattgacgctggatacgaatcaatttattgattgtttctaccatgtgaactggaatacggatcgtacgtgcttggtcggcgattgcacgagtaattgcttgacgaatccaccatgtagcataagtagaaaacttgaaccctttgcgatagtcaaatttttcaactgccttcatcagccccatatttccttcttggatcaagtcaaggaactgcatgcctcgccctacataacgtttagcgatacttactactaaacgaaggtttgcttctgctaaacgctgttttgcttcttggtcgccttcttcgattttcaatgctaacgctacttcttcttccgcagttaaaagggagacacggccaatttctttcagatacatacgaaccgggtcattgatttttacaccggttggcgcagatagatcttctgtttttgcctgttcagcttttttctcagcacttttcaagctgtgaattgatggatcaccattttcatccaccacactgatgcctgcgtcttcaatcttttggatcaatttgtccatttcatctgcattcaaagtgaatggtgtagcaagctgattggataaatcatcatatacaacttgtcgtttgggtttgttttctttgatgaaagctgctactgctgcttcatacttttttttatctgttccatttgccataaaagaaggccccccttgagtagctatttggcttgttttaactgtttcgttaaattgatgatttcgatcgtcaattcaagctcaagctgtttgttcccagtacgtctggcttcttgctgcatttgtttttttaatgttatttcatcagctaagccagatttgctgatcacatctagcaagtcttggatttcccgtggcgaactttcttctgccaccggtaaatattcgatctccaccaccaaccgccttaaattttcatcttgcaaaaagtctaaaaactctgcaaggttgaattcataatgttgtgagacatatgcatcgaataaaaaataaacttctgcgtatgcgtcgtggataaactgaaattctcgttcttttaaaatattgcggacagaaacttctttaaatgcgcggtacaacagaatctgctctgccttttctacctgcgtcaacggtctcttcttccgtgcagtttcttgtctcttggtctgcgtatgctggttttcctgaggttcttgacgattttgctgatttgttcttcggagctcacgcaattgtttttgtatcgtctctctgctgacccgaaactctgtggacagctgcgataaatacatatcttgttcaattggtgaaacgactcggctaagttcaactaataattcttcaaggtactcgattttgtctttttcattttctaaatttttcccttgtttcaaataacgtgatttaaaagtaaaaactgtttcacgcccatgagccactaattcttgaaaagatgcttccccatacttacggagatattcatcaggatcaagcttttctggaacgactacgaccgaaagtcctaaacgactattttgccgaagcaattcaatccctcgattggttgcttcaaaacctgcgttatctccgtcataacaaaaaaccagttctttcgtcagtttttccatttgctggatctgttgtgctgtcagacttgttcccatggaagctaatccagttttgataccagcctgccatgcagcaatcacatccataaaaccttcgaacaacaagacttctccattttttcggatatcgcttcttgctttatcaagattaaataacacttgtcttttattgaataattctgtttccggactgttcaaatatttgggctgatctttttcctgccctttttcaggtgcaagccagcgtcctgaaaacccgattgtctggccttgaggattacgaaggggaaacatcaccctttggtaaaaacggtccgacatacggccatcatcatgtgcgacaaacaatccagaacgttctaacaattcatttgagaatgattcattcttgaagacttgctgaagaaacgagcgttcattaggtgcaaagccgatattgaattcttcaatcaattctaaagacaacccacgactttgcaaatattctaaggctggctgtcccgcttttgtatgcaacagcatgtgatgatagatttccgctgctttttcatgagcagcaatcaattttcctgtagcagattcaggattttgtacagctaacgttcgctgacgccattgatcttccaacggaatctgttcgaaatctgctacttttatcactgcttctggaaaactcagtccttctagttcttgaagaaaagtaaacacgtttccgcccttaccgcaaccaaagcaatgaaagatctgcttgtcttctgcaacagagaaggatggtgtgcgttcttcatgaaaaggacacagccctaagtagtttttaccagactttttcaattggacatattgtccaatcacctcaacgatattcgtttgactgcgtaccgtttcgataacttcttgaggaatccgttgagccatttttccaccccctgctttattgatatcttttcgttttaacaaaagatatttcaggagaataaccggtaaaaaatcgcactaactgaaatcagtgcgattttaaaggacacaattatacatgtttgattgtatcatatttcaattctttttcaagtataacacatttctatttaattaagcatcaatttgctactcttttcagtagctgattttgaatatcagccttccagtacaataatcgaaggacaatatttacgatcatgaacataacgaagtatcctatggtttctcctaagcctaagtttacttccaaaattccgtggaacagcatcgcagctacatatatccctacgattgtcgttactgctaagaatattcgcaacgggttgaaaggataacaagcttttacaactgccatgcagctgattccaattagcaagtaatacatcaacgtagtggtttcactacttccccacgcgaacgtttttccaagtagatacactgctatgatattcactactacaagcaaagcattcggcaaagcgttgataagtgcagtaggcaagtaacggtaagtgattttgcgtttatcttgttcaaatgataaaaagaaggaaggatacccttcaatcgccaaatcaatcagcgtaatctggatagggataaatggaaatccaatagctgtaacggcacagataatcgataaaataaaagaataaatcgttttgatgaaaaagataccggagactttcgtcacattgttgactactcgacgtccttcaaacaggacttctggcaatgtcgtaaaatcagagtccaacaatactagattagcaatttgacgtgtcgctccgtcaccttctgccatggcgatactgcaatctgcttctcttaatgccaaaacatcattcacgccgtcacctgtcatcgcaaccgttctgccgctatcttttaattcatttaccagtaacttcttttgctgaggactcactcgaccaaaaacggtatattgatgcgcggcttctcgcacgtccgattcttcagtaatctgagaaaggtcgatatacgcatcataattcggtaatcctgcacgtctagcaatattggagacagtaaatggattatctccagagattactttcaggtcaacgccttcctcatgaagataagctagtgtttctggcgcattttttcggattggatcatcgatttcaaacagagcaactggctcaacaaacgcgggggtttcttcgtttaattgctgatttggagcaatccccaacataaggacgcgatagccattcgcttgagctgtttttagactatctggcagtcgatcttcttccaccaagcgttcaggtgctcctacgtatacgactcctaattctggaaactccatcgcaccccatttgcgatcagaagaaaatgcgactttgtttgttacatcataacgattagaaagctcaaaatactctctcatcgcccgcatggtgatgttgttatcactgctttctgcaagatacgttcccataatttctggaatagctttttcatacagcggatgtaatgcttctacacgctggatactcattttcccttcagtaatggttcctgttttatccaaacataatgtatcgacgtgagcaagtgtttcaatggaatacatgtcttgaacaagaatccgtttttttgccagttttgttacacctgtcgttaacgcaatacttatcaacaatactaatccctttggaagcatccctaacaaagctgctgcagaggcaataactgaaatcttgatagaagcatcgcgaatgaacagtgcctccaaaaatagtatgatccctaaaggaataatcacgaaactagtgaacttggatactttacgaatcgaatctacaagttcagaatgaatagctttgtgggtttttgcctcgctagtcaagcggacagcataattatctgcccctactcggatgacttcagccatgacagaaccacttgtcaaaaagctcccagaaagcaattcagctccagcttctttgacaatcaagtcagattcacctgtcaaaagagcttcatttgcttctgcccgtcctgatatgacctgcaaatcggctggtatctgttctccagctccgatctttaccaaatctcctaataccagctctttagtagaaatcgattgttctttaacgtcccgaatcactagtacttctgattgggaaacaatcgataattttcgtacaagatttcttgcatgtatttcttgataaattccaataacgatatttacgataataattgctaaatacgccatgttggaataagcacctacaaataacagacaaattccgataccgaagttcagaaaattgaataacgtcaatatattatcgctgaatatttgctttgtactttttgatgcatcttcctggtagtcattttgctggccagaagccattttctgaactacttcttgctgtgtaagtccattcattttctttttctccattttccgccaactttcaaaaataatcacgtgtttaagtctagcgtgttccaagattaaaaacaacttgtttttataaaatttatagaaaaacacacgaatgattcttacgaaaaagatgctgaccttttttgtatgaatcacccgtgtgttgttttttattatcgaactatctttacttatattgttcttccaaacggctcatccaccatcctagtgctgtaccagctacaaaaagaacaggacaagctagcactccagcgactcccaatcccgcgtaatcagtagggatgatcataatcgttgaagcaaaaacgacgcctaaaataaaatggaatagcttactgtatgcctttgagaaaatataatccatgatttttgacaggccaaggacacaaagaaccccaccaattccaatcggcaagatgacttcaaaccgaacttctttaaatccgtcagccatcgctttgtacaatcccatatataccaaaaaattagaaggactcaatcctgggacaatcatacctaaaccaatcaatccgccggcgatcagccaagtcccaaaattctgatcgacttgtccatcaaataatcgagcaccgtataataaaaacaaataagccagaacaaaagtaacaaccatgatgattacatcagaagtatctcgtcctttttttcctgcttctttccataacgcaggaacagttccgacgatacacccaacaaaaaaccacaatattgttgtttcatacgcccctaataaaaaactgactaaaaaagaaagtaaaaagatgcctgtcactccgcctagaccaacaggcaggaaaaacaaaacattttctttgaaattttttgtgatatgggctagaaaagaaatcagtcgctcatacatgccaaaaacagctgctaatgcaccaccgctgacccccggcaaaataaatcctgaaccgataaacattcccttcacaaaccgcaacatccaatctttggttgtgtaccccactttttgattttccattttttgccttttttccactatttgcgcactccttctttcagctcattttattatgtttggatatttcctactcgtttatttaaagactttttcgtaagtctctattattttttcattcattttgacaatatcaggataaaacatattacctccattatgatagagatagccgccgttgtaaagcaaggactggatccgccaatagcggtactgttttccttcttcatttcctaaaagtgggctcaacacatctttagaatacgattctgctagttctactgtgttttctccgccatgattttttacataggcaatataatctttcccaaaattatacgcttggacagcagtccacaaatcacatccttgtttttttgcttccattatcatctccgccaaatatttgaccccttgatcaatactgtcagctggattatcaatgacatcggcttctccatgcaaactctctgaactctgcatgagatctgtgccttttccttttgattcggtcaagattattgccttgatcaatttttcgtatgcttccatatgataattttttgcagctgtcgttatttctatttgatagctttccacccgttttaccgagcgataagttcttcctcctaaaaacaacaccgcaccaatgaccattagaatgatcatgtaaaaaagaatacggataatagataatcgttttcgcttcatttcatcacctagttattttgacatcttttttatcttactatttctttatcttcttggctatttcttccttaaattctgtgtacaccttaagaaaaaatgaattttcctgtgttttttatcatcttacgaaaatgatcgttgtttttcagtaaaaacaattgcccaatgactgttataatcgttatactttacacagtaggtgattatgtgaaaaaagaaaagaaatatgcaaaaatgtcagacgggagcaaaatttattatgaaaagagtggtcaaggcttcccactctttttactgcatggcaatgatggcagcggccgctttttttcagaacaggttcccgtacttgaacgctactataccgtttatctagtagacagcagaggacatggccgttcaacaaatgaagcatctatattgaattttcatttgatggctgaggatctgaatacgattatgttgctagaaaaaatcaatcaggcagattttcttggatttagtgatggcgcaaatttggcattagtatttgccagctgctttcctcaaaaagttcatcgactgattttaaattctggaaacacgctagttaaaggtgttcgtttttctgccagagtcatcagcaattttcattatgcatgggtatggttgctctctttatttcgcccaagccttcgcaaaaatctgttagttattaaactattgctacatgatatcggccttacagaaaatgatttaaaaaaaatcaactccccaacattaattattgtaggaaaaaaagatgtaatcaagctgaaacattctctgtatatagctaaaactataccaaaagcttcttttgtacttgtaaaagaacaaggacatgaattagctagaaaagatcctgaacgcttcaaccgagaagttcttcaatttctttctgaaacataattattaggaatagaaggtgatttatttgataaaaactaccatacaatggctgaaaaaccatctaggactgttcaaaacaatctttttgatttctgtcattgtcattattgtcggtgaattgatgtccatcggtaaaactctatctatccagcaattaggagaaacgtttgccactatacctatttggaaaagcggacttatgctgttgattggtcttgtctctgtgttacctatgattggttatgatattattttgaatcggatgcttgaacaaaagcagaatcctcgttacttgtttgagacaagctggctgatcaatacaatcaacaatattgccggtttcggcgggtttgttagtgtggggcttcgctctgaactatatggacaaaagaaagagagcagaaacgtgatccaagcattatcgaaagttttcttgtttttgatggctggactttctatttacagtctgctttcttttttacttgtagtcttcacaccagtcgctcctttcttgaagcaatattggatatggctgattggcggtggtctgtattttcctgttgtctttttattcactactttcaaaaagaaaggattccttggtggtacctcacttaaaacgcaaggacagctcttgcttgtttcattattggaatggtctggtgtcctgttcagtttcctttctgttggttacctaatggaaatccgaatcgatctgtggcaaacgattccgttattcattgctgcttcagtgatagggatcgtgtctatgattcctggcgagatcggcagtttcgatgtgatgatgattatcggattatctgctattggtgtgccaagagaaacagtcgttgtgtggatcttgctttatcgtctgttctactacatcattccgtttttgattggaatcgtctttttcttcaaaaatatcggttccacttttgatcagcgttattcaggtatccctaagcagttagcaacagaaatcgcgcataaaatcgtggttgtacttttatacttttctggaatcatgttggtactttctgccactattccgcaagcttttacagagtttcgctggcttcatagtttgaacccattgaaattccactttattatccagtttcctagtatattattaggatttcttttgattgttatggggagagggatcgctgcacgcgtaaaacgagcctatctgcctacaattttcttgatcgcactcgctttattttatgttttattaagcgattttagcttcacaccggtgattttcttgtctattctgtttctgatcattcttgcgtccaaaaacgaactgtttcgggaacaactcatctattcgtgggaatggcgtacgatcgatggaatcattatcggtgcattgacattgctttatattgttattggtgtatacaatctgcctgattttccacatcggcgtcaccattttatttcctttttcttattcccttctgaaaagatttggttttcagggttgttggccattatcgccgttagtttcatgatcgttctatttgtccattttcttcaaggagaaaagaaacagattggcgaagcctttaatgaagaaaaggcactgaagatcctcacaacttatggaggaaactccgacagtcaattgatcttcttaaaagacaagcggatgtttgtctacgaaaaagacggtgaaccaactgtgcttctccaattcgcttgcttcaataataaatgcgtcgtaatgggcgatccttctggtaagaaagaagatttttcagaagcaattgaagctttcatcgaagagacagaccgattatgttatttacctgttttctacgaaacaagcgaagagatcgttatgattttgcatgaattcggctatgacttcattaaaatgggggaagaagcttatgtagacctgaatagttttacaacatcagggaaaaaaatgaagggcactcgggctgtcttgaaccgaattgaacgagaaggatttacatttgatgtcttacaaccgccattttctgctgagcaaatgagtattttcaaaaatatttctgataattggttgggttcacgaaaagaaaaaggtttttctttaggctttttctctgaagattatttacaaagagcgcctattgctgtagtcaaaaatactcaagaagaaattgtcgcttttgcgacgatcatgcctacttacacgaacaacaaagtaggaacgatcgatttgatgcgatatgatcccaaaaaagcaccttccggcagtatggatttcttattcctgcatttgtttgcttatatgaaagaagaacatatccaatggttcaatttagggatggcccctctttcaaatgttggtacttccagaaagagttttttacaggaaagaattgcttacttggtttacgagtttggctctcatttttattctttccatggattaagagaatacaaaagcaagtacgctacgaactgggtctcacgctacaccctatattcgcgagatagctggattgcatacgttatgattgccttgctgattattgataatgcgccagttgagcagacacaaggtcgaataagtggtttgaaaaaatggatacgaagaaagtactaaaaactgcgtattgtaaggaaacactcacagtataaataaaagagactgaaccaaagcgtgaggtacggctcctaccctctcttattgtacaattgtagaataaaaaaagcggtcaaaacaggatttctgttttgaccgctttttcattttaaacatttttcattgccaaaatattcgagtcgcgtttcttatgcttcgatttctgtaacgatacctgaacctactgtacggccaccttcacgaatcgagaaggtcgttccgttttcaacagcgattgggtggatcaagtcaacatcaatcgtcacattgtcaccaggcatgaccatttctgtatcttctggtaacgtgattgttccagtaacgtcagttgtacggaagtagaattgtgggcggtagttgttaaagaatggtgtatgacgtccaccttcttctttggtcaacacgtacacttcagctttgaattttgtatgtggagtaatggaacctggtttagcaagtacttgtccacgttcgatatcgtcccgctggataccacgtaacagtacgccgacgttatctccagcttccccgtaatctaacgttttacggaacatttctacacctgtgacaactgctttttgtgtttcaggtttgatccctacgatctctacttcatcaccgacacgaacagcaccgcggtcaatacgacctgaggcaacagttcctcgtcctgtaatggagaaaacatcttccactggtaatagtaatggtttatctgtatcacgttctggcgttgggatatattcatccactgtatccatcagttccataatagcagcttcagcatcgggatcgccttgcaatgcttttaatgcggaacctttgatcacaggagtgtcatcgcctgggaaaccatattcgcttaataactcgcgaacttccatttctaccaaatcaatcaattcttcatcatcgactaaatctactttgttcaagaaaacaattaggtattttacaccaacttgacgtgacaacaaaatgtgttcacgtgtttgaggcatcggaccatcagttgcagaaacgactaagatggcaccatccatttgggctgcccctgtaatcatgtttttcacatagtccgcgtgtcctggtgcatcgatatgcgcatagtggcgtttttctgtttcatattctacgtgtgcggtattgatcgtaattccacgttcacgttcttctggagctgcatcaatactagcatagtcttgaggatttgctaggccttttttgcctaatactgtagtgatcgcagcagttaaagtagttttcccatggtcaacgtgtccaattgtaccaatgttaacgtgtggtttacttctgtcgtaatgttcttttgccataatttacaaacctcctaaataatatagatcactgaaggatttcagctctcacttttttattatagtctttttttgaataaatcaaaaagaatacgtccggcttactttttgtaagattcgaactaagcttattatacgtcaaaattggtcaaagtaaactaagagcactcgcctatcttacacacgagaaaagtaccttttataaataaaaaattgtgttttttgagaaaagcttcaagctagtccttacctttcttttgaagcaataagaacaaaatgaggaaaagtttaaaattcagctgtcgccaacaactttcaatagacgaaatcttctatttcgttaataataagaggagaggtgaagtacatgaaaaaattaattggcgtacttgtcgttttaggcatctttctcggcggaagttttgcagcttatcattatttttacggcggtgaagcctattatacaaaaatcacgacgaatggcgaaatatcagctatccaagcagataacggagagaaattcacgacttatacctacaagcaagcggcttataataaagatggagaaaaaaaacaagtgacgcttcgcgaaaaaagagaacatccattaaagatgaatgcgtatcttaaactcaaagtcaatcctcgtaaaggtgtattaagctgggaagaaataaaagcttctgaagtccctaaaaatgcggcagaaaaaatcgatcaataatcgatggtcttaaaattttattagataaaaagaggctgggacagaagcgtttatacgtttttagagcgtgagacaaaagtgttctttacttttgtctcacgctctttttttgttatattcgtcctttcagatccttctcatggaccattcattcaactaaacatcggtagttgaacatctaatgttccagtcacttttataaacgatttaatacttcatccacatttttgatcatcacagatatcgtaccatctggattattcacaaattcaatcaaatctgggttgcgatatacatcgactggtacaatcagttcgattccgtttgataatttaaatttttgttttccaaattttttctcagaaatttcttgtacttcttttacaggaggtgcttctgggacaaacccttgttcctgtacttcttctttaaaagccagttttgccgtaatgttttccttgaagactttttctgcgatcatctcatgatccaaccgtcctttttcttctatcgtgtcatagacagcttcttttaaatcagccatgatatcaaattcttctgtctcgaatttttttccaagatgcttggctactttttggatcacttttacattttcttctaaagaaggtgcaggaacactttcgatcactcttccagaaaaataaagctcttttttaccggaaaactcatattttttttcaatcaattcataggtccaatcggacaagttcaccgcgaaggcttcatctgctttttgtgttttcgcgcctagtattgctcggttcaaaatcaaacggttgtcaattcctacttcgtctgcttcaacaaaatgcgtataagcctcacgataattgactttcaataaagataagtacatcactgtatctaattcatacaaaacgacaaatacatctgcacttggcgcctcttcactttcttggtaaatatcgaaccatcgctgaacgattgcttcacttgcttccacaaaattttcttgagcgattttaagtgattcaacgatcatgctttcttctgccaattgtccagttttcgtttgggcagaagagattttttggattttcttttgaagaaaatcacgaatatattcttttgtcagatccagctctttttgcgaaaagaccggcgaacccgtctctctgtcaataatatgcaggattgctttttttaaatagatatccatttcctcattcccttctgtcttagtttacggaaaaaaaatcaaaaataccagaatcaaaatcattttcttttaaacaaaaatttcaatagtagaaacaaaatggattcttttttttggaaaatgcgctaaacttatagatgaacgaataaaaaaggagctgaaagtatgaattcattaacaagcacgtatcgtctatcaaatggttacgaaattccagtagtaggattcggcacatggcaaacacctgatggggatgtcgctgtttcctctgttaaagaagcactggctgcaggttatcgccatatcgatactgcccaaggatacaagaatgaagaaagtgtcggccaagcgattaaggaaagtggcattcctagaaaagagatcttcctaacaacaaaattatggaatgccaatcacagttatgaacttgtgatgtcttcttttgaagaatcattaaagaaacttcaaacagattatgtagatctgttcttgattcactggccaaatccagttgcttttcgtgataattgggaacaagcaaacgcagatacatggcgtgcatttgaagaactgtatgaagcaggtaaaatcaaagcaatcggtgtgagcaatttcttgccccaccatctagatacacttgctaaaacagcaaaaatcatgccaatggtcaatcaggttttccttgcaccgggtgaattgcagccagatgtagttgagtatgcaaaaaaacatgagatgatccttgaagcatatagcccattaggcactggtaaaatcttcgatgtccctgaaatgaaacaaatcgctgaagcgcatgacaagacgatcgcacaagtcgctttacgttggtcgttgcaacacggattccttcctcttcctaaatctgtcacaccaagcagaatcaaagaaaatactgaactgtttgattttgaattgacagaagaagaaatgaaacaaattgatcagttagatggtgtagttggcaaggcaaaagacccagatactacccaattctaagacgaaaggtgattttatggatccaatcgaacgcttgaattctctctcggaagacgtcattcagacttttcattccgattttgtctttttgatcgatgcagagaagatccaacatttccctgcaagaaactggacacatgatcaaatcatcgaagagctgaaaaaacggttcaatcattcactaatggtcacaacttggcacgaacatgaagtcatttattcacctgagttacctatttttgccttgataccgaaaaaataaaaagattggaacaggttatctatccacataacctgttccatttttttatttttctttcaaaaaatggaaaaataagcaaatttttctgttgtaatttgcgtatacgcaagtttttttgcattactccttttcatttggctttttttttcttataatcgaaagggtatgagcgaaggagagaacatatgaagaaaaaacagaaacaaaaattattaaatcaattccgtccttcattggatggtgtaagaggacagttattccgttctctagaaaatgaaagcttgagacgttatggtttgccattacaagtcatgcttgatcccaaaaaccgtcaaatcttaacgatcggattagctggaaaaacaaatgaagatacacgaatcaatgtgcctatcgatgataatttcaatactgtattaaagcggatccgttcaggagaaaacggtattttcgaacgattccgtgacaatcttcttattgagatcgtatcttactggaatgatcaacgtttgaaaaacgatgaaccaactgcacaagccgttgcaacaccagtaacagaagaaacagtcagtgtgccagaagaaaaagtggaagaaccaaaagcggacacaactgaaaatacacgctcaactgatacgaatgccgctttaagttttgctgatttttcaaaagctgttgctgagtatcctaaattttacacagaacaaaatgaacaagaagtagttatttatgaaaaaaatgccgatgaacctcgtaagttagcaactatttctatgactgctgaaaatgaatttgccatcgaaaaagcacttgaacgaaaatacaaagtcaaattggctttgattcctttaattgaacaatttgcagcgacagcgattgcggaaagatagaaacattcaactgtagaaactgttgaagttaatccgttggttgaataagaaaccgcttggtaggttaaacaaatgccaagcggtttctttatagtcatatagtattttttattatttcgttccgttgaataaataactaatgatcaacaattaatgaattcgctatgattgattttctttatcaatcttctctatggatcacaaatcgttgtctttgtatatgagcgactggcgcagtaatcaattcttgattattgttgtatacgccatctcttacttctagtattcggttactatgagcattttgcaaataatacacatctcctagcatatgctctagcccagacgataacaatcgccatcttgcacgattttgtatacttggctggttcgttacatctataccaaaagaactattttctgctaacacatgatccctgttacgttgacttcgcaatatgtatgctttactcgcaacatcataatctaagtaccacttttgatttctactcccagcgttatggtaaatgattcctctgttatttccttgattccaatccacaacttttgaggtatctgcttcacattggatagaagtgatatatccatcgtatttccctttgctttcacggtctttcaataaacgatgattgatatcgatgatggaattaacgagccactcacttggatagtcgataggtacgattcccgtatgtttgatatttctatttattatccggtaaaaagaaaaatgattgattacatctgcgtatcccaatacaccattccaaaatccatttgcacttagataattgatatatttgacaccatttattcctctgctttggtgtgccttgtcgaattgttgctcgacggcccaccgtttatcatttggattcactggattccaatagtcttgtatatcaaaacttgacggataagggattccgacattatttcccaagaaattacaaaaaatgacgatttttcctcgtgtctctctaagagtcggattagcatttccataataaaagtaatctctccaacgactatcttgtaaatatcttgtattaagaatatggttgaatgtatggtcatttacactactgtattcttgtttcaatctcatatagactacttctccaggattgtcacgaagaaaggccactgttttattaagtacatcaccgaaattctggtttagatagtacctgtcgtgatgcatcgtaaaagcaccatcaatagcacgcgcacgtatatctaaaaaacgtattccattgtcaagctgcttgcggatatcgatactttgtgtctttacgtatccacttgctatacctgagaacgttcctgttgctgaattatgggtccctggaatagataattctgaaagacgtacattatcatttaattcactcatccaataccgattatatgtacgtgacgaccaatctccaccatttatatgtgcataagacattggtgttttatatcctagtaaaaataaaccgaaacaaatacacaatagtacagtaaattttttcttattcataagttctccattcttttctattttgtgcgcacacctaattatagctagaaatatattttaacaatgaacacatttttctcgtaaaagaaaaaaagacaagatctacagtaactaaaataactgcaaatcttgctttattcctctaaagatattgttcttttatttttcccggattttttccaatagttgtatagctgtctgctgattcatcttttctgcttcacgtaatttttgcgcaacttgctcgatttcctcaccaactgccccaattgagatcgctaatgaacgagcttgaagccccatgtgtcctttttggattccttctgtaactaatgctcgcaaagcagcaagattttgagctaaccctacagcagccattacttgtgctagttccttggctgaatcaacatctagcatagctaaggatactttagcttttggcaagatattagaagctccgcctactgtggccacagccaaaggtaccgttaacttcccaactagtttattttctttaatctgccagtctgttaatccttggtataatccgtttcttgccgcataggcatggatcgaagcacttaccgcacgtgtatcatttcctgtagctgctactacagcttctataccattcatgattcctttattatgcgtcgctgcacgataaggatccagcttcgcatactcccctgcttgttggatttttttagcgatttgttcaccaatttctttgcttctccctaagcgttcaaagggaatttcacaacaggcagaagccaacgattctgtagcaaaattacttaaaatactgaatagaatctcttcctcagggaaccatccccgtaatttgtctgctacactctcaagaatcgagttgatcatgttggcacccattgcatcttttacatccactaaaaaatcaatagataggtaggcatggaaacttcccataaattcccgtgtagagatatcttgaacaccgcccccgcgtttcacgatggaaggatagctttcatttgcacaaagaatcagttcttcttttcgatgattcactgcatcgatcactgcttgatactccgattttcctgatagaacgatttgtccacgcatcaaccgttgaggtgtttctgcacagatatctccacagatttttgcgccattgcttgcagctgcaataacagatggttcttctgtagccatcgggatccattttttcttgccattgatttggaaattttgtgcaatgcccattgggatctccacttcgctcacttggttttcaatcatgtgatctgagagctcttcagaaagtgtttgttcctcaaaaatcagtgcattttcctgtgtcaatacacctttttcgactaattgactgcgccgttcagatggcgtgagctgatagaacttttttttttgcaaatcctcacgtgtttgctccgtattcgcttctaacaagactgccaagcctaaacctccaccaatacataatgaagcaacaccgtatctcttctgctcacgaagcaatccgtaagctaacgtggtcaaaatccgtgcaccgcttgccccaattggatgtcctaatgcgattgctcctccatagatattgaccttttcttcatctaactgtagttctcgattgaccacaatagatgaagccgcaaatgcttcattgatttcaaaaagatcgatcattggtaaagctattcctgctttatctgtcaatttttgaatggctgtgattggagcgattcccatgatgcttggatcaataccaacttccactacttctttgatggttgccaaataaggcagattattattctctgcgtattctttggatgcaaggatcaccactgaggcaccgtcattcaatggagaagcattacctgctgttactgttccttcttccgagaatactgtacgtaatgtacccaatttttccaatgtactatttccacgaactgcttcatcctcagataacacgtcttcagcagaaatcttgaccggaatgatctcctcagaaaatacgccagcttcaacagcttgagctgctttcaactgggatgccaaggcataacgatcctgctcttctctgctcacagaaagttgagttgccacattctctgcggttaatcccatatgtgtatttgaaaatgcgtcagtcaatccgtcattgaccatactggaaattggttcgccatattcatttgtttctgactgatagggtttcagcataggtgcttgtgacatactctctgttccgccggctaccacaagctctgcttcacctaattggatcagctggcgtgctaaaatcactgctttcataccagatccacaaacttcattgattgtcattgcagggacatccactgggataccgctgttcaaagcaatttgtctagcaacattttgaccattaccagcctgcaggacatttccaaatattacttgatctattttatcttttttcagttttgttttatctaataattctttggtcacaagtgtgcctaattcaactgcagtaaatgaacttaaacttccgcgatactttcctattggcgttcttgcagcatctatcattacgacttctttcaaataagccacctcctacaaaaatataccattctttgctataaaaacaaatagctcttgttccagttgtttttttctaagattaaattttaacaatccttaaatattcgcttttttatatttcttttaatctttttatgatactttagtaaagtaagttttttatcatgagtaaagaggtgttgaaatgaaaatagggattgatcgtctttccttttttattcctaatttatatttagatatgacagatttagcagaaagccgtggagatgaccctgcaaaatatcatatcggtattggtcaagaccaaatggcagtcaatcgtgcgaatgaagatatcattacactaggggcaaatgctgccagcaagatcgtgacagaaaaagaccgtgagcgaatcgacatggtcatcgtcggaacagaatccggaattgaccattcaaaagcgagtgcggtaattatccaccatttactaaaaatccaatcttttgctcgttcttttgaagtaaaagaagcttgctacggtggcaccgcagctttgcacatggcaaaagaatatgtcaaaaatcatccagaacgaaaagtactagtcatagcaagtgatattgctcgttacggcttggcaagcgggggtgaagtgacgcaaggtgtcggtgctgttgcgatgatgatcactcaaaatccgcgtattttatcgatcgaagacgacagcgtatttctgacagaagatatctatgatttctggcgtccagattacagtgaatttcctgttgtcgatggacctttgtctaattctacgtatattgaatcgttccaaaaagtttggaatcgacataaagaattatcgggtcgaggactcgaagattatcaagcgattgctttccatatcccatatacgaagatgggaaaaaaagcattgcaaagcgtattagaccaaacagatgaaggaaatcaagaacggctactggctcgctatgaagaaagcattcgttacagccgacgaatcggtaatctttacactggttcattataccttggactaacttctctactggaaaattcgaaatcattgcagccaggagaccgcattggtttattcagctacggttctggtgcagtaagtgaattttttacaggttatctggaggaaaactatcaagaatatctcttcgcacaatctcatcaagagatgctggattctcgaaaacgaatctctgttgacgaatatgaaatgattttcagcgaatcgcttcctgaacatggagaaagcgcagaatatacatcagacgtacctttctcgattacaaaaattgaaaatgatattcgttattacaaaatataataaacgcataaaaaagatcccttcacgaaatgtgggggaatttttttttgtcattggaccagagaagcaatcgataggtcaacctagtcgtactgatgatttcttgtttttcactgaatagtttgcgaatatatctagtcacaacaggatcttttgcgtaatcttcatagtacatcttcatccactcttcagtaattgattcctgtgcaaaataagtaaaatcgtttttctttactttgattcctttatcaattaaatatgattcaaattgatccatgataaatggggttgtattaggatcttcttctatcattcctagttgcttttcgataggataaaaaatatcatcgattgattccactactctcattatcacgcaccatttgcttgcctttttcatcagtttttctaattgattgggatgtgtcaaagctgggttcgctgctgtaaaaaccacttcatatgtctcactggattggataaattcttctaatgatcgtttgataaaggaaacatttgacaagtcaattttctctgcttctttttttgcatttgctagcattcctgaagaaaaatcgatcaaatcgtagtgattaacttcttttgctaaagaaataaatctgccagatcctccggcaacatctgctactatttcagcaggcaggactttctccgacttcagatattctcttacatcttctgcaatagttgtttgtgattcttgctggatttcataatattcttccgcaaaatcatcccattctttttcattcatttgaatccctcttactttttgatttttgttagatgttttcacttttcagaataaattgttctcctctttcatctattatatctcttttgatgaataaaaaaatgttttactttccgtctattataaataaaaaaggactgtgacaaacgtcgtgtcacagtcccttattccgaataaacggtgttcaatcagctgaccctcggcattagctcaacaaacggcaaaatatgaggaactatttttccgtttgtttctctaataatcagatcagaacgctgatttcacaacctctgatacacggtgttcctgaagtaacttcttcagaaataagccgaaatgccacaaaaatttgagaagcaattttcgtacattccttcttatttcttgaagctgaccacttctgtcactacctccttgattcgttttatttatttccttgtactcgtacaatgatcaatttcgtgatttccatcaagatgattgtcacaagagcgatccccatacatgtaaagacttctgtcaatccaaatgctgatgggatagagaagacttctttcagtcctgggatcattgttaagcagtaaagcgcgctacatacaactacagctagtaagacacttctgttagagaagaaccctgcttggatagctgtttgtgtatttgaacgtgctgggaatgtttgcagtgtccgacaccaaatcaatgttgaaaatgacatagctacaccgaattcaggtgaatgctgcatgccaagccattgagcgaagataacagcaatcccaatcagtacaccacgatacgttacagaaatcaatgttttgtccgtaaagattcctgaatttggatctcttggcggacggttcatcgtagcgggttctgctttttctgtacctaatgcaatcgctggcagtgagtcattgactaaattgatgaacagcagttgtaatgctgtaaatggattggaccagtcagcaactaaggcaaagatgatcgcaatgatcgcacctaagtttccggcaaatagataagaaatagctttcttgatattatcaaacacgttacgtcctacttctactgcgctgacaatagaagcaaagttatcatccgtcaataccatcgctgctgcatcttttgccacatctgtaccagttcccatagcaatcccgatgtctgcttgtttcaatgctggtgcatcatttacgccatcacctgtcatagcggagatatgacctttattttgccaagcacgaacgatacggattttattttcaggagaaacacgtgcataaacggtcactttttctaaaacttcgtttagttgatcttctgttaattcatctaattccgttccagtcagagctaagtttccttcttcaaaaatcccgatttgttttgcgatagcaacagctgttgttttgtggtcaccagtgatcatgatcgttttgattcctgcacttcttgcttctgtcaccgcttgagtgacttcagcacgtggaggatcgatcatagcaagcaaaccaaccaggatcaaatcatcttcatcttcaaatgataaatcaaaattatcaagtggacggtaagcaaaagctagtacacgtaatgcgcgtgttgaaaaagcttcattttgctcttggaattttttcatcaattcatccgtcatcggaacaacttcgccattcagtaatacttttttactgcgttggaagacgatatctggtccacctttgacaaataagtaattttcgttatcgatcgtgtgtccagtagacatcaattttcgatctgagtcaaaaggaagttctgcttgtcttgggtagttgtttcgaatttcctgataaggctggtttagtttttcactaaaatcgataaacgctacttccgtaggatcgcccaatttagtaccgtcttcactgatcgatgcatcattcgctaagacactgatttcaatcaaacggcgttcgtcagctgtccactttgaaggatcgtttgtgaaatctccagtatcgccattccctaaaaagtagtcaacaactgtcattttgttttgtgtcaatgtaccagttttatctgtacagatgatacttgtcgagccaagtgtctcaactgctggaagttttcggataatggcatgacgtttcgccattttattcgttcccaaagataacacgattgttacgatagactgtaatgcttctggaatagcagctacggctacggctacggcaaacatcactgcactcacgatatctgcagtcatatctcctgtaccttctccaagataaatacggaacaattggatacctaaaatcaatagagataatgccaaaatagccagacttagttttttactgaatttatccagacctcgttgtaacggagtgacttgctcagttgttgattccaaaagaccagcaacttgtccgatctccgtattgttcccagttgaagtcactaagaatttaccgcgtccgtaagttacgattgttccactgaataccatattcgtacgatcaccgattggaacagtacttgtgatatccattacttctttttctgcggaagtcgactctcctgtcagcatgccttcatctacttttaatgaacctgcatccagtaatcgtccatcagcaggtacataatcgcctgcgtctaacaacacgatatcccctacgacaagttcgtttgccggaatcgttttttctttaccgtcacgaatcactcgagcatcaggtgctgaaagatttttcaatgcctctaaagaaccttctgctttttttgtttggacaacactgatgatagaattcaacatcaacactgcaaaaataactaagaattcgatgtagtctcccatgaccatctgaataagtgcgacaatcagcaatacgataaccattgcatctttgaaggtttctaagaacaatttccaagttggcttcttcggcttttcttttagctggttcaagccatctctttctaatttttccttcgcttgcgtggtgctcaatccatcggttgagctctgcgtttgctgcatcaacgaatcgatcgtttctttatagaccgcttgttgtgcttgttccttgttttccaaatttcatcccccattttttgatctcggtcctagtcctgtctgaaaaaaaagagacctaagacaaatgcgcatttgtcttaggtctcaccatttcatacaataccagaaaaccatttggttaacttactgttgatattatcgcaacaaaatgttgccggttactcccctaaggagatattcaactgtaataatatcctaccttattaaactacaaaaagcaactactttagcccgatttacctacattttcatgaaaagagtgaaaagtatattcaccttggtaggcttctttcttctatcatgctatactaatgttattgtatgtaaggaggaacatttttgtggtatctagtattatatccgccctttatctattgaatgcacttattgctttagtggcgatcttgattaaaccccgagatgtagcagctatttgggcatggctcttagtattgtttgcccttcctggggtgggttttgtattatatttatttttcggacgtggattaacggataagaaaaaattctatctccgacaaagtgacttgaaagaattagaaaactttcagtcttttagaggagataccattgaacattacgatcctgacatgggcgacaaagacaaacaacaatttgtcgacttcttctcttcattaaatcgtatgccgctgacaagaatgaattctgtcactcttctcacagacggacaaaagaaattagattcactgcttcaagatctaaaaaaagccaaacattcgatccatatcgaatattacgcatttgtgacagataatatcggtcagcaagtcttacgcgttttagaagaaaaagccgcagaaggcgtagaagttcgtatattatatgatgcatttggctcccatggcacaaaagcaaaagatttcaatcgtctaatcaaaaatggtggacatgtccatacatttgttacctcgcaaaaagcattgcttcgtttccgattgaattaccatgatcaccgaaaaatcgttgtgatcgatggaaagatcagttacaccggtggtttcaatattgccaatcaatatgtaaatacgacaaaaaaattcggttattggcgtgatacgcatatacgaattttcggtgctgcttcttctttgcttcaacttcgttttttaacagactggaacgtttcagtgtctgaagaaaaaaaggtcggctatcatttgaattatttctttaaaaaagccgatcgagatgaatccaaacttgctgatacgtccatccagcttgtctcaagcggaccaaataacgaacgagaacaaatcaagctttcgtttatcaaattgattacttctgctaaaaaacgtgtttggatacagacaccttacctcgttcctgatgaaagtgtcattgctgctttgaaaatcgcaactgcttctggtgtcgatgtgaaaatcatgatccccaataaaccggatcatccttttatttatcgagcaacacaatattatgctcgtcagctcatcaaggaaaatgtacagatccttgtctatgagaatggcttcctccatgcaaaaacattaataatggatgatgaaatctgcatggtaggttcagcaaatcaagatattcgtagctaccgattgaattttgaaacaagtgctgtcatttacgatcctgagtttttagaagagcttgctactcagttcaaagaagatgagacacattgttcaccaatgacaactgaaacagtgaaggaaatgtctaactggctgttattcaaacaacaaatttctcgattgttttctccaatcttataatttttccattcaagtagagaaaaatatactaaggttaaagggactgtgacaaaaatcttgtcacagtcccttcttccgaataaacggtgttctcctgccaactcctcgatcacaagtcacaatattcatcaaacatgagaagctgttttttgaacttgttccttatgactcggagctggacggcaggctcacgacctcttggtaaacggtgttcaaaagccagtttctcggtattaagccaaatttatgcaaaaatgtagaaagccattttcacaaaatttttcttaatactcgaaactaagcgaatttttcacaacctctttcttttactctaattcaccggctgcccaatgattgattggtccatatttatgccctacgtttatttcttcacgaatcgcacggtttacatagtcttttgccaatcggattgcttgttctactgtttttcctttagctaattcggctgcaatacatgcagataacgaatcgccagttccattgatccggtcagtaggataaaatggcgcattcagccaaaatgattttcctgattcaagcaatacgtagtcgttgactgtttcttgctgcgcatcttttgcatgatgtcctttgatcatgacgtttttcgcacccatatcttgcagttcttttgctgcttgcacaaaatcttcttcagttgctaatgtccgtccagtcagcttttctgcttcgtaaaaattaggtgtcagtacttctgccaaagggacaagtttttctttcaagctttgtaaagcagattcttctagtaaaagatttccatgtttcgttacgatcacgggatccacgactaatggaccaaaatcatatttttgataattttttacaactgtctcaatcaaatttgaatctgctagcatacctgttttagctgcacgtatttgaaagtcctctgcaatcagttcaaattctttatcgataaaatcggttggcaaggtcacacttgctccgattccgtaagaatttcctgcaacacatgcggtcatgacagaaacaccgtaaacacttcttgtaaagaatgtatgcatatctgcttgcatccctgcgcttccatcgctatctgatcctgcgatcgtcattgcttgtacatactgttcttccatcaaatcaatccctccatttttataaaaaaattttttcatgatgctgttactgtttctatcatatgtttttcaaagtatccctcagtaaatataccactaccttttcttggtaatcaaatttatttgaaaaaacatttgtaataaatcagaaaatagttgtcatttatttggactagttattctaataacaaatacccgctattcgatttatatatatttcagtatccttcttgttttcatataaccaatggcgctatgatttccatatgataaaaaataaagtcaggtgaaaaaatgaaacttgaggataaaaaagtcattttgaagaaaatcaaacgtctcccagaccaaatagaaaactatacgatctgttctttcaaaaaagacaggagtataaaagcttatacgcaaaacacagaaaaaggaataatctatttcctacatgaagaaggttacgatacccaaacctttatgtttactgaaaaaaaagaatttcataaacagatgaaaaaactgattgaaaaagaatttccaagaagtcataaactctatgtgaatcagcaattttaacttttaactatacgctcttaactaaataggttctgtaataaaataaaactttataacaactataacaaaacagaatgcaaaacaacagttctataagttataatcatagttgttagatgattcatctagtaaaaacaccagatttcaaatttcacacaattgaaactagatcaatcatcaaccttcttcaaattgttagaaccctttcccgaggagctgcagcataagcaagaaaaacaaacaggaagccaaatggctgagacattccttctattagtctagttgtttctcgtcgcaaatttaagactttagaaagttatttctattgatgtttgggttgtttcacgcttgtgctcagctccttacctattatttatctcaacagatcgaacaaattaatggaaaatttaaggagttttgttatgcttacgatctattcttctcgtacacatagttaccatctgatggcaaattggctgaaagaccatcaaatgccttacagagaacgaattttcacgcctaaacagcctttaaccagaaaagaaatcttttatttattatcattaacagaaaacggatttgacgatctattagctaaacgctcgattgattataaaaatttaaaagatcaaatcgaccaatgtacgacctcagaacttgtcgattgaatcgtctcacattttactttgttgcaacgtcctatcattactgacggaaaaaaattattagtcgggttcaatgaagatagtatgcgtctttttatccctgttcaatggcgcagaagccagctcaaatctgtctataacgatttcacgtgggtaagcgatttagacaattctatggagttagatgatgaatttttaaattattctatataaaaatgactgtgacaaaaaagtgtcacagtcattttttcgaataactagtgttccagaagtagcttctacgaaaaataagccaaaatttcttgaagctaattcttgtagctaactacttctgtcacaacctctgactcacggtgttcaaatttgcgcacacttaccacgaataagtgctttgagtgaactgacgataagaatgacggacaagactgccataaataatcaaaaagacacccgttcctacggtaacaaaaaatccagaggcaccgatactaccatccatataccacaaaatcgaagcaaaaagtgggaaaagtgaaaaaatacataatccgattcctgcaatcaacgagaagccaaaacttcgctgatacgcttcttctttttcttttgcttctgctaatactttttcaggtatttttctattatacaaaaagtgatttaagcgggtgattttcataccagaagcgatgaaaaaaccgacagctaatgctataccgaaaatcagacaagaaacacccatgaatgcatagcctgttgaacaaaagaacagaaatcctgcaaaggataaacaagtgaataggacacctgacgctacttgaagacctgctgctctgtattctttccagtagttttccgcttcacttaaataaatcaaagctgaatttgattctgtctcgggacttggattttcttttttgacatctaattcttctaataattcatcgattgaaccaaatgtcgagatgactgtaccaatggcctcttgttcatttttcccttctcccattaattcatgataatgatcttccatatttgccaacagatcagctttcagcttttctatctcggtacttcggggtactccgataaaaagactttctaaatagttacggattgcatccatttactttccctccaaaaattgatcgaccacgtctttcgtcgtcagccactcttgctttttttcttctaaaagattacgtcctatttcagtgattttataataggtccgttttttcccatgggtcacttcaccagggtacgaaacaatcaattgattcttttctaaacgggcaaaaacggagtaaagtgtcgtctctttgattacataggaatcatttgtcctctcacggatcgttttagaaatttcgtatccataagaatcgtttttgttaaggatcgataaaataatcgcatcattgtatccgcgtattccatcacttgaaatcatgttctttcctccatattactccatctgtcgttgtaatcagcatagcatgattacttcatcaggtaaaataattttttgcaaaaaataaaaaggaacagaaagcaaaagaagcgttatgcttttttgctttctgttcccttaatttattttacaaccatgacgttacatgatgcgtggttgactacataggaagtagtggagcctactagtgcacgttctaccgcattcagacctgtcgcccccatgacaatcagatcgattggttctttcgattcatggaaattagcgatcagtgtctttggataaccgtaaagaacatatgtctcgatatctgtcaggcctttttcgattgccaagtttcgatgttctttcatctgattttccgcaacctcatccaattcttcctgcaggcttgttgtaacaaatgcaaaatcaccaaagtaattgcctgttacttcattgacatacaggatgtgcaacgttgcttgatttcgtttggcaatcgtgattgcctcaagaaatgctttttctgccttttcagaaccatcaattgctactaaaatattgcgataagtgtctaccattgtaaacgcctccttcactgttagtgtagcacgattacagtgttaggacaaacattttgtgaacgttttatcaaaaaatatcaggcatcaaatccgtttttttcagagacctttttaaaccagcgacctgattttttaatcgtgcgtttgccgtcttgttccaagtcaacagcgataaagccatagcgatttttgtaagcatttgtccatgaccaattgtccatacatgtccacatgtggtaacccacacaattcgttccttcttggattgcttgatggacatatttcaaatgatccgtcacaaattcgatccgataatcatcttcaatcatgccttcgctgttaacaaaacgttcttctccttcgactcccatcccattttcagaaatatagcatttgatattaccatagttttctcttgtattcgttaaaatatcatagatgcctttttcgtaaatttcccatccacgatatggattcatttttttattgggcatgtcgtaattatcaaaataatcatctggcatggggctttgttcgtgattgatcggtgtttcttttgctttgatccgacgaggctgataataattgattcctaacaggtcaattgtgttttctctgatgagttctaagtctccttcatgaatgtcaggtattatccccaatgttttgacaatctcgatcaactcttgtggaaactcgcctttcactgcagggtcaaggaatgatcggttgaagaatgcgtcagcgatcttcgccgcttttacatcttctgggttcgtttcatctctcggataacttggtgtcagattcaagatgattccgatctcaccatcatgacaaccttcatggtaggctttgattgcctttgcacttgctaaattctcatgatagcctacttggaccgcttctttcatattgatatgatttggatagtggaattgatacaagtagcctccttctacaggcacgattggctcgttatgagtaaaccattttttgactaggtctccaaacaattcaaaacacgcggctgcataagaaacataagcgtcaaccgtttctcttgataaccatccgcctttttcttgcaaggacagtggcatatcaaaatggtaaagatttacaaaaggctcgataccattgttcagcaattcagtaaaataatctcgataaaaagaaacagctttttgattgatttcacctgtcccttctggaatcaaacgactccattggatagatgtacgaaatgtgttatggccagtttctttcattaactgaacatcttctttgtattttgtgtaaacttgcgaagttttttcaggtcctacttgattaaagaatttttcaggctctaatgtataccaatgatcccaaatattttctcctttcccgtcattacttactcttccttctgtttgcggtccgctagcagcagaaccccaccaaaaattttctggaaatgtgtaggttttcattttgtacttcctctcttttcttcttgatatcgtaatcataacgaacctaaaaaaataaatcaatactttttataaaaatgactagacatttaaaatattcggcgttatactttgtatgtaatcgattgcaaataaatttgaggtgaataaaaatgaacggttttatggacaagctttctgagaaaatcatgcccttagctaatttattagggcaaaatcgttaccttacagttttacgggatgcgtttatgctttccttccctttaacaatgttcggttcgattgttgtcgttatcaataacttgccttttttcagtgacgcaacaaagggaactttatcgaacttattcggtaatgggcaaaatgcaacaatgagcatcatgtcggtttttgttacttttggtatcggctattatttatcaaaatcttatgacgttgaaggtattttcggtggtgccgtgtcttttgccagcttcttgattcttacgccttttgcaatgaaaaccgttggtggtgaagatgtaactggtgttctttcacttgatcgtcttggcgcaaaaggaatgttcattggaatgatcgctgctttcttggctggagaaatctactgcagaatcacgaaacgcggttggcagatcaaaatgcctgatggagttccacctgcagtaacaaaatcatttgccgctttgatccctgctgtagtcacactaactgttttcttagtaatcaacgctgtgatgactggtattttcaatgctaacttacatgatgtcgtttatgaagtgatccaaaaaccattaactggtttgggaagtagtttacctgcaacattgattgctttgttctttgtccaattcttatggttcttcggacttcacgggcaaatcatcgtcaactctgtaatggacccgatttggaatacactgatgcttgataacttagaagcttatcaacatggaaaagaattaccgcacatcatcacaaaaccattcatggaaaccttcactgttggtattggtggctctggaatgactttagctgtcgttttattgatggcctttgttcttaaaaagaaacagtatcgtgatgttggtcgattagctttagcacctggtattttcaatgtaaatgaaccagcgatttttggtctaccaatcgtattgaatgcaacaatccttattccttgggtcgtagcgcctctaatcgtaacgacgttcaattatttggtaatggctgctggacttgtccctgcaccaactggcgtctctgttccatggactgtgccaatcattgcaagcggtgtcttagcaacaaattcatggcttggtggtatgctgcaagtcatcgactttatcatcgttgcctttatctggtacccgttcttgaaagtattagataaacaaccagatttagatattgcttaatggatcattaaggggatgtgacaagaaacttgtcatatcctcttttttcgaataaacaatgttccagatgctacttcgagttgtcggaagcataatctttcgttatactctagaagaggtgaataacgtgccaaaatacgaagaaatcgcaaatattttaagggaacgaatccgttcaaaagagtatcctcccgatagttttttgcctaatcaagtggacttggtaaaagaatttggtgcgagccggatgacaatcaaaaaagccatcaatatcttagcgatggaaggacttgtctattcgcagcgaggatcaggaacgaaaattttgaatcatccattcatgcaaaaagacacatcgcccgctaacgagtatgaaggtttgagcctccaaatgaaacgcagaaatcgttctttgaagagtcaaatcattcattttgatgttgaattccctaatcaatatatccaagaacgattgatgatcgatgccgagcaacctgtctacaatattcaccggttaaggatcttagatggcgagccgtatgttttagagcatacctttatgccagtccatcttgtgccgggtttaaaaaaagaacatttgttagcctctatctatgatcatcttcatcaagaattgaatgtccattttgcaggggcttatcgtgctatttctgcagataaaagtgatgaatatgatcagcaatatttgaactgtgcagaaaacgatcctgtactggaagttcagcaagtcgtctatctcaaagatggccagccgattgaatattcttccagccgaaaccgatttgatgttcggaactattctgtgctggatgtgcgttcaacttaaccaaagaggttgtgaaaaagtcgcttagtttcgagtagtaagaaaaattttgtgaaaatggctttcctcatttttgcataaatttgacttactaccgagaaactggcttttgaacaccgtgaatcagaggttgtgaaaaagccgcttagttttgagtcgattgattgtcacagatacaatcttttgaataacatttaccaagtactttcagaagctcgtttccatctaatcataaaaagacttatgaccacccgtaatgattctaaagttagttttttaaagctagtttttttgaaatcgatacagctagtcgtaagtttttttattttattgatccgttcctcctcttttcattcttgattccttcctgatactttagaagacaaattaattgcaaaataaagatgcaccctctatactatgtctaaatcaataacttactttttgtaagttaacaggaggaaatttatcatggatacacaaatcagaggaattcaccacgttacagcaatgacatctagcgcaacaaaaatctaccgcttttttacagatattttaggaatgcgcttaatcaaaaaaaccgttaaccaagatgacatcgaaacttaccatctttactttacagatgatactggtgcaccaggaacagatatgactttctttgatttcccaaatcagccaaaaggaaaaaaaggaacagatacgatctctcgtgcttctttccgtgtgccaagtgacgctgcattagacttttggttggaacgatttgaaaaatatgatgtcgctcattcagcaatcaatgaacgtttcggcaaaaaatatatcgagtttgaagattttgataatcaatattatcaattgatctctgacgaaaacaatcaaggtgtagcagctggcgttccttggaaaaacagcaatgtaccgacagaatttgcaatcacaggacttggacctgtctttgtccgtgtcagtcaattagagcatatccgcttgattcttgaaaaaatcttaggattcaaagaaacagaccattcaggagatttctacttatttgaaatcggtgaaggcggaaatggtgcaagcatcattattgaacatcggacagacttgccaaaagcaatcgaaggatttggaaatatccatcacttagcattgcgtgtagcagacaaagaagcattggaatactggattcaagtaatcaataagattgaattgccaaattctggtttcgtcaatcgtttctatttccaatctgagtacttcctagccgctcatcacgtactgtttgaactagcaactgacggtcctggattccttgaagatgaaccagcagaatccgctggagaaaaactatctcttcctccattcttagaaaaacgtcgtgaagccattgaagcctatgtccgtcctttcgatacaagtgacgcaaataaaaaacgtgaataatctcttcatgccacttcatttgcatctatagaaacagaaaagagggaacaaaatgtcctacatttttgaaaaaggaacaagtggcaagcatttgatcttacttcatggcacaggtggcgatgaacattctttactggatatcgctcactttcttgcaccaaacagtacgttgctttcttttcgtggcacggtccaagaagatgggatgaatcgttttttcaagcgtaatggattgaatcaattcgacctggacagtttggaaaaagaaacagataagctccatgaaaaaatcaaagatatcagcgaaacagaacagataccgttaagcgattggctgcttgtcggctattcaaatggcgcaaacatcgctgctcatttattattggaacgtgagaccatgctaaataaagggttgtttttccatccaatgtctctaggtgtccatcaaagccgttccacattagaggataaaaccgtctggctttcttatggtgataacgatccaatcgtttcctctgcttcctttaaagaattggccgatcaattcgaaacacgccaagcaaatgtgacgattcagctaactgtaacaggtcatcagttgacgatggacgaaatcgagcaagcgagggaatggacagagcatcttctaactaaataaaagaaaagaactacgacttatatgacacaacctgaagcagacatcaatctggatcatagtgtgtgaaagtcgtagtttttttgccagataggttagtctccgctagctgtaataacagatttattataaatagccgttttatgtttcaaatcttccaatctgccgattttctcacctttcgaataaaacccatcagtaatccctagtgcttggaaaatcgtctgtttataagcgatttctgcattccattcgactgtatcaaggatttgcagtgctttatggatagcttcgattcctgattctccacctgtgttgatcaatacgccatgtgaattgagtaataacatatggggcaactctaaatcatgtgtttttacataatcgcttgtcaattcagcaagttcttcagagcaattaggctcaaagtccatgacaggaatctcttttactttagctgtggcttctgtcaaattaggcataggcaacccagtagtcgcccagaacattgcattaggcgcatgtgcatgcaagacagctttgattgctggattagtctcgtacatcgcttcatgcatattgatttcacgagttaaatgaccgactccatcaacgattctacgcgttcttggttctactactagaacttgtgcaggagaaatctctccaagataggcttctgacatcatggtcggtgtcatgataatgtagtcttttccttgatcatcagtggttttaaaggaaaaattccctcctgcgacatttgtatttttcctttcgaaaatcactcttacgatacgtgccatgtcctgtcgttctctctcaaataacatacgtccatctgacataatgacccctccattatctttttataaaacttttttctctcaatatttctttggtagcttcttttattttcattgattcttctattttctgttttcttttttcatcgtactctctgaataaaacgtgatttccatatttatagatcactagtgcgaaaaaaataaccaatagattgatgatgatattctgagtaaagagtccatatagaaatagcagaagtgtaccacaaagaacgactgtccattttattttttctatctcttctcttttcattgctttcccaccatttcgatgctatttttgcagttcagcataacgttcgctcgggactttcgcttttatcatatatttataaagtagaacaaacaatcctagaaaaattacgcatcctacaatagcgagaatatttctattaaatgcctccgcaaataaaaccctgaactccggcccttctattgatgaccatgtgatcaactgtcctttctcgattccctcaactgctccgcttttttctgctaaatcactgagtattggcgcaagataagtggcaccgtacaaataaataggcatcgtgaggattcccaggatcagcatacgagccaagtttcctcctgttagaagcaatccgccgaccgcaatcgaatagttgatgatccctgctaatggtaatacttggtttcctggcaaaataatagcataaccgataaacacaggaacaagtaaaatagcagtaacccaaatctctgaacgaccagctaatatcggccagtccaatccaatatatacttcacgatccttaaatcgctttttcataaattctgacatcgcgtctgctaaaggagacaaagattgcatgaacattttagagatcatcgggaacagacttaatgcagtcgcagtctgtactgccagattaagagaacctgagacaccgtacgcagcagcaaagccaagtcccaagccaataatgaatcccattacagagttttcagagaagatcccaattttcttcttcaatgcattcgtatccgctcgtttattcaatgcaggtattttatccatgatcatattgaaagggagcaacaagacagcggcagatgtcataaaatgagtcactgttactaatggaatccctgtgagatcctgtatatgcttctgaaacatatcaccaagctttaattccaatataacttgaaccattgctgtaagaaagcctgcagccaaactaccagaaacataataaactaaataagcagttaaagctttcccccaaacattccacatatcaacatttaacgtcttcgtccaattaaaaagtaagagtacaaaattgaccccaatcgttactgcaaagaatataaaagcgtaactccacgaccatgtgatgcttgctgcacccgtccaccctagatcgagcgccggcaaactgattcccgtatttttagccaatgcttctgatgctggacttactgcgttagacatatagccaatgaccatagacatcccgctaaaagcgatccctaaagtcaatgcagacatgaatgcttttttaaatttcatccctgccaataatccaagtatcaaaataatcaaaggaacaaaaatagctgatcctaaattcaaaacataattgatcacggtttggaagacttccataaataaaccttctttcttttgaaatatagtagaaaaactacgagacaattttttatccaacaatcctcctttactgtattaactctttgatactgtcataaataggttctacgcccattccagttaaaaatggaattcctggaaatacttcaatacctaaatcttttgcttgttcaagtacttcatcatcaggctgtgcgacatacacatagattccagcagtaggaagctcattttggattgatttgtaatcaactgcttctacaggaaatgtaatgccatcatcttctaacatactttggatcttactcgcgattgtctgactcgttgctacgccacttccacatgcgacaattaaccggttcttcatttttcttcctcctaaatataatttgtaataagttcgtatattttttgcggtgtttcttgtttcttataattttctacgaatgtttcatccatgaataaattcataaacgcttgaagtaatcctacttgttcttttggttctttgattcctaaaaaaaatagattttctacagtcatttcctgattatcccccatttgataaaaataaattgggttcttcagctgcataacaaaaacgaatggcttttcgacatattcacattccgaatgtggcagtgcaatatttaaatacttagtaatcaatcctgtaggaaattttctttctcttgcaattagcccattcaaataattcgcattgacgtaccccattttttctaatcgttgggcagctattaaaaaagcttcttctttattttttacgtctaccgctaattgaatcagactaggaacaaacatctctttatattccatttctccaccctctttttgattaagtttgttaatttcgtgttctactaagttcatctttgtttacaagaatattatatttctgttagtttattttgtcaacgctttcaaaagaaatttattttgttaaatttgatctacttgaaaataaaatcgtttatctatataattaagaagaacaaagtcgaacaaaacttgacttttatgttaaaggagtaatttatatgttgaaaaaagaaagacaagaacgaatcattacgttattagagaaagatttttatttaactaattcagaaatcgctaacaaattaggcgtatcagaaatgaccatacgccgagatgtcactgaattagcaaaaaaaaataaagtaaaaaagctgtatggcggcgttgaacgaaaggaaccttataatcgagaactatcgactcaagaaaagattgatacgaatgtagccgaaaaaaaatatattggtcaagtcatgaacagtataattccggataattctactatttatgtaggcgccggtacaacaatcctgtatgcactccctttcattcaaaagaaaaatctatttgtaattacaaatagtttgattgctttcaactatttgaagaatcatactagttatcggattttacttactggtggcgaattttctcctattacagaagagttcattggggaagttgcagaaagatcttttgaaagtttgaatgtcgatatctctttcgctgcaacaaatggaatatttgaaaacaatgtcacaactgctcaatttattgagggaaatattcaaaatgcagcgctcaatgcagccaaaatcaaatgtattgttgcagattattcaaaattaaataaatcagatgtctatacttttagaaaattaaccgattttgattatctaataaccgataatcatttatcagaacaagatttccatcattattcaaaatacttaaccatattaaaggagccaaaaaatgatactgacaatcacgatgaacccatccattgattccatttattttacaaaacactttgaattaggtacgatgacacgctttgcttctccggtacgctatgtaggcggcaagggaatcaattgcggacgagcttctgctttactaggttcatcagttattttaacggggtttttgggcggttattttggcggtatgattcaagatatgctgcaaaatgaaaatttgtttgatttgcattttttacctattgcagaagaatcaagaggtgccgtcaccatcatgcatgatggtgaaacgcagacagagctagtggaagctggtcctgaaatagcagatactactatcaaaaaattaatgaatgatatcaaacaaatcagcacaaataattacctttcagtcattacaataaatggttctgtcaacaatcaagacccctttttatatgctaaattattacaatatatcaaagaacaaatagatccttccatctatatattaatggatatatctggacaacatctccgtgaagtcttagcaagtaagtataaaccgatgtttatcaaacctaatattcatgagttttcagatatcatccatcaaaaaattactaaaaaaagcgatataaaataccatttaaaaacaaatcctttatttaaagatatcgatgttatcatgatttcttgcggctcgtatggtgcagtagtcaaagtaaaagaagaattttggaatgttgagatccctaagattcctgtcattaatacaacaggctctggggatgccactgttggaggttttgctcattcattagaacagaattatcctttaaaagaatgtgtaaggtacgcaatggcttgcggcatgtcaaatgcacagcaatcagaagtcgggaaagttattccagctgatgtaaaaaatctagcaaaaagtattaaaatcacagaaatgaaataaatagtacaaagtaaataattgtttatatgagatgagacaaaaaagagcgtgagacaaaagtaaaaaacactaatgataccctacagatatcaaccgattctatctactaaacggagtatatcgaatattttctaaatgatgaataaacaaacaattttttcatttatcttattttcattgctcaatggaatatccaaaataagtacccctatctatatgtttattcacaaaaaaactccaaaagtcagattttcaagtctagcttttggagttttctttaaactgattattagaagtgtttattttttcactcaagtatcctgcacttacagaaatatcctttttaccgccaacctaattctggagcgatatcttttacgattgtttcaagcaagtgcatgttgtattctacccccaaagtattaggaatcgtgacaagtactgtgtctgcttctttgattgcttcatcttcagctagctccttgattaattgatcaggttcacctgcaaaagtttttccaaaaatcgtcgggttccgatgataagcaagatagccgacagcatcttgttgcggactaccgtcttgtccaaataagcgtcgatccaaatcagtggtgattggctggatcgagcgagtgaccaatgttcttggttcaaaatcatgacttgtttgcttccacgcttctttatacgcacgtaattggtttgcttgttggatatggaacggctcatgggattcgtaattgactaatgtagatgattgcagattcattccatgttgtgctgcccagattgccgtttgctgtgaaccagctccccaccagattctttgtcgtaatccttctgaataaggttcgatccgtaattttcctgatccttgtgggaacattggttgaggatttggttctgcaaatgattttccttcaagtaattccaagaattcaagggtgcgttcccgtgttacctctttgatttcttcttcactgtaatcataaccaaagtatttccagccatctaggacttgttcaggtgaaccacgccccactcctagttgcactcttccttgcgtgatgatatctgtcaatccggcattttctgccatataataagggttttcatagcgcatatcgataagtcctgtaccgatttcgatcttattcgtctttgcgccgattgcagctaacaaaggaaacggcgacccaatctgaggggcaaaatgatgtacgcggaaaaacgctccgtctactccaattttttctgcttccactgctaaatcgattgattgcaaataagcatcttgagctgttttcacgagtgatccttgctccatccaatgtccaaagcttaaaaagccgatttttttcaaggtagtgacctcctccaaccctacaaaaatggaaggttttttatttttaatatgaactgattctactactttttttcttaaaagactaataattgttctcgcatcatattcaagaaacctattggcttactatacccctacttccttcatcatctgccatgtcttaatctcttttaatagtcttttccatcgttgttttttgactcaaaatgattgtttctaacatgtatttaaggatgtgacacaactttgaccacatcctcttttttttgtatttagttttctacttctaaataaatagatagaattattatagatataaaggcagttttttaatatctgcttattcataactagacaacaaggttaaaatctctagtggatgattggattgcatcaactgtgccatttgttctggttgcttttctaaatagtgaataacagaaaaaatttttttgaactctgcatgtttcaaatcctttctctttattgctaacagcagtacgatacgtatctgttccccatgccataggatcggttctttcattgttgcaatagaaatcatcgaatgttttacatacagcggattaccgtgaggaatcgttacaaatggtgccactctagtactggcgtgacggtctcgttccaagacagaatcgacgaattccggctccacataatgatgttctactaagacattccccataaaatttaaaatatctactggatcagcccattcaagatgaggaaagatcaaaaatggatgagtaaagcttgctagatcaaacgtttttttcttcttgataggtacatgttccagcatatattttgtcagataagccaggtcagtttctgtgatcattggtgaaatctcgattactggaatatttgcatgtttaaacggtaatgtagctaaaataaaatcaacaggtggaaagtcttccctctctagttctggcttatattcaattaaatctataatcgttaattccggaagttctctgttcagccgtgcttcaagaaaagtagccatagcttttgaatattcactaactaaaacggcttggtatcttttacttttctgatgtttgtgtcgctcgatcgccgcttggaaatggatcgttaaataagctgtctcatcttgcggaacataaaaattttctttctcaaaataatcttctagaatcaactgtaaaactaaaaaaagttgtgtgtacgtactaaatacatttttcgtcagtggattagaaatctgcaagccgtaatggagtcgaaaataggtcgaagataaatgagaccttaagttttgtttcagtaactgatcttctttcaatgaataacctaaaaactgctccacttgtacaatcaaatgatcagcaagtgtactagattccttttgaaatcgtgtggctgcttgtgagtttgtaaaaagattggcgatacgtaaagccagataattgatttcatcaggagaaaattcaattgggtaaatagtagctaactttgctaagatctgactacttaactgctgtgcttgggtatgctcaacgacttcattttcgtctttacttaatttcactttctggtactgtttcattcgctcaagcataaaatagatatgaatctctacactagccagtcctcctggttgttctagatgattttcatagaaaacttcttttaatgtatgttggatgacttttaacgtatctttggcaaaaaattctttcaacgaaggactttgcggatcttctttctgcatattgcgtagcgtcttaacaagcagctgtcttttttcttgttcatcgcctttaagaaaagtgccaagttttgttttggatactagctgtaaattatggtactcaaaaaagcttttcagctctgtcaattctttacgaatcgtacgttttccaacatatagtttttctgaaagctcttcaagactaaatccgtcttttgctactagcagatggaaaatcaataattgacgaagctggtttttatccatttctgtttgtgcctcttcattaagtgctcgtttcaattgttccttttcgtgaggcagaccattcaacaagattcctgtacccttttttctttcaatcatcaaaggcagctgtttgtccctgaaccaagtttcgatgacattcaaatcgctatgaaccgttctttccgacacatggaaatgctctgctagcttttttattgtgttataattattcgtttcaattaattggtaaatcaaagattgctgacgctgattcataataagcagaaactcccttccaaataaaaaatcgatcatgataacacatctattatgtctcatcacggtcgatttttcatcttatgttattacatttcacttaataattggtgaaccgctgctttatctggcgcatccatcaatgcttgacggaaatcatcatccatcaatttacgtgaaagacgttgcagtattttcaagtgcatatctccttggctgttttcaggtacagcaatcataaagatcatatgtgcaagttttccatctaaagaatgccactctactccatcttgacttctggcaaaagccaccgttggtttacgaacataagctgattttccgtgtggaatagcgattcccatgccgattcccgttgtactttccttttctctatcatagatgacttctttaaatccgtttttatctgtgatcgccgctgttttttctaaacgttggactaaatcttcgattactccgtcttttgttgttgctgtttctcctagaacgattgcttcatctgacataatatccgtaatagaatcaaacgtttcaggttttgtataaacatcccttgtttcagattctgttaaatccgctaccgctaccccatttgctgcagcaactgcagtatgttgtaatgttggtttcaagattcttaacattaacacggtgacagcaatacctgcaatcactgctacaaaaaacatggctacatgatcgactgctcctaaaactgctacgattggaccgccatgagcgacatgatctgtcactcctgaaagcattgcgatgacacttcctgtcatcgctccgactacaatgcttggaatcactcgtaatggatctgttgaagcaaacggaatcgcaccttctgtgatcccgaacagccccattgctaaggatgccttaccagcttctcgttctgtttttgtaaatttggttttcaatgtcaatgatgccaatcctaatgctaacggagggatacagatagctacagcaattggacccataatggaataatttccttctgcaatcaagccagatccgaacagaaaggctactttattgaacggtccacccatatcaaaagcaatcattgctcctaagatcatagctaaaacaatttcacttcctccttgcatccctgctaaaaagtgagtcaacgaactaaataaaagagctactggttctccaataacgtagataaacacaaaaccaactgccaatgatcctaaaattgggataacaatgattggcataatcgattgtaaagctttcggtactcgtactttcttgattcctaaagcaatgaaacctgctaaaaatccagtgatgattccgcctaagaaccctgcattcgcatcactaccatataatgcgccatttgctgctaacatccccccaacaaatccaggaacaagtcccggacgatctgcaatgctttgcgcaataaatgcagataagattggaaccatcaatcccatagcaatacttccgatactattcatcgttgcccaaatcgttccttctggtatcttgattccttcaggcgtcgctgttccacccaatgttaatgaaatcgcgatcaataatcctcctgtaactacgaatggcaccatatatgaaacaccattcatcaaactcttatagattttcttacctaaattttctgattcacttttattttcggcagaaatagtggtctctgtacttttatagattggcgcttttcctgctaaaatctctcctaccaattcatctgcatgatgaattccttcttgcacgcctacggttatcaatggtttgccgccaaatcgtgttttatctattttagtatccgctgcgatgattacaccagctgcttcttcgatatcttttgcagtcaattcattttcgataccgatagaaccatgtgtttcgacttttacctcggcgccaactgctttccccgccttctctaagttttctgctgccatgtatgtatgggcaatgccaactggacaggatgtgattgcaataatttttttcattttcctaccgcctttctttctacacttacagtatataaaaacggtttctttttattaagcacaaaatgattccgtaataactgaaatttttggaataaatagaaatttcgctaaaaaattgatatacaatttattatgttgaataaaatactattggaaaatcttacatttctgtacttctgcttacgtacatctaaattattatctacattaacaatttccgtaattaattataaaaagcttattccatttcattctggaataagcttcttattttctaatgagttagtgaataattttttttaccatgcttaatagtatccttacgtctcctatacgcgtatctcctgtttctttatctataattgaactgtaaacatgaggaatcactttttttacacctgcatcgattgcaattttcagaatttcttcaaagtttgaaagatcaattcctcctgttggctctaaatagaaatcatattttgcgcaagcttccgcaactgctttaaattcttccctatgtgctaagcctttcatcgggaaatacttgattgaagtacctcccatgtcttgcagcatttgaatggcagtttcaataggcacttcagctgctggcgcttgtgaacttaacggacctgtagcaatattgacatagccgatcttacctgttggtgaaaccaatccattgatgaccgtatcattttggcccaataaagcacgagaagtccccacgccagtaaatacttgattgacatgttgtggttgtaaaaccccagataaacgcgaaaccatctgactttggtttggatctccagcgcctaatccaactgacaacgcattattggttgcgtcttggtaccttttcatatcttcgattgctgcttcatcgctagcataatttttcgatagcacacctagtacgacatgcccttccgctgcttcatagcatgcttttgcattttcaactgaatgagctaatacatttaaacatacccgatttttataataatttgggataactgacaatttaaaagcctcctacatgatttctctcaatctttttatgattttttccatttcgttttggctgacggaacgaatgtcgaactcaatgattccgttatttgcttgatattctcgagtgtagactgctggatttcgtgcttttaattcctgaatgacttctttcgcacttttatcgccattaatcgttacacttgctcgataaatatctctgccggcaccatcttgaactattttcgctgataggtcaggaagttgattgattgcgttaacaaaaggcgttaatcgttgcttcatggagtcaccggattcgctcccattttttaaataatcttctagtgcctgggtaaggcctaaaatattatctttaccgattttcattgctcggccaatacctttagactgtagccgaatccattgaatatacttcttttttcctatgaccagtccggcactcggaccttcgattgcttttgccccagagtaaatcactaagtcaacgcccatttcgctatatttgaataaatcttcttccgcagctgcatcaacgatcaatggcaaacgatgagctttggcaacttctaccatttctgccactgtcagcatacttttctgaactgcatgatgacttttaatatatagaagcgcagcagttttttccgtaatcatcatggaaacatgttccggtgtacacatatttgcatagccagcttctatgacttttcctccaccttgagcaaccattacttcaaccggtgtcccataatctacattatgtcccttaggtatgatgatttcccgtctagcgattttttctgtatagggatgatagacatggtacatgttgccctgtccgattaaagcagcaacagattgagctatccctgctgaagcagaagaaacgatttgcgcatcttccactttcagtaattgagaaagataagcgccggttttgatggcaagatcactcatctcaaaaaaatgctcgcctccaaatcgttgtgctgctaggacactttcagataccttagaaacccctaggatcgtcatttttcccgatgcattaatgacttcttttaaatcaaactttccatagctaattgtcatatatgacgcctccaataattgttttaatcggtaaaatttgttctttagctatacgtgtaaatccgttagaatctttcaattccttttcattttcaacaatctcaaatatcgtcaaatctgcatcataattgacagctaactggcccttattcttcaaatgaaaattccgtgcaggaactgctgtaactttttcaatgatttcttcccaagaatagccgactaccctcaatttttctaaagtagttgctagatcaaaaactgggccatttgtacgattgcggatgtagatatccgtactaatagaggtagctttcattcctgcttttagtgcggtttctgccacatgaaaattaaagctatccgtcccatgtccaatatcaaagacaacaccattattgtaagcatcccagacaaagtttttaatttgatctgtctttggatctaaaataccgtttggttttccattaaaacaatgggtcaatacatcgcctctttccattcttgacaatacttcttctaactcaggaggtgcagaaccgatatgaaccatcaatggcagatcattgttttctgactggatttttttagctaattctaatggcttaatgccattttcaccaacaactgtcttactcattctcgctttgatcccgacaataaattccggcagttctgctaacgcagtacttactagatcttcttgaatctttgttagatcagcaagttcatcttgtttgacaatgccccatttagagatattcattagcgcatacacatttgtcttgaccgatttcgtcaattgataaaattcacggatgttttctgctcccgtagttccagcatcaatgaccgtcgtcacacctttttcgacccctatctgatcaggatagtcataataaagattcatcttttcatagcagtggacatgatcatcgatccacccagcggataaataatactttccctccaagtcaactacttcttgcgccggctgatttatttctgttgcaactgctttaatcatgcctttttctatagcgacctctatcttagatccatcaatcaaccttccatttttaatcaaagtatcaaacatttaatgaccctctttctattaatttactgccgggaagattgctcctaaaatcattgctcctaaaatagcacctccagcaattggttttttccaagcatagaatcctagtgctcctaatgtagcgccaatgccgattggaatagatgctgcacacgcgcttaatataattaatggacccaaaaaacgtccagatgaatttcctgcccccatcatgacgtcagcaccaaaagtggaatttgattgattgatcgtaaatttacgaatcaagacaatgatgccaccaacaatcaaacctagaaccaaaccagtcaataaagagagtgcaaaattatcgattggtgccgctattttcatacttaagagaattgctggtaccccaattccgatcccagttaggatcgaaccgcctaagtccaagatcccaactaaagagccttctaaaattctggcaaataagaaactagcaccaaacgctgccgctgcgccataggatccgccatccagcccggcttttaacatcgccacgatcgaaacttcattgaatgcacccacaccatacatcacatacatgtgtgttcctgcaaatacagcagcggacataattcctacgattagcggaaaagaccagtctgcaaaccaaaagctcttttgccgctttacttctaatacttttgcttgttcttctgttgtctccatgattctcctcctatttcacactaaagatgttgtgcaagttatcaagccaattaggcacttgaagctggaagctcttgatcatttccatatcaaatccacggaaaaatccactgaaaataaataataaaacaatagcgatcatcatgctcttcgtgacgcgattccaaccgctctcatcgacgcctttaccaatcaagattcctagaacaacaccaggtaccgcatttcccatgatcaattacgcgataccaccaaaaagagtgccccaaaaaccagttcgtttccctgcgtctaaagctgccaaccaaaaaataactggcattactgtattgatcagaatcgtcgctgctggtaccaaaacggaaaccgccgtcacttgtaacgcctctggaattgctgcagctgttgtgtttaagaaggctaccacccctgccccgataaccgctccaatgatccccatttttttcggatcatgcatggtctgggtgacatctttgttttttgctagaagtgctgccgctgcccaattgggaatgattcgatgcgtcacatcttgtgtgaatgcaccagcaccaactgaagaagcccatgcattaaagaaaaagcctaaaccaaatgaaaaatgagaagctggatcacccatgcaggcattcatttcgcctaatgttctaaaagctcctaaaccttgtgtattaggtgcatgaaacattcgagctgccccgacagatgctgcaaaaccaagtaatcccccgataataaccgatttgactagaatgattacgaaatccacgttattctttcccccttataattcaaaattagatttttttagttacaaatggaatggcaatcccatttggatcttcagtcatttgctggctgaacgatatgtctgccaattttatttctgttacagccacagtaacagaaagttcgacttcatagctgatacgttgccgtgggaagaagaaaaatagaaagcgttctgtgtatttgttttcgaccgcctttaaaatatccacattgactggttcgattcgcaataatacgtttgattgttccattattttgttttgaatttctgctaacgctgatgcaaaagcatgttgctttgtttcccctttaccggagacgataactttttgctgaattgtcttttgaacgctcatttcatgtccctctttctattttccatgctttttgataaattcttctgtcagacgtttccctaattcctcttgatccataaagccgaaacctagaacagttttgccatccttgatagctgtgatcccttcttcaatcgaacgcataccatgtcgttctggatagccatattttgttgctgctgttaatgcacctgcaccaccactaccacaaaaagagatacccatatctgcatgctcttgttgcatcacatcgcccaaacgcatatctgcccccattcctggtacgacaaatgctttgccgccagctgcttctacccctttggccacattttgtcctttacccatacggtctgcaataactactgtaatcatgattgttccctcctaaatattaattattttttgctgtttcaaaatgaatcgacaaaacatatatttcatcatcggttaaattaccgatacttctaactatttcatcagaaatagttatggcttctttggatacttctttgaacaaatcccgatcgactacgggaatcgtttcctttctttgagaacgtttcagcatctcattcaagtgattaattagaatggtccactgcaactcggttggtacaatagcatgttctactaatcgctcttcaattagatcaatcacttgttttaacttttccagattttgactttcctcgataatttttaaagcctcgtctgacattttcactaacttgacgctccttcttttatatatgagaataatgcactgatttctgactgattgattcctaaattattttctgcaaaaactgcttcgatttttcctaccagtgttcctttgtctaaaataatctgatctacttgacgaccttctgccatatattgttgatcaaatgtgatacgatgaaccattaagaatacatgaagcaaaaaagcttctcgatattcttggatcaattctgcttccaaaatgacaagtaaacgttcataaatcgtataagctttcaaaatcaattccttgctaaagtcttctaaagtatctttattgatggacgtttctctaagattcaagttatgcctttcctgctgattggaagaagctagtattttttttattatttgttgaatttttttcaagtcctgttcagtgggtaatggatggactttgatgaaaggacgatcgatgccattgattggaaaaatactaatcaccaaatcaggatctttggtagcaatcatttcttgcgcattcaatactgaagcaaatgccacgatagtgatattatttaattcttcattgatcttttgcttgatcagactagtcacacccaaccctgttgaacaaatgtagacggctctaacgcttcgtagatcttcttctctttcgtaggaaaccaaaaagtgtaaggcgatatatgccacgaaagaatcattgatcagaatattttgttcacttatttcttgtcgaactgcttgcttgattgcatcaaataattccgggtatttctgcttgatatcttctttaaaaggattatattcattgacaaattttttctttctcgataatcgcatagataaatgagcatacagattcgtcaacaattgtggatcttgataaaaagaatggttgattgctttacttactttataaatcacattctcaactagtttcataacgtcttgctggtgaatcgtgtcgaatgtatcactatagatataatgatattcatcctcgaacagtggcaactgataataatcaaagacctgctgcatgacgcgataagaaagatcgtttttgtctaattcttgttcagcaaccaattgataacgaccaattgtagcctctttgcgtaagcgaacggtagcaattgtcactcgaatcagaatatttagtaattccgcgtaattcagtttctctagattttcaaattccagtaagtgccgcattcgaatgattacttgattaaatacctcttggataggtgtagcagtagcagaatacatttcaaagtattcagtctcaccgccgttcaataacaatgacattaatttataaatgtcataatccgtgaactctttttgaagaatctcttcaatcgttaatcgaactagacgttcttctcctgtgatccaaaaaccctttcgcgcctgacgattcaaggtcaatccttccttaagaaaattattttccagcacatctaaatcattcatgatcgtatctttgctgacatctaatgcgttggccattttcattccagtaatagcttcttttgttactaaaagcataattagtaaacgtttgattcggagactttgatctgcaaatatttcaaaacgattaacatccatcaattcgctttttaatttgattcgatcagagctactaatattcatccaaattccctgactacgtttgctatataggacttgcttccgttcattcagccactctcttatatcatctagatcgtattttatcgtccgaacactaacattttctttttcagccaactttttgattgttaccggttcagacatttccaccaagtaaatcaaaagctgcctttctctttttgttagctgctgcattatcatctctccttacattgctaatataagcgttttctaaactaacaacaatatgaaatgtttgcacttaactaagtgcaacttatagctttttaactaaacttacagagtttatctattataaagacgactacatgtactgttaaaatacgttttttattgcactaagtcgtaatataaataatcaaacgctttttcaaattttttaaattaaaaaattgagaacagctttcaatatcttaaaccgtatattctctaaaaatatcatggcttacacgttctatcctaaataaagtttgactggatcaccatacaaaaattaaactccatgtagaataatacgcggctgacgaattcctacatgaagcttatctatgactataaatatttaaaagtaatgaataaaactaatcaatgatacacgtttattggtattgatcatactcaaataaaaaatattcaaacagatggattcatactttctatcccactaaaatttcataaagtatatataattcccatgtcgatattttgattttataaaactgttccaaagtatagaaaatcgtttgtgtattttgataaaacaatttgttgttgattttcagctggttgatatcttctgggactggatagtcttctgcaccaagtatcgttcgttcgaccatcaaagctagatgcatcattaaattgaacttcattttagcattcaactgaagactgaatcttttctcgcacttttctactacatcttctacttgtcggataatcacatcagggtttaaaaattcgagtttttcagataaaccttcttttgaaaagaaatgaatgaattcgttcgttaataatggaacactactaggatgaattaggtttctcaattgtctattcaatttattctctgcatcttcatccaaaacatcaattagattaatactaggaaccggggttgtgttatccagataggaagttgtcaagatcaacgccgtctctttcaaatatccttcttccgaagaagctcgttctaatgtgctcactaattctccgtagtttaatacgattagcttaatgtcaggattaaagtatttttcacagatcatttttattttcttagcaatatcacgaccagatatactagaaataatgacatttttttctacagcaaaaccttcaaaatactggatattcgttacaaaatcactttctgccgtttttgcaatctcataaaaaagatttccattgattagttgctgtccaatctctagtgcataagaggtagttaaattattaataactaataattctcctaaaatttgaggcttcaagctcttatataaatgagttaatgagcccatatccacaagcatgatcactccttcagatgtatctctttctgaaagccaatcattaacttttgtgataatatctctagcagaagatgataaaggcatattgatagcatcaaaaacgtaatctccacacattttatttgccacagcttgaatactactagcagtcgcatttccatgagctactagtaatgcttggtaacggatgtcttctgagaccttgccgatcagcattacacctaagaagaaagtaacaaaggggcgaatttctagaggaagctctcttgtgagattagtagttaaaagtatagttctaggatactgttttgatagtagatgtattttttcttttaaatttttttctggtagttttccttttaagatttgtagtaacctacaaacaatttcaaggggttctaacgtcatcgcttcattgtcgatgattctacgattttgtttttggatgcttgttttcatacttaaagacaaactatcatttgacaaagtcactacattttctaagtattgactatcaaatttttgtaatttttcttttaattcagcaaattcatttatatctaatataggcatcagtctctctgcaaaaatctggtattcctcaatagatggactagatgtagaggggtaagttattttaactgttgttttcttatcttgacctataaataatgtttgactatgaggtgtcagccttaatgcatcagcacaactcatccttacctgatttgataagcttccaatattacctgaaagttcttgtgttgttaaggcaaaaaaattctcgtttgaaataactatattcttttttattcgctttgcttctcgttcaaacaaatatttgactagctctatacgctcaaatattggtcgttcatgaaaagctggtaattcaacaataacggaaatacgtcgataaaatgtcggtaatagtgcttcttcaggcttttcagtcgttgcaaataataatcgaacattcgaagaaatcatttctgcttcttcgccgataggccgaaaattccctgtatccataaattgaaatagtttttcctgattctcgtgagataatcgatgtacttcgtctaaaaataaaacactatcatcagcttgcgctaaaagaccaaccttttctttttctgctcctgtaaaagcaccttttgtgtgtccgaatagaatagaagataataactcagggttattagcgtaatctgcacaattgaagacaaagaaattttttgttcctttacactttttttctttaagatatttaaaaattaagtgtgctaaaaaactttttccaactccacttgctccgtgcaaaagaagtggtaatcctaatggtggatacaatactgctgccttacacgtctcaattgctcgtttagcactaccattatttccaatatactgagcaaacgcatctttcacgcctttattttctgattcggcaattgaccagtacactggttttgttccgcttttttgtatttcatttttatctaataattcattcaaatataagcttgttgctgagcggcttaatgagatagaatcagcaatctcctgtgttgtcaaggtagttgctccagataataaattcagtaactgctctctcgtttcttgtcgcatactcaaacctccctcataaaaaatatagtatatgataagaaatgaaaatgccatatcctccaaaaaggcttacagcaaatggaatactaaaaaatcaaaactactgcagtcagagtgtatcaaatcatactcttagctacagtagtttttcctatgggacacggctctacttatttcgaacgtagtaattgagataatatcaaggtggctgcttcattgtcggttttagcttgtagaatctctgctgcttcatcatcaacaaaatgattcaaccagatcggacaccagccggctaatctagatggaataacatcattttgataactatcccctaaataataaatttttgttatcttttctggcaattgtttagaaacttttcgaaaacagcttacacttggttttgcatcacctaacttttctgaaataaattgccatctcggttcgataaaacgatcaagttctaattgatctagtttactttgctgttgctgagtgaatccatttgttataattccgcatagaattccactttttttcaaaacacttaaaagtaaagacatttcaactgacaaagtctgtttgctttggcataaatgatagtaagcatctaattcagataaattggtattcttctttgaatttaatgtttccatcactagtaaccatcgttcgtctttcttttttttatctaattttccttcttgataaaacttataaatcttttcgctatgacagcggaattcatgataaagacgctttaaaaaaggttcttcgaggaaagaatcaggatagtactttcggatggtacatttgaaggcactataattgtctaataatgtatcatcaatatcgaaaaaaacagcagtgttttctagcatatccctaacagtcctaatataatacctaaaacataataccaaacattactacatttacgttgacttttttccgtaataaccaaaatgcaaataacgtcaccgctaatggtatgatgcctataaataattgatcaaggtaatcttgaattttcatcacttctttgctgccttccacgctcacctctaagatggtcttgaatttgacattcgatgctgtcattgatcccatcatcattaagcccaacatacttgaagcttttgtcaaaattttcattccacctgattcatacattcgttgaataaaactggcacccacagaataaccgctatacagtgcgtaatagtgaatgagaaaagccggaatattataaatcaataaaaatatgattgcacctagcggagaaccagttgctgctaaagagataccgatacccgctgcgattacccgtaaaattccccagaaaaatgaatctccaatacctgatattggtcccattaatgatgctttaacagcagtgattgaactggcgtcaaaatgttcatcttcactattttgcttttccattgaagcaactaatcccataatgaaattattaatatgcatcgttgcattgaaccaggttgtatggcgaacaattgcctctgcacgttcttcttttgtttgataaaaacgattgataactggcagcagcgtgtaaatgacgcctactgcgtggtattgcgttgctccagtacgactggcattcatcgtccatgaacgccaaaagacagaacgcatcattttcttttcttcttttgtcaagttttcttggaatctcatgcgaaaaagtcctcctcttcttctgcttttgtcattagccctttgtcatgcctattaccatttttaccaacctctctaatttcaatatcccgctgagcgctgacaacacagataacaaccccaatcacagcaacagccactgccggcagttgtaagtaagcggttagaacaaacccaaggatataaaaaacagctaacttattgtcccataagagcttcatcaacatggcaaatccaacagcaggcaacaaccctccagctgcactaagaccattcattagactttgagggatatgttcaacaaaggaatttaccggaccactcccagctaaaattccaatgaaagaaatagatgcaatgattaaataatagatcacccatgtaccaaaatgtagcgtaaggatcattttttggttattttcacgtgcagctttatctaaagctggagcaaagatattcatgaaaacatttttcaaaaacataacgacaaatgcagctaacataccaattggcacagcgagagtcattgctgctttttgttctacattagaaatgatggcgaaagttgtagctaaagttgtggccgttactggctctgctgctatcactccgccaatatttacatttcctaaaaatacggcttccaaagaggctcccatcaaaatacccgttttcatgtcccccattaaaatacctgtaacgagacctactactaatggacgttccatcatactttgtccagtcaaatagttacccgcaaaacagataaatactgctaaagctgccatagttgcgtgcattaacatattttattcctccctactctaatgcatcttctaaacttaattgcggatttgacggcaacacctggttgtaactatttactcgatctaatttagctaattcctttgctgcagctaattcattaggattcaactgcacactaggaaatatcatttttttcgttgatggatcagatttatcaaatctacctgcgttagcaacattgactgtttctatgttttctacattttgagctattttatttgcatcggatacgctatttacaatgacaaaaattcgtttgtcggctcctcttggatcattgaatatattgatagcatcatccaccgaacgaatcaatagtttcattccatttggtacagccatcttcaatgtcatttgcatgacctcattttttgctgcttcatcattagcaaccactaataatggcgcatttaattctttcgtccaaactacagctacttgaccatggattagtcgatcgtccacacgtatttgagttatcattcttttttcctccttattttgtatcaaattactataatagtttcttcttacacttttgatttaaaaaaatgtctcttctgtaggcaaatctgttgatactaaacgaacctggcttatctcaattgcttcgtttatactttgttttgtaaagacttcactttccggtgttaggactaaagataatataattgctaaattactattagaaatgacaaacaattgatcttttttttgttttatcatttctgctaccactgtttgatttacacttccgccaaacagatcggtaaagataattccttgttctccttcttcgatagaatctataaagttagaaatgatgggcgtatagtcttcatttgttaaatatgcattaatgacttcaagttctgctcctttatcagctagaatcgccattgaattttgaaagccgcttgctagtcgcccatgtgttgcaactaaaaatttttttttcatatttttcacctcactttatattaagcaaatactatgccaaaaaataaaagtataagaaagccccattccttgagctttctaatacttttcaaactgtttaaacagtttgatttacttctaaacagatgctaataggtgatagaaagcttgataataaatttgtctaaaccagtacttcgaacctaattaactatacagatgcgttttcgctcatgttaactttcattcaatatatgagagaaagctctattttcataaaaaattttgaggtaaaactactaataaaccaaaatgtaaaaaatcatttttattatcctgaaaaatgaatcttctgattaaaaaaagccacttttctaagtggcttttgaacagaaggtcattatcataatcataggagaatggtttagtgctagcagaataatgataatgagaagagtactatcacaaatactcctgagaatagttttcaaaaggaagatagttgtcaacggtctgtgatagtgacttaatcatgtcacgataatagaaataaaaatagtttgaaaattttactgtttttagaatttttttaaatatttaaataaaaaatattctcttaacggttgttgagacagcttttcataatgatttcgtactatcatttttcttctttatttactttataaacggtctttatttatctgtcttagttacctgctctgaaagtaatcagctttcacttaatttttaaggatatactttaatcatttcgctttcggatattactaaggaaggagaaaaagtgatttttcattaaaaaaaaaactcattacaggtttaaaccaagtttctcagatggataataaattaaattatcattacattccatcatttaaactttatacgtatgtttataagatcataaaacgtatattagagagattgttttactaaataagtttatttcaattagaataaaataaaaaaggaggttgacttatgagaatcatgaaaaaagcaattgctattataatcccccctgttctgagttattttgtcgcttttttaggtttgtttatttccatttatttaaaatccgttttttttgaacaactatttccaaatctgcaaggaaaccaattagttagcttgatacttgatgttttctttttttaatgattagtttcttttttgtagtattaactaagttaatatataaagatatcagaatattaggtttttctaaaaaagatttcttaaaaaagtttatcttagggtatttaattggaggtctcttaattgcttttattgtattcggctatgtattaattggcggagctgatttccaagaagtttttgcgaaatcttcttggtctacattactaataagcatggtgttttatctagctcaaggatcacaagaagaagtaattagccgaggatttgtatttggtgggatcgcgaaaaaaactaatcttttatgaggagttgtagtaagtagtttattttttatgttaatgcatctgagcaatgcaggaggatttacgctagagttgatagattattttttaattggtatggtatggggctttattaagaattctattttctaatacttgggttgcagcagcttctcacggcgcctataacttttttatgtctgacttttttggtttggctaattctactcaagatagcgaaggtatacttttccaaactatctaccatagctcaattgattatatgagcatattcgtttctttatttgttttaatcatactagttatattgatatggcgcaaaagagatatctttaataagccattacaattggagtgaaatattttctcaaaaagcaatctatgaaattaaggttacggatcaatttgataacgttaggaaatgttgatcgaaaaatccaagaagtattatattgcaaaaattctccctctcaatagttaaactaacttttgagagggagaattgtatagattactttttgacaatataaaaaagaatagtgatttttctctaactatgaaatccaaggttacggatcactgaccttttcagtaacaatgtaagtaagataaagatttatactattttaaaacgtaaatgtaatccataattaatttccctttatttgtttctcccataactgttttgctacagggatattgcctaattccgtcatgttagaaggtaatataatggtatttgtttgactagaaactacctctttaaatgcttctattcctaaataagataaggatacctcatcgagttgactattttttatcgcttcatttaagattattattctttttttctctgcttcagtaattttttcaatacgatcagcttctgcctctgcgtcaatacgaatgcgctttgctcttgcttctgcgtcaatttgggtttgttgtgcccttgcttgtgcatcaatggtcattttagatgcattagcttcagcattaagtaccgcagatgatttctcaccttctgcacgagtaatcattgattctttgtctcttgaagctgttatcaatttgttcattgattcaacaatttctttagatacttttatttccccaatattaattcgatcgattgccaaaccatagccagaagtaatatctttaattgaagcaaacaaagaggcattaatttcttcagtaccattcaatacttcatttagctccattttcccgataattccacgcaaattcgattgcgcatcttggatcattgatactacggaattttcattatcataaacaaatgctcgaacatctgtaacgtgatatttgatagcttcgtcgatctcaaccattacattatcttttgtaatagcactttgaggttctatttctaaaggaatctgttttagcgatactctttcgcgcacagtatataatattggaataaggaaatgtaatcctggctccaacgtttttacatacttaccaaaactttctactacttttacttccccttgacgtacaacaactgcagtactagtcaataaccagataagaaaagctacaacaaatactccaacgattattttcacaaccaacattctatataccctcttccgtttacaaataaactattattcactcttgtaagaagcacaccggactgaacatctatgatttctagcatagcatccttttcagggactccttctattacacggtattctgtataagtaccataaacacgaataatacctaaaaattgatcagtaggtgaacgaaagtactttcctatgaccttattttctaaataatctgccatattctcctcctttcctcttattatatattaaatattaaaaaaaaaatcccaaaaaatttaatatggtcaggattagaattaaaaaagttagaaaattagaaagaattgtttaacagagatggtaatagaataatactgcaaagcatttatacattgatgatagcatgaagatttccatacatattcaatgcatggacttcttaaacgctatatacccgttttcctcatccagctcgcccttattttaatttggcgcatcttcaaaattccattttaatataccactgtagatgcctacgttatccgaaggctgtagtttcaaatgcagtttatcagatagatcgacttttgcattcccactatcttgccaaataacttgttccgtagaatttagatgaacttctttcccctcatacgtcgtaaaagataatcggtcattaagtttatcaccttggctattcattaatggggtttcttcagacagtttaatggtccacaagctcttatctaatttactattgtcttctactttaaaaatatttccttcttctagcgaagaaacagtattcatggatggtatttctttcactccaaagttaatatcttcaggaagtgtgagttggggacttggttccgtttgaatcgttcttacttcctcttgagaaacacagccttcttcatcttttaaataaaatgcgacttgttgacccaaccatttttctggtgctttaaaatggaaagtacgattctttactgtttcagccgcttcagaatatttttccaaagttatttcttctttcccacatttagccatcaaataaatcttttcgttagctttatgtgaaaaatcaaacgtaatttctctatctttagtgaagcgagatacgtataagggatcttctttatctagtaattcaaattgtatggacttgcctttcttatacctatgaacaatcgtctgttcatctggtaaataaattcctgtatctttggaactgttttttataggataatatccttttatttcaggataatcttttgaaacatcatacggagtggtgacgattccctctttgactaaaggcgattgtaagatattatctttctcatcaagaaaaggaatgattattttacctttgtaatttacagaacttttccctgattgttctcctagtggttgatcattgagcaatgtctttatgtcgaatggtaatggtaacttttcatctttaatcagaccgatgtctacaggataatccgttcctttccagtttagtttaatatcatatagcaataccgtatcatataaacgtttgtcatttaaattgtttatcactaaagcgacattaccgtttggttcattgcttgttttaaacaagtctgttaaatcatcaccattgagattagttacttttgcttccttaaaagaatattgatgggtcgaataaattttttgtaaattaaaacataactccattgatttatttttttcccatttttctatattaggaatcgtttgctgtgctcttaaataaatgtcctgatttgctttctcaaatgaagaatctactccgtaagctacaggaaactctggttcagctaagaaatctgttctgtactttatcgaagaagtagttgaatcattattatggatgacaaattttacgttagaaattggttttgttgttagttccaaatcttgtctcggatcaactgcccaagctcctcctcctgttgggtttttaaaatatacccaatagtcatctggccctccatcccaaacatcatatagaatattcgtgggattattagcatacagccctttaatcaaagttgcaggagacaaaaaaccgatatatttgttttgatttaagccactataattaaatgcagtttccaatgtcagaggctgattatcctcatctaaaaaatcataggttacaatcatttctccgtaaatataaattcttaaaaaatcatctttggttaaataaatagatcccccatttaagtttcctctatttctttccaaagttattagtaaatttactttttttcctttataaaaccctacattttttactaatgctttacttttattagtgttacgattaacttctataaagcttgtattagctatcccttctattggctctactgaaagatcatcactgtagtgcataataaaagtattatctgctggtgttttagcctggtttgcccagtgaaagtaccctaaatctgttaaaggtcgcggcgctgcttctactctttgagatgtgaaaaacaagaagccactaaaaaatagcaataataatataacctgcttattttttttcatcttgttcacctgctaataaaaatttttttagatagtatagtagtattaggaggcttataccagttatattcataaaccagttttgtttatcatttgttttaggtaacaattggttatattctcttggcgcaatctgatctatcttatcaggtacaactatttttttcataggtactgccttattagtagactgataaaaagtaattcctaccctactagttgtttgatcatcagctgatgcagacactgggattgccgccctaatcagcaatcccaggcaaataattgttaaaatttttttcatttttgtctcctttctacatcttttatacaatcatttttatagaaagttatccaaatcatctattttatatatgaattattcacacattttttaagatcgtttccccacttcacaatcttaaaaaatgattcgaatacttttatggattttttcgtcgtaacttagtaatatatccaattaaactgatgataatgatcaaacaaagaactaaaagaatatagaataaagaatgatccatattttctttatttacttccactgcatctttgttgagcgtttcgtcctctcctttgattacgaattctttatagagtgtccattttttatctgaatcatcttttaactgaatacttaattcataggttccttttttcagtggctcattattcaaattaaaaggaatctgaaattgtgtgcgtggtgcaaaagacactttttggttgaattcatgtaacgcttccttttccccttttttcttgataactgcatgtagatccattttgcttttaagcaccggctcttaattttctaaattggcaaaaagagtcaaatagccattctctaatccgggtttaaccttcgttaaagcaaattctggttccacttttttatctgaacaaactagctttacaccgattgtatatgcaaacttattctttagactaaaaccttcatttttttcttcttttccttttgtatcttcatagcaataaaatcctcctaaaatggttccttcaaaacctttctctgggattttcaattgaaaggtcacatcacgttcctcagaaggcttcaatgtgatcgtctgtgatttagaaattaaatcttggaatacaggttttcccaataacttagcctcatggttagaataatcgattgctccatttttattggtacaagcattattggcttctaccactacttttatttgtttggcagtagtgtttttcaattttagtgataaatcttgcgtagcgccaggtgtcacctttagatcataataacttgcttctgactgctgattacctggtaaaatagcttgtgcatcaaaagataccttgtttgaatctgcgaatatgtttgtagacaaatagaataaagcaaagaatactataccaacaaaaaagaggggaaagcttctcccccacccttttcggacattatgctggagcatcagacaacacccaagtcaaatcagctgtatagctttgtgcttctactccagctcgtggtacatgaagcttcacgttttcattatgcccatcttttccttcaaaaactgcagcaaaagctccggctccctgtccttctttagcaagcatcacgtcttgataaacttcatttaaatcaaatgtttgattggctaatttaggagcttcagaagtattgtctttagttactacttgaccatttgtcaaagacatcttcgctccagttaactctttcccgttttctccaataaatggagaaatggtaactcccaatgtccagccttttgctcctccacgagtatcgtttacttgtacatacggttttttattcaatgcatagtaatccgtatctccctgttggatttcttgttggccaaatgtgatattagatgcaaatggaatcgataaagaaccaacgtctcctgtacttggatcatcatcgtgcgtgtcatctggcacaactggtgtgacatctgttccagatccttccgtcaaagtaacgtctgtcttattagttgtccctgatatcatatctgcagaaaccatacttcccgaagcagttactgctaacaaacctaacgcagcagttgtgatcattgttttcttcattttataattcctcctaaataataatagatataatttgatccaaaataattttgacacgtccagtactttttatctagttcaactattttccaaaataaagaaaaaattagaaagcaaactagatgattcattcaaataagctagctgttcttcataagaaagctagcttttttctttttttaattgataaatcgttttctcgaacaaacgccagtttctttcggtaggtatatttttcattaatagtaatggcgtttttccagtgttgatgtagtaattagaaataaccaaatctacttcagttatatttgtcctgtaatcataaaaagcaaaaacataagaatgcccaaaatacagattaattttattcattaaccataaccgatgcgtatggtgtaaatcatcttgtattaaaatcttaatcggtttaacatttgttaaaaataaatcataataatctaacacataataataatccaaaaataattgtgcccagttttctaatttctttgatacgtccaaatccgcatttgcttgtaattcttttttgagtttttccattatgtgataagttcgaggttcttcttctttcatttcttcgatatacgtacgattaaaaaaaagatctggattaccataaaatagataacttctttcatgaaacgcaataaaattgaatatgagttctggatcctttatatctaaagaaaaacggaacatgctttgtaaaactttctccaaattctcaactgctcgataagaacaagtattttgtcgctgatgtgcatatgcatgactattttcatatattgcatttccatcaattactccaaaagaataaattattcgataaaggaaacacagttcatcgctgttaaaagaaagattaatttgttttgaccacttcttcaaaagattaaaatgcgaatcatctgagataactgatttatattcattatctactcgtacttttctaaatgaacttctttctatattaatggctaaccaaaaagaaaatacacgtttttgaaaaatagttaacgtaatatcataaatcctctcaaaagcaactatatacttctctatttccttttgttcgatatgaaatggccacttatcactactttcacgtgtagaattccaatagaaataataaaaaaagctacgaatgtttgcctctgatgcattcaattctaactgaaatggatgaaatgttatatgataacgcctaaaatatggaattaagagcttcgcatatctgaaaacagtagatacactagtaaattgctctttagcaaaatcttttagaacacttctaggatatttatacataaaatcaatcaaatgataattataggaagctttataaaaatgaagataaatattataaataggaaaatctttctctttttttatgaaaaagcgtttattatcttcatttttcagaaggatattcccattatattgcttaaataaatcctctagttcttctatatagtgtaagactgacttctccgtaacattaagtaaatttctaagttcttccattgcacaccaattgtctttttctaacaaataatctaataaaactacttttttgaaagatgttttagttaaaaaagtttgcatcatttcacctcaataagttacttttgtttattttaatcaaagaataaacttctctcgctcgactataactgttcgaacaaaagaagccttttaataaatataatctcacttacatacataggctagttatttgcttctagcttatgacaagtatataaacggatatcgatttcataattgttttatcttaaacattatagcagtaattgtttttatttttacatgaagaattattataatctagtttaatttttttctgaaatatagaataaaaataaaaacatcttttcattttgagttattaacggagatgtaaatgattaacaatatgtaatttaattttttattcctgcattaagataatttgattgttaattaaaaacaaacgtaaattcgttattttaattcctatttattgtgaacatatccaatttttaacacatagatatttgtataaacattctatgaatgcgcttgtatttaatttagaaagtgttactatctatttaggcaaatttttgctaatattttgttttttcatttaccatctgtagaaatcatttaatgatttctatcttctccttccaacttttttgatgcatcataaattaacagtgcattatccatcttttccatgttaaaagaactaagagtcaagacatcatcttgattcttagttcttttattccttctagaaaataattgttagcaatatagtttatatttttaaatactaaaccagtagcttctagttgctttcctgcttaatagtccatattactcaacgtaaaaaataattgattgtggacattgctcatccactttatatccacaactttctttataataggtatgataatcactctctatcatattaattaactcttttcccccgcaaaattcttcaatatctaaattaataaattcctccaaaagggaaagcttagagtcaatcgaaagcattttaggtaatatagtccaaaaatcattatcatcatttttacgtagtgtataatatgtttgcttttctagatttaatacataattatatgcatcataatctccctttttttcaaaaaaatttttcatatttaaaaatctactcacaaattttttcttgaaattattcattttctcacctctatttattcttttacttgtccacagcataactgttgaatagagtaactaaattcaaaagctattatagtataaaaatacactttttgttgttcaaatttttcatctaatctgtgcagtaattttgaactctatattttttgatatttaatgcttaagcaatcatttaaaaaaggctgtgacacgtcttttgtcacagtcccttctaacattatattactattatttattcactgcatcttcttaagaataaaacatacttgatcgtttgtttctttactaacagccttctttacttggttcctacgatccttaattttatctaagctgattgcttgtaaccataaaacttcgatcagaacatacatcctagtattgtcgtctcgctcatgttctgtataacaaagaggataaatccaaagcgatttctttccaagaagctctcagttaacgacctcgatcatctcttttttaccacgaatattaaaaatttcctcctcttaaacaccgtttatcatatgaagtattttttatttaaattgattcataggaaaaagtaaggttaacacatgtaatcactaccttattgaataactgaagcaatatactttgcataagctgtacgtccactttcattcaaatgggtttcatcatcataaaaaaactcaggatggtttttactttcactataccaatcgatcatcgttatattagaatactgatttggcaatttagctaatgtggcatttatcgtatcttgccagccagtcggagcttttatatttacccagtacacttttttatctttgagcaaagacatggtttgttctatagcatcatctgttaacacaccattggttcctaacccgatcactatttgtcggtaagaaactaaatctttatgctcctttaagatttctggtaacgcagtgatttgtcttgactcttttgcgtctaccaatgcttcttttggaaaagtctctttcagttcctgatacgcccccagcataacagaatctccgataaataatatttttttctcttgtgacaactgattttctcctgcacttgctttactagaattttcttttaataaactttgcaactgattttggtcagcggtcaaccgattggctggagcgcgtaataccagtacagaaactccgattatcattagtgccatagttgtccaaattttgggtgatctcatcttctgcactccttttctaaagaaagtaatcatgagtaacgtacacaaaaacacagtgaataaacttgcgatatctaaatatttcaaatgataatatttgaatagatttgtcagagcaatcaatactggaaaatgcaccaaataaagttcataactgatttttcctacaaaagaaagttttgtactagcgattttggtcttttttgcaatgttcatatcatcaacactggctaacaatagagcaaaacaaatactgatcagtagttcatttagtgtataaggaaaaatcgggaacagaatcagacaaagactagctagtaataaaagccagattttactaaaagtgttttgttcaaagaaacggccaatagttattcgattaaaatacccccaaactcctaataaaaatggaaaaagtttagccaccgtatgataatatgccttagctgaaggtaaaaacaaactaaaaagaatagaaacaaaaatcaatgtatagattaagtaaaacacttgttttctcctcatacgtttaatgacaataaacaaaaatggccaaatcaaataaaattgtagctcaacggaaagcgaccaataatgtttaaataaagaagcgttaaagtaagagtcgaaataagatacgccttgattcagctgccaccaattgttatagccaaaaatcaaactaggtagctcactacgaatatttcctatcaatcgaatgttgctgatccccagtatgaaaatggatacgaccaaagaaaacagtaaaaatggataaatacgtttgatacgcttatagtaaaaatgtagaaaactgaattgtctgtttttttcatctcttatcgtatttttagccattaaaaaaccagaaaccacaaaaaagatcgttactccttgcaatccgcctggtagcttactatttggcaaatgataaaatatcactgctaaaacagctatgcctctaaaacaatcgatttcctttgaatatatttttttcatgtatcatcaacttccttctcttcatggcattttttaatcaaacatattcttccgtatctattttttcatttttctattcatttcaccttgttttgtaaattaacagttaaaagtatctaaaatgtatcttttccctatcaatactcgttgaacacaaaaaacatgaacataaaatatccgattaattatttgtgcgacaaaaaaaggtggtgacaaagatatgtcaccacctcagactgtagacaaagaaaaaaatttctttgttctacagtttttttgtttattctcacttacctagcaccacgtataacatactatagcaatcatcatcccgcttctttgtcttttgaaatactacgttatttctttttattaacgaaaaataagagcactaaacagaccaaaatagttatgaccctcaacgcgggagtaaacagcaaggctatcattaaattagcaagttctctgacgattgaggaatttgattcatataatgcgaataaagattctgcaaataaattcacatgtctataaacaaattctgtaaataaatatgcagataaccctaaaccaattatggtgatatttttttagattttgacattttttctctcctatcataatttatttatttccttttttataaaaaatatagattgttttaaagtaataatatactataatttcaagaaaatttacaggaaatttgataactgatattatttactttttgaccaccatatacataacttttatttttgtttcttttttagaatccaatgtgattaaataaaaatttttacaataatatgcacatataaataataagatgatataatcaacaagaaaaatgtgaattttttcactatattttatcacatgaaaattcattaagaaagtaggcgtcgaagtatcatgcacacaccagaagaaattatggaaatcagtattcatcttggagcaaaaaaaatacagaaacctatcttagcaaaactgattttagggtttatcggaggagccatgatttctctaggttatttggcatacgtacgggtctctgcttctatcccagaatctatggctagcttgactagtttagttggtgcctcggttttccctatcggtctgctggtcatccttcttggcggtggtgaattgatcaccggaaatatgatggctgtggcgattgcctttatggataaaaaagtcacattctcacagctagttaagaattggtcagtgattacttttgcaaatattattggggcaattttcgtagcctacttctttggacattttgttggtttaactcattcaggtgtctatctcgaccaagtgatccatattgctgatcataaaatcgctgtttcttggtggcaagcattagggtctggaataggttgtaattggtttgttggtttagcattatggttatcatatggggcaaaagatgcggccggcaaagtattaacgatttggtttccagtcatgatttttgtggcaatcggtttccaacatagtgtggccaactgttttgtgatacctgctgccatatttgaaggtcaagcgacttggttagaatttctctcgaattttatccctgtttatattggaaatatcattggcggagctatttttgtttcaggtttttattacgttagttataaacatcattgaaagagcgtgggacaaaagtaaagaacacttttgtttcacgctctaaacacgtataaacggcggaagcagaagcaactccttcggaaataagctgaaattcacaaaaatttgaaaagcaattttcatgaattccttcttatttcttggagttaaacgcttctgtcccagcctctctttttatatactatttatattttaagaacaatagctttttattatatgtattattcaaattagttatatcgagtgaaaaaaacttttaaattgattctttttatttatcataaagatatagatacataatcattttcgcttacatatatttgaatatgaactaaaaacagcaagaaagaagatgatcaaatgtattatgtagaaataaaaacaaaaggtgtcaaaaacaaacaatatgtgaaaggtatcagtaacgaatatcctttacttggttcatggaaagaagcagctcctttttccaaaccatgtgccataaaaataaagagcgagctggaaaaagaactgacttgcggcaaagcggttgtaaccatcatcgaaaagtaacagtgcaaaaactaatgaatgacttatttcaacactttaagccgtatagaaaggaagcaaaatatggattatactgttgagtttgacagtgaactattggaacaatttccgcaagaggtacatctcgcatacaaaaaaactatttctaaaaaagtcatagagcatgtagaccataatttttttcgtataaaaccagtacgaacacgctcggcaaagggaatatatgaaatgaaagtcaatattgataaaaaaattatcgtatagcatttacttttaaaaaaaatcatgtattcattttttatattagtccaaatgtacaaaaaatagtatttgataaagaagtgaataaaaaaataaaataaacgaggaatggaggatagattgagtgatacttgaatctatcctccaatttttttctttttacgttatatatagtatttgccattaccaaaaagtccctcttatcttctagtatcctttatataagaaacagcatccatttcttttacttgaacaaaccctactgattcataaaatttttttgttttctcagtatcatctgtcaataattcgatttggactggtccataactggtgatcttctccaaaacttcattcaaaagtgctttgcctattccttggcgctgatacctcggatgaatgaggatatcttgaataaatgcgatcgtcgcacaatcagtgatccaacgaacgactccgataatcttcccttctccattacgctttatcagagattcagattgttcaaatgccttctctaaccttgcagtgtcttttgtgtaatgcgtccaaccaacgctcttatataattcagaaatctcatcaatcataagggaatcaacattcatttttttcttcctttcttatacaattctccctctaataatacaattctttgattatttaatctatcacatataactctcctgtaaagattctctcgattccttaaaattcctctttccttttagaatgcaccctttttgataaataaaaaaggttgtgataaattttcttcacaacctctgtttctctctatcaagtattatcttttaattttctacccttaccctagcatctctattgcccatagtatgcatgctttccgtgttttcgaaaataatgtttatctagcaaatattgtgggatttcacatatatttgggttaatcaacttgttttctttagccatcaaacaaatttcatctaaaatcaggctattttctactgcttctataggtgagcgcccccaagtgaatggtctatgtccatagacaagtactccagggacttcgtttggctctaattttctttccttaaatgtctcgacaatcacattccctgtatgaacttcgtaagcttcttttacttcttctttcgtcaattggcgtgtacaaggaatctttccataaaaagcatcagcatgggtcgtgccataagctggcaaatctctgcctgcttgcgcccacatgacagagtgagtagaatgagtatgagtaacagcagttacatcttcaaaagctttgtataaaacaacatgggtaggcagatctgaagatggttttaagctgtcttcttctattatatttcctgacaaatctgttacaaccatttgatctgcttgcatgcgttcatatcggacaccgcttggcttaataacgatgactcctagctcacggtccacttcactcacattgccccaagtcaatttgactaatctgtattgcggcaatgccagatttgcttcaaagacacgttgcttcattgctgcaattttttcttcacaagacatcatagccagcctccttcaatttagaacttaagtagtcttttgcctgctggatttctcttcgaaaatcttgacttttttcactccacatttcgatcaggaatgttccatcataatctagacgtttcaaatgtctcaataatccaagaaagtcaacgcatccgttaccaaaaggaacatctcgaaactgtcctgaatattcttttgttacaggatacgtgtcttttaagtggatagcagtgatataatcgatccctttctcaagttctcgagccggattattttccggccatgcggacaaattgcctaggtctggatatacttgtagaaaaggggaacgaatctgttctttgatttctaaaaattttgaaatggagttcataaatgggtcatccatgatttccacggaaagaatgatgccatatttagaggcttcctttacactttcttttattccttcgataaagtcttctctggaattcattgatttctcttcataataaacgtcatatccagctatttggattactttgacgcttagattatgcgccaaatggattgcttttttcattagttgtttcgctgcttttttcttttctggatcagcagaaccaaacggaaatcgccgatgcgcacttaaacaaatcgaatggatacgtactccagagctaaacatctcttctctcagctcagctatctttttttcagaccaatctaatcgtgctaaccgctcatccgtctcatcaatcgacatctcgataaaatcgaagtccatttcttttacaagggaaaaacgttctttccatgaaatatctttgggtaatgctttttcataaatcccaatttgagccatttccttacccccagatacgaatgatctcatctttgaaacattgtgcagccttcattggatcttctgctgctgtaatcccccgacccgcgataaaggtatacacgttgattccttcaaacaattgtaatgtgtttggatttaatccaccagttacagaaacattgaagcctagttcaatcagtttgctgaccttcgacaaatctttttcaccccaagcttcaccagataagagcgcatcacggctttggtggtagattacctgtcggattccgatgttataccaatccttggcttgctcaaaagtccaattgccatagagttctacttgtaattcgcctatctctttttgtgctgccttcatcgttggcattgttgcacagcaaatgactgtcatccaatctgctcctgcagtagcaacatttcttgctactgttcctccagcatctgcacattttgtatcagcgaccagttttttttctggaaatatactgtgaatacagcgaatcgctttttgtccttcctgtaagcaaaggatcgttcccacttcaataatgtctactacatcaccgactttcataacatcgcctaatgcatgttctaaattattatgatctaacgcaatttgcagattcggcctgctcatcttggttccttctttcacttgtttttttgataccatgttgtttcagcaaatttttcactgatttctttggcggacatcacattttttataccaataactgtaacgccttttttctctgcctgagtaaacatattcaaaaaattgactggtgtaaaaacgacatcatattgactcgctgagcttttcccctctgaaatagcacaatgatgaatcttggtaattggtatatttagttctttcattgctttttctacacttctcatcatcatcaagctggttcctgatccatttgcacacgatactaaaattctcatcctaatccctccattatgagtgttgtctaatcagatttcttttatgctttctgcttttctgcatatttttcataatcttctacaatcaagaaatacccttcaggatttttccgatattgtaactgcggaatagccaatagaccaatgacgactacggcgattccagcataacctaggactttcatgactactgtaaataatggccaagctgtcgcccaatcgaacatcccgatataaccaccgtatgttgacatcccgatccatgtagcgaataatgctgaaccgcctacttgtatgattccagaaagaaacgggaatagacaggcagctttgaatccacctcggttattggcataaactgctatgacagcattatcaaagaacaacggaatgaaaccggctatgacgatcgttggcgatttcaataaaatcagtaaaccaatcatcaaaaattgacccaaagcaccgaacaaaaatccaatcgttaccgcatttggcgaaccaaagccaaaagtagcggctacatcgattcctggaacagctcctggtaaaatcgtgtttgagattccttgaaaagattgagttagttcatcgacgaaagtccgaacccctaattgcaagattgccagatataccgcaaaattcaaggaagtcgtcataatgtagaataagaaactctgcccctctttcatgaattgtgcttgaatcaaataatctttgcctagtacaagcagaatgatcccaaagaaaaatagcatgagcaacgaagtagcaaccatattctcattaaatatcgacaggaatcctggtaattggatatcttcgattttcttgtcttgcttgatcgatttttcttttcatcccgctttttcatccattcagctagtttagcaaaaataaagattccgaacatttgctgatgtgccaccgcaaatccggcaccttctgtcaattcctgcgtgatccctactgttaagttagaagctactgcccaataacaccctaaaatcaatcccataaatatcaatacttgtatcctgcctagatcaggaaaacaaaacaataaaatccaaaaagcggtagctgcttgctggacctgaacatttccggtcgtgaaaacggatcgcagtttcgtatatttctgaaaacggactaataaaatatttaaaacaaatgcaatcagtaatagaatcatcacatctccaaaggtacggccaaatgtctccattaatccagcatccacagcattttgtccaaaataaggatctgtaaccatagcatccaaattaaaccgttcttttagtccaaccaagattggtcgaaaattgttgaccaaaccaccagagccaacagtcaaaataaagtagccaaccgttgcctttaagaatccagcgatacattcatgaagcgggcgtttcagcaaaatatagcctaataacacgataaaaccaatcaggtacgctggctgcgtcaagatatttgttgcaaaatacgtccaaatgcttaacaaaaattcccccatcttttttctcctctatcaattaattatattccgccatcacaacttggtaatcatcgatggagttcgtagagatgagacgctcaaccaatccatctgtcattaataattcggataatttttggatattttctaggtgttcttttggatcttttgctgcgagtgtaaaaaacaaactggccgttttctcctcattctcatcttcgctttcaaaacggactggctgcttcaacttggtaaatgaaatagccgttccaaaaactccctcgcttttttctgaagaatgtggcatggctacttgaggtgcaatcacaatataaggtccatatttttctacacaatgaatgatttcttcaacatacgtttgatcaatgattttcttatcaatcaatacacgacagctttcggcgatagcttcacgccaattcgtgatttctttatctgggtaatgaatcaattgatagtcaaaaaagtatttcagcaagaaacttcccttctttcttataaaaacgacggaaacggtgtatcattttcaatcgagaagacatcttcaaatccgcgataaaaattaaactcaagatcatctttgtttgtcggatagatgaatttcccgcctacttgccagatataaggtttaaacccataatacaagcgatcctttttgaatttccaaatttcagtaatctctttaggatcagccataaaattagaccaaatatcgtagtggacaggaatcactacttttgcattcaatgcctccgccatgcgcagcatatcaacagaagtaactttgtctgttatccctcgtgggttttcaccgtaggctcctaaacagacatcgattttgtggtcattgccatgtttggcaaataaattggaataatgtgaatctcctgcgtgataaagattacctcctgatgtttcaaataaataatttactgctatttgatccatctcctgaggcatttttcctttcaatacttcttccggatcttcacaagtaaccaacgctgtccgatcaaacgcttctaaagctactacattgatatctttgattttgaccgcatcacctggtttcacgataatcgttttttcttcagggatcccccatttttgccacgtgtgaaccacttcttttggtccaatgaatattgcttcaggacaattttgatgcacggctgcagctgtgtgaatatctagatgatcggaatggatgtgtgtgacgattaaagcgtctacattttttatttcaaaaggatcgattacgaaaggctgagtccgtaagttaggctgcatattttgaacaccgctcatacgcatcatctgatgcccttttttcatcatgccatttccatgactgcgttttcccgttccacaccataaatcacataagatattcgttccttcatgacttttcagccaaattcccgtacagcctagccaccacatagcaaaagttccaggttccactatttctgattcgatttcctcgttcaaatacgtaccccattctggaaatgtttctaatatccacttttcttttgtcacttcatttaccgttttgctcatttacttgttccccccatatcattcttacgacttacaagtaaatcttaatgcgtaaccgcatgcgtgaaaacccttttatatgactgtttgtcttttatatgattttcttttaaatattaatgattgtttcagtataataaagacagatatgaatatttaaatgaacaactaatcaaataaatccatggatcaagatgtccttcaggaggcaacagtcatgaaaaactcacttgtcaatattgaaaaacggcaaaaagatattttggaactacttcagcaaaccgaacaattgtcaacttttcaattagctgaatctctggatgtatctattagtacgatacgcagagatttaaatttattagaagaaaaaaacgagatcatccgcaattacggttattgttcttataattacaaaaaccagactgattttgatcaatctggtcctgaaaggattaaacaagcgattgccagagaagctagtaaatacattagcgattatgatacattgtttattaattctagctcgactgcattgaaaacactggattttcttcaatctaaccatttgacagtcgttacaaacaacgtaaaaatcaactattctcctcacaaagataattgcagttatattttaactggcggagagatgcgctttccaaaagaagcactggtgggcgatatcgcattaaatacgatttcttcaatcaatgcagacatttgtatcattggttgcagcggagtcgatgtcgcacatggggtcacaacgaaaatattgaatgaatcaacaatcaacgaaatgatgatcaaccagacaatcaaatgtaagattctagttgctgatcatcgaaaaatcggactgacatcaaaattcaagattgctgatatttcagtctttgattatttgatcactgataaattttgctctgaaaaagtattagacaaaatcaagaatatggggacaaaaatcatccaagtagattcattttaagaattatgttggtttgcgtaaaaaactctactacattcaaaattaccatttgaacatagcagagacttcttaaaacgataaaatggatgaacaatcaaaatttgatttaatcatccattttactaactattttctccacatccaaagttccgtattcttccttagatattacgaaaacaggtatttcagggaactgactttctattttatcttttgcatatccaagtaaaggagtgagcaataagatgtctgctctctttgcttctttgtctatttggctagaatcatatactttgactgacacatttttttgctctttttgaaagaaatgtgtcaattttctttctaaacgttgcgtttgcaaaagtccaacagaagaaatcaaactgaatgtcatatcgaaaagaaagattttctttggactttgttcagcaatcttgggcttgttaagattcattggttatcttcctctcttttgtctttagatcatcccagtattttaactaacttttattatatatacatttttatgaaagcgctatataataagttagattattatctaaactcaacagagatatttgtttacgaatactatttttgttagatattgaaaggagtaccgtccatgttaagcaatagtttgattgctttactagaaaagaagcgttcctcgttaagtaaaatcgaaaatgaaatattggattatatattcctccatttgtccgatattggaacaaaaacgatttatgaagtatctgatgatttatttgtctcaactgctactatctcccgaacggctaaacatttaggctatcaaggttttaaagagttgaaatacgccatcgatcaatccatccatgtagaggaacaggaaggaaatagccgaagctttcaaacaatcacgaaccaaatcacttcaaatgtcacagagacgttccatcaaatgagcgaagaaaaggccaaacaaatgatgacattgatctatcaatcgaatactatcgaagtttttggattaggaggaagcttccctatttgtacagattttgctcgaaaactgacttttttaggaaaaaaagcatttgctcgttcagattgggatgaacaagaagcagctgtaagtaatttgaaacaggaagacttagccattttcgtcagtttcacaggagaaacaaaaggtatcctctcctatgcccagattgctaaaagacaacaagtccctatcatcagcattatttcaaccaagggaagtaacttggaaaaattatcgacgatttccttatatgcaaagggaacgactcgctatcaccacagtgtcgatttaagttcaagaatttctgtgatttgtttatttgatacagtactcttgatgtatgcagaccaaatgaaaaacaattagctataatttgttgctatttctagtgaaacatcttactcaatcatgtatgaggatacagaatatctgtctcctcttttttatttcctttagttagctataataaacctatcaatgaaaacgcaatcatttttttaaaaatcttaaaactactaagagatggaggaagaaaaatgaatacaaagaaaaagaaatcaaccttttgggagttctttcaagggttgggaaagacttttatgttgccggttgctttgttggctttcatgggtattcttttagggttaggtagttcattttccagtgaatcaatgattcagactttaccgtttttaggatatccagcagttaaagcagtgttccaattcatgtctgctattggcggttttgcctttacctacttgccagtcatgtttgccatggccattccattaggattagttcgtaaggaaaaaggtgtggccgctttctctggattcgtcggttacactgtcatgaatttagccatcaacttttacttagtcctgacaaatcgtttagttgatgccgaccacttgcgagaagctggacaaggaatggtttttggtatccagacgatcgaaatgggtgttcttggagggatcattgctggaatcatcgtttataagttgcataacaggttttatactgttcagttaccagatagtttcgccttcttctcaggggctcgttttgtaccgattatcacttctctagttttagggtttgttggtttgatcatccccttgatttggcctttattcgctatggtcattatggctatcggccagctaatccaacgttcaggaatatttggtcccttcttattcggttcaggggaacgactgcttcttccattcgggcttcaccatattctagtttcgatgatacgctttactgaagctggtggttcggcgatcattgatgggaaagaagtatttggtgcactgaatatcttttatgcagaattgcaaaacaatttgcctatttcgccaagtgcaactgcctttttatcacagggaaaaatgcctacatttatttttggactgcctgcagcagcattagctatgtatcgtaccgctgcaccacaaaatcgacataaaatcaaaggattgttgatttcaggtgtgattgcgacagctgtgaccggaatcacagaaccaatcgaatttttatttttattcattagtccgctattatggctcttccatgtcgtcatgactggtctaggttttatggtcatggcattattaggtgtcgtaatcgggaatacagatggtggaatcttagattttgtgatttttggtctactccaaggtaatgacacaaaatggtggtgggtattaataatcggtgctttgtggttcggtatttactatattgtcttcaaaacagtaatcataaaattggatttaaaaacacctgggcgtgacaagacagtggatgaaacagaatataccgatcaagaagtgaactttcataaaacaggcggatacgatgcaaaaggaattttagcagcacttggtggtcaagaaaacatccaatctttagataattgtattacacgtttacgtttagttttagcagatgcagatatcgtagatgatgaaaagttaaaacaactaggagcattaggtgtggtccatctcgatcatcaaaacgtccaagtgattatcggaacgaaagtcacaactgttcgcaatcagcttgatacgattttaggataaaaagatagaaggtgaaatttgtggcatttgataccgctataaatagaaaaggaacgtactgtacacagtgggactacgttgaagaccgatttggcgaagctgatttactcccttttacgatttctgatacagattttatggtccccgaagaagtacttgatactttgaaagaaagaatgaaccacccagtatttggctatacccgctggaatcatcatgaattaaaagaagcaattaaacagtggtatcaatcccgttttgacacactactggaagaagaatggatcatgtacactccaacagttatctatgcagtatctacccttattcaaatgcttactaaaaaaggggaaggagtggttttacaaacgccagcttatgatgctttttttaaagtcatccaagacaatgaccgacttctagtcgataatcctttgatctatgaagaaaatcagtaccggatcgattttacggatttagaagagaaattagccaggccagaaaacaaagtactacttctctgctctccccacaatccaaccggtagagtatggaaacaatgggaattagaaaaaatcgtggcattgtgccgtcagtattctatatttttattatctgatgagatacacatggacattttaggacgaggacaaacgcatatacctatcacacgcttcaattatgaacaagtggcgattgtcaccagcggtacaaaaacatttaacttccctggattgacatttgcctatacgttgataccgaatcttgggttacgtgagcattttcaaaggaagttaaaaaatgcggatgggttatcttctaccaatattttcggtatgttagcgacaatgagtgcctatcggtattgcagtcattgggtagatgaactgaatcattatcttgaaagcaatcagcggtatgtaaaagcatttatccaggaaaaactgccagatgtaaaagtcgtcgatcttgaagcaacctatttgatgtggctggatatatccaaagctgtatcagatatccctcttttaagagagaagctgatttctataggcaaagtagcgattatggatggatcgatttacggcggaaatggtcatcaatttttacgattgaatatcggctgtccgaaatcgaaattagtagatggactagatcgtatgttgaaaagttttgaagcaactgctgaaatcgaaattaaaccataataaaggagatgtgacaaaaatttttgtcacatctccttttttcgaatatacgatgttcttaaagttgaacacttctgtcaagatctctttatttaaggtcgttttcgatcactttcaccgcgtgatcattcccgttgaaacatgctacttttttggcatccatatatctttctaaataatcgtcttctcctagttgcttatggcaaaaagcaatttcataaagcaagtattccaatgcctgggttgatttatgtttcttattgtacccaatccccttctcgcacaactggattgctttttcatagttctcgattttgctgtaataggtggcgatattataatatacgatacagaccatcagattatcaaaatcagtatcattcaagattttaagcgtacgttccacatacacttttgcaaagtctagttctccttttgccaagtagatcattgccacatttgcagctgcttgtaagtgatggatatctgtttcggtcgtttgttccaacacttgattgaaataaaacaatgctgcatcttctttttttgcataaagatgatcaagcagtccttgataaaacaagatttggtttaaaagatcagaattgcttacttttttctgatcaatcgtttgtaaaatttcataagattctttgtacttcgatacagcattcaacgattgaatctcacttaatttttttctgatcttgtcttcttctgtttccactaatatatcggagatctcgacattcaactttttgcaaagcgcacttaggatgttgatacctggtgacatattcttgttttcgatattgctgacagttgcctgttcgcaaataccttctgctaattgtacttgtgttaacccctttttctttcggtattctttcagtaatgctccatctacttttatcaaaacaatttccttccctttaaaaaattatttctcctttatatcatacacaaaaaaaagttctaaacaaccataattgtttagaacagaataaaaattttaatttttaccaccaattatttcttgataaaaaatcaactgtctacctgcagatcaatctcctgaagtattttctctatcatttcttgttgacttaattcggcagtcagtatcttctcattaggcaatccaagtatatcatgctccaaccaccaatccgccatttgttctgcaccaaattcttttgacatctttctctggctgtgacgtctcagcgtttcttcaaaagaaagatcgtaataataagcaaatacatttccttgaaagctctcatacaggtccataagcatcgctttgtagatttttgcactcatgatcccctcgataaggactaaatcaaatctgtcttttccaaattctgccaactgacggatcaaatctggtgtaggatttcctactttatctttgacattcaacatttctcttctcacttcatcttgagagattcgcatcaccttccccataggaaaatgattttgaatagctttagctgtcgttgttttcccacttgctgaatttcctcttaatatgactagcttccccataacactgcatctccttgtataccaataatcattcatccaacatcattaatccttctgttgattgaaaataaaaagagaatctgtttgtataaaaatcattctgttctgtggtaagcatatggaatgagatccgtaattttgatttttttagccccctcttctgttgagacaatgatttcacaagcaggtgcatactccaatataaactgtcggcaattcccacatggagaatagatcatgtcaaaatgatctccacccacagctacgatacactcaaaatcacgttcaccacgactgattgctgtccctaacgcaatgatttctgcacatgccccatgattcgaataaacattcacaccagtatacacattaccatttgtgcaacgtactgcagctcctactgtatgattgaaagacaccaaatcaatatttgatttaatgacttcggttgcagcatccactaattctaaatccattgttgataaatcgctcatttttatctccttttttctgccaaatcggttaaagtaatcataatctttatataaaaaaacatcaatggcagaacggaaagaaaagaaacgactcagttaatatgtggactattgttcttggtacaacggtaaaaaagcaagcttgcatttacaagcctgcttttggaacatttaaagcttcgatcaaagcttcgatgtgacaaaccacctatgctgctcgatcataaaattgatagcaaaaattccacaaagtatatatgtgccccatgataataaaacattcatctgcggtaaaatgatctttggaagaatcacaatcaaaaatgatgccagagcccaaacccaacgattgatgtgaacgtgacgcatagccagcatattcaacataagttggcttatcgttaataaaaagataaaaacaaaaaataaaatcagccaatacattgttttccacctctgaaatcagacttaagcagtttgtatttcgttatctccattattattttgttcatctgacaacatctttttatcataagcttttacaaatggataatagatgataaatgctatcagtgtattgatcacaatcaaaacaaccacacgccagtcatttcctgctgaaaggtagccgccgattggtgctggtaatgtccatgttggcaatacagtaaatccattgaccatttctaatttgactgcaaaatagctgacaatagtcaaaactaaaggaactaagttgaatggaatgaacatgtaaggattcaacatcataggagctccaaaaatcatcggctcattgatattgaagataccaggaataatggaaaaacgaccaacttcttttaagaattttgatttacaaaagaataaaaacaaaactgataccacaatcgtggctcctgcaccgccaatcgtaactgtccattgataaaactgttcaggagcgatataaggcaatttggtagcagctgtaccatctgctaacgccttcgcattctcatccaacataatcagccacattggacgaacaacagctcctacgatactcatgccatggatcccaaatgaccacaacaaatggatcaaaaacatcggtaataaaacaccaagcagattattccctaaaatattggttaagggctcgaataacgacaataaggcagcgttaacatcgaaacccgcgacgcttcgaatcaaccaagtcgttgttaaaatcactgcaccaggaatcaatgcctcaaaactacgggccacagcaggtggtacttgttctggcattttgatagtaatattacgctttttaaagaaacgatacacttccactgcaaaaatcatggataggatcccggcaaacatcccagatgctcctaaagaactcatcggtaagacccagccaagaggtgcctcttcaggtgttaaaacgtttacaggaacttgtaacataaagaacgtccctagtgataatataccacccgtcacactatccaacccatatgatttagctagatccgaacccataacaaaagttgcgtaaatagccattaatcccatcgtaatcctgaaaggtaaaacgattgttgccgaataaggggcaataaattcattccacccaggaaacggtaaattgatgaaaaccataaaaaatgtaccaatcaaaatcaatgacagtgttgaaacaaccccattacgaattgccaacaaatgtcgctgtgtaccaatttttgccattggtgggacaagtttttcctcaacccatttcatcagcttttccactaaaaccactccttttcaataaaatagagaccattcactgcataatgaagcaaagaatgttcataattaattatataattatgaaattttatttcaatatattttagtagaaaatattattattttttaatacaggttcttttttatatacaaaaaaatttttcaaacctaataaactttactgttcctatactgatctatgggtttataaaatagtatttaaataaaataaaaaaccttgaaatttaatttcaaggtttttcgtaataccggcggccggggtcgaaccggcatgtcctcaacggacactggattttgagtccagcgcgtctgccaattccgccacgccggcaaattaaaagaataactggggtagctggattcgaaccaacgcatgagggagtcaaagtcccttgccttaccgcttggctataccccaagaataaagggcgaatgatgggaatcgaacccacgaatgccggagccacaatccggtgcgttaaccacttcgccacattcgccatcataaaagatgttatttaatttctcaataaaaaactaagatgaagacatcttagtcaataccggcggccggggtcgaaccggcacgccctcaacgggcactggattttgagtccagcgcgtctgccaattccgccacgccggcaagttgatttattagtactaaggcggtaaccggatttgaaccggtgatgaaggttttgcagacctctgccttaccacttggctataccgccattatactattatcaatctataaaataaagaatatattatagaaactggggtagctggattcgaaccaacgcatgagggagtcaaagtcccttgccttaccgcttggctataccccaagaataaaaaaggcgaatgatgggaatcgaacccacgaatgccggagccacaatccggtgcgttaaccacttcgccacattcgccatggcaggggcagcaggaattgaacccacactaacggttttggagaccgctgttctacctttaaactatgcccctataaaatggaggagagtggattcgaaccactgaaccctaaggaacggatttacagtccgtcgcgtttagccacttcgctactcctccatggtggcgcgggacagaatcgaactgccgacacacggagcttcaatccgttgctctaccaactgagctaccgcgccatattttaaaattattaattgaataacaagaacgacggttccgacgggaatcgaacccgcgatctcctgcgtgacaggcaggcatgttaacccctacaccacggaaccagttcattatggaggttaacgggatcgaaccgctgaccctctgcttgtaaggcagatgctctcccagctgagctaaacctccaacattcaattaaatgacccgtacgggattcgaacccgtgttaccgccgtgaaagggcggtgtcttaaccgcttgaccaacgggccaggtaaacttgttacggagagtaagggattcgaacccttgagacagtttgcaccatctacatgatttccaatcatgctccttcggcctctcggacaactctcccgagtgaaagaagctcaatactctttctcaaaatgagatcagagtgacaagtgattgtcaactcttttttaaaagtttttttcgatttcgttttttgaaatctttcagcaactcgtttatcataacttgtcgtttgttatttgtcaagaacttttttgaagtttttttcgatagaatcaagcttcgcaagctgttcttttttaacgactcagttatcttatcatgtcatcataaacatgtcaataactattttttaagttttttcagaaacgtgatataacgtccacttcggaatcaacgctgttaaatttatcatgtatttcttccttggtcaactataaattaagcattactttgtgaaatgatttttcgatcaattattattattcgttatacaaccgttttctacatattttgaaaacaaaatgcactaaaaaattatctatagcagaacatttcattgtcttttttggatcaaacaataaaaaaaagaagtttgaaaaaaattcaaacttctttgctcgcttaatctgtattttagaagaaaggcactccctctacttcgtaagttccaagaacagagcgcatttgacctggttcttcccaaatatatccttcgcctaattcttctctttgattcttttgttcagtctcaaagacaaacaacggaacattttcctgattaatatgtgtatttgtcaattccatcaaactaatcttgctaacatcgatatgaactatttcttttaagaaattaagtatattcgctaaaccagtcttcccttcagaaagttccgctaacgcaaattccaacttgtcatcaattgaatggaccaaaaattttttagaaccatcctccaaatgcaacataattgtaccagcaactcttttgcttgccaaaatttccacctcgatcaccttgttctatggcttacataaaaattctagcacattttcagaaaaaatacacactttttatttcttattttctttccgttctaattcagataacgcttcttctatccaaataggtaactgctccgcaatagtggcaaaaccgattttacgatttttattcgtgaaatatctttttctacgataaggaacagctggatttgttttttctaatgttcttaaagataaactgatttttttggaatattcatcaatgtcgatgatctgaacggttactggctgcccgacttttaacaatgaatggatatttttcgtataaccggattgtacttccgaaacatgaataagtccttgcgtctcattatcaagagagacgaatgccccataaggctgtatccctgttacttttccttcaattatttgtccaattttataagtcatctacttccctctcttcgcatttatcattatactgtaaatagcgcaaaaaaagaagcgacgaaaatgactggaggtattgagatgatcgaatttgataaaaagatttcaagaaaagatacagaaagtgtaaaatgggacgcgattgccgagacatatcaaatggatgatttacttcctttgtgggtagcagatatggatttcttatctcccgagggggtagctaatgcgtttagtgaatacatcaaacacggaatctttggttatgccactctatctgataaactctatcaggctatcattcattgggaacgtcaacgccatgctgttgagttgacgaaagaaaatattgtttttacaagtggtgtgttgactagtttagctgcagcagtacaaacttttacaaaaccaggcgattctattttgattcatgacccagtttatcctccattttcctctattatagaaacaaatcaacgtcacattgttcgaagctctttgctagaaaaaaataatcattttgtcatggacttttctaacatggagaaaaaaatagaagaaaacaatgtaaaagcaatgatcttgtgcaaccctcataatccaggaggtcgcgtttggagcaaagaagaattgaaacagttaagcgaattgtgtttaaaacatcgagtgtttctgtttagtgacgaaatccatcaagatttgactttattcgatcatacatttacttccatgctgacgattaatcccgatttggacgatttgctcattgcctttacttctgcaacaaagactttcaatttagctgcaatcaaaaattcaatggtatttatcaaaaatccagagctgaaagctaaatttgaaaaacatctagtgatgaatcaacagcacgaaatcaacacttttggtttgattgggactcaagcggcttatgagaccggtggagaatggttaaaccaattgattccttatctagaaaaaaatgttcaaacagttaatcagttttttgaacagcatcttccgaaagtgagaataatgagccctgaaggaacttatttaatgtggttggattttaccgcttatatttcagacgaccagaaattagagaatactctagtgagaaaaggaaaagtcgtattaaatcctggtatcacatttggtccttccggtcatggacatatgcgcttgaatattgcttgtccagaagaaactttactagaaggacttcatcgaatcaagcacgctttagaaacaaccgaataaatcagttatcaaagtaaaaggacgagaccttactaggtttcgtccttttctataaatactccgtatcataccaaactattctgaaatttcgattgtttcaatcactatgtcatgtacagggcggtcttgcggaccacgttgcacatttgcaatttcatctactgtatccattccttccagtacatgtccaaagactgtatgtcggaaatctaaccaaggggttccgccacctttatacgcttcaatgatttctgatgggaatccagcaccttccaattgtccaagcatattagctggcacatttgtgttatttacaataaagaattggcttccgtttgtgtttggacctgaatttgccatagataaagctccgcgaaggttgaacagttcacgactgaattcatcttcaaaactttctccataaatactttctccacccattcctgttccagttggatcgccgccttgaatcatgaaatcaggaataacacggtgaaaaatcacgccatcataataaccttttttggaaagttcaatgaaattttgaaccgtcttcggtgctagttcagggaataattggacagtaatgtcaccacggtttgttttgataacagcttttggtcctttttcactttttaaatctagttgtgggaatcccatattgtttcctcctattatttgcatacttcataaataataataacataatacctaaccttccgtaaaaatactagatttgtttttctttattttttcatcactgcctgcattccatgaataaattctatgactgaccatttcaacttcaaatatttttgagaagcattctcaattaaattctgctatagtgtgaaaagggaggaattttttatggaaatctatgacattacaattatcggtgcaggtcctgtagggatgtttgccgctttttatgcaggaatgcgccaagctaaaacaaaaatcattgacagtctacctcaacttggtggtcaattagcaacattatatcctgaaaaatatatttacgatatcccaggttatccagcaatcaaagcaagtgaattaatcgatcaattagaaaaacaattaactacttttaatcatacatttcatttaaaagaagaagttctctcgcttactcgtgaagacgaagttatcgagatcactacaaataaaggcatacattattctaaagcagtcattttaactttagggaatggttcattccagccgagaaaattgaatttagataatgctgaagcattcgaaaaccacggattggattatttcgtaaatgatttgatgaaatacgccggaaaaaaagttgctattgctggaggcggcgattctgctatcgattgggcattgatgttggagcctattgcaagcgaagtttacctgatccatcgtcgtccggaattccgtgcgcatgaacatagcgtatcgcgtttgaagtcttcaactgtcaacttgcttactccatatctaatcgatggattgtctggcaacgctggagaactgtcagacatccgcttaaaaaaagtgaagagcgatgaaacaattgatttgatgattgatgctctgatcgtcaattatggattcacttctaatttagaacatctctcttcttggggacttgatagtactagaaatgccatcactgtaaaatcagatatgtctacttctattccaggtgtttatgcagctggtgatatctgtacctatgaaggaaaagtgaaactgattgctactgggctcggtgaagcacctaccgcagtgaacaatgctttacactacattaatccaaaagaacggactcagcctggtcacagcacaagcttatatgataaaaatcttcggcctagttgattttttagattcctctgcatttcaagcgagatccgaaagcagtttcttgcatttttttcatgttccgttaacatgaaatagagaaagaaaaaataaagggggagcaataatatggtcgtcaaaactgagactttagaagaaaaggcaagagaactattgaaagaacgtggcgtaactgtagaagatatcgcacaacttgtcatgtttttacaaaaagactatatttctgatttgactttggcagattgtactgaaagtgtcaacagcgtattaacaaaacgtgaagtacataacgccattatcaccggaatccaattagatatattagcagaaaagaaaagattgatggatccgttgcaacacattatcgaagatgacgaaggtctttacggtatcgatgagatcttagctttatcaatcgtgaatgtttacggtacgattggctttacgaactatggctatatcgataaagtgaaaccgggtattttaaaagaactaaacagccacgatggcgttcatgtccataccttcttagatgatatcgtcggagcaatcgctgctgctgctgccagtcgattagcacacaaagaaccagaaaaaagaagtcgacttactcaataaatcaaaaaaagaaagaaaacgtctatttagacgagttctttcttttttgtttgtttcaaactatttttccctaagaaaagaaaaatagcaaaaaatacttctaatactacaaagaacaagataaagctatgcatgaaaaattcttctggaagtacattgatgattggatcagttacaggatcgaataaccagtcatcgttgttgaaaaacgtttcatgaaaaaggataaaaaagcgatcaaatccaatcatcatgaaaaaaccaaaaatgactggcagcaacatgccaatctgaaacggacgaatcaatcgccaaagacgatcattcttttgcaaatatctgataaacaaaatacttgggatcagagtgatgaaaaatacagcataatccactaaaaacaaaattttcacttcataaaaatgatgagctccgctagcagaaactggaaagtccggcaaactgaggactgtttggaagggattattaagataattcatcaggtgatcaaaatttttcagtaatgtctcttggtctaaagaagtataatccaaaatatgcaaatgtccgatatcaaatacatacagcggtcgaaaattgatcgtcactccaactgccaaactaatcagcgtcagaaacaggctgaataatccggcatattccaaccaccgccatctcgaatttttcatattagaagctccattcatccaatgatcgtttcacaaaggtagctgggataggcagcccaggtacatcttcttcttttgtgaaacctgataaaacgagcaaagtatcgatattattacgtatccctgcttggatatctgtttcatagttatctccaaccatgattacttcttctttttgcagacctaatacttcaacggctttatccataatgattgcttctggttttccgatataaattggtggagtttgggttgctgtctcgacgaaagagatgactgacccagctccaggaagaagaccacgttctgtagggatattcttatccggattcgtaccaatgaaagtagcccctttttgaatagcaagagttgctttgacgaccttttcataggtcaaataattatctagccctactactacatagtcaggaacctcttcttcccatgtaaatccggcagctaaaatcaagtcaattaatccggcttctccgataacatacactttttttccttttccatctgctttcatgaaatcaattgtagccaaagtagctgtataaactgtttctggtgctacatgaatgtcaaactcatctgctagacgattagccactgtttctggcgacttagtcgtgttattcgtaacaaataagaaaggcaatttccttttttgtaattcttccacaaaccgtttccctgccggtataggttccgtcccgcgataaatcgtcccgtctaaatcaattaaatatcctttatagtccattcatccactactcttccctttttcttatcgtaaatgctgtttttgttttttccacttgattagattgttcttgtttttttactttttcagaggtttttgctgactctgtttttcgatttttaataaccggttttttacgattagatgtgactggtccttttttctcatcgatatacgcacgattatggttttttttcttttttcggcgctgagttgtcttttcttttttaccgccgattctttcgatgacaaaatacgcacaaccaaaattgcaatattcgtaaagatagtcttccaatgaatcaattcgctgatccggatgcgcccgtcgattatccgctcggaagaatccttttaaacgtagttgttcataaccccaatctcctacgatataatcatatcgggctagtacatcactgtatcgttctcccagtttttctgcattaaatccttcacgataatcggacacaagccgataatgtctttcgcctaccaaaaaattactgtcatctaacagcgtcactacttcacctttgactttttctgctttcggctcctcgacgatttcttccaaagcagctgtcagttcttctgtgactgttgtttcctgttcagctgatgattttttcttagcaatttctgttttatgctcaacgttctgctgttcattttgttttgcagacatgcgttcaccacctatcttttttattataccttgtttttatttgattgggtagtgagctttcaagtaatctcctaccacgcttcggataaattcaggaaacaaaaattcattttttccaacaatttcgatcgttggaaaaaatgggacaaacattagatgatcgacggtagtaaaagtataatttttagtcggatcgactggcttattcttccaaaaaacttgatggttaacggagtcatacatgattccattatagaccatctgtccaaaaatcttgccgcgaaatcccattcccttcatcggatagttacgtaaaaactgacgatttttttctatttctaaaactaaacgaatcagatcatttccacccaatgtgacattcagcaagtgcattggatgcggcaatgccgtgtgaagctgatcctggttgacccgaccttttggaatttcagttaaaaacagaccactgtttaatattgcggcgtccgtctttcctcgttcttttaccgcctcaagggctacttggataaacgaatgctcactgaagatatctaggcttaaagaaaacggcaaatccgctacttctttttcttttagcagctcatgcccctgttctaagtaaccgtttacctcttgttcatcttctgtaaaagctgtcattgtttctgtagggatggctttggccgaatgcttaaggatttttttttcttcatcgatggttaaatggacttctcctacatattgaccgtatttgccagctgctgctatttggacatcgttgactacatgaccttctctgaataaatgatgggtgtgcgaacctaaaataacatcaattgctggtatttcttttgcaatttgtaaatcatcttgaatcccgagatgactcatcaaaactaaaacatccacttgtggacgtaaatcttcgactaattccggcaaaatatcatatggattgcgtatgtcccagccatttggattatacgtaagcgggaacggggcagtaaatgcaatcaagccaatttttgtctggtgtttcgttgtaatgattttatacggtttcgtccatatcggtggctgcaacgtatttttatcaaacaagttatcaaggatgatatcaaactcagcatgatcatataagtggtttagatcttctttggaatttcctacgccttcattgtttcctatcgtcgctgcatcataaccaacttcattcatcagcaagatattcgcctgtccattcgttgcctctgataatggatgccaacgatccacaaaatcacctagatcgactgcaatcgttgtcgtattttctttcttttcgttttctcgtttacgctgatctaagaatcttctgatccttggccaattttctaaatgtgaatgcagatcattcgtatgtaaaatcactattttttccatgtgtcctctcgcctctctttatcttcatcataccacaggcagctttttcttccattgaaacaagctccatttcagagcttttcctgtctcgaagcaaattacataagtataatattcgataaaatagtctggctaaaagaacgaaaaactattcagttttacagcctaattatttctagaaataaaaaaaacagacccgaaagtctgtcgtcgtttcattataatcagacacatggcggaacctgcttagtgctgcttccttccagacctgacacgcttcacaagcccaccattgtcctagcctttcggcaaagaatagtataccttatttttcattcgttgaccagtctttttttaatttcttttttcgctgacgtagctttcggaaaaagtcagtcaaaacccttccgcattcgtcttctaaaatgccaccttctacatacgcttgatggttgaatcgttcgtcttccaaaagattcatcaaagtgccggctgttccgcctttcgggtcatatgcaccgaaataaacttctgctacacgagacaaaatcatcgcgccactgcacatagggcaaggttccaaggtaacaaaaagcgacgcattttctaagcgccaacttccaactttttcacaggcttccttgattgcaaacatttctgcatgtgtagtagcatcttgtgtcgtttctctaaggttatatccttttccaatcacttctccctctaatacaaccactgctccaatcggaacttcatggagcacttctgctttttttgcttctgccaatgcaaggcgcatccatttttctttatctactgcatcaagatttgtattaaccaattaaccttccctgcctttgttttttcttgttttactttagcatatgacaaaaaggctgtaactaacttttttttctatggtaaaataaatacaagaggtgaacaagatgaaaatgaataaattacttgctctttacccacaagcacagaaaaaaaactgtccagcgtcagaagctgatatcctttcttttgcagttgatgatgcttttatttggattaaaagcgattcactatcccaacaagaaactagtcttttgaaagcgttattccctatagtcagcgatcaaaaaaaacatccgtggtatcactatctttttaaagatgcttcttgcatccaagaaaaaagctttcgtttgatccagcttcacgtcgaatcgaaaggagaattcttaaaaaaagaatggcaagatactattttggaattatttcgctattctgctgatttcttcttttatacagacactgatgctcttttgatcgaacaaaaaaattgtgattatcttgatgctgctgagatcaatggtatttttctatctttagatgctgattttgatacgacaacatctgtattcgttggttcttttcattcaccaggtagcgaccttgtccctttgtttgctgaagaaagaagaatttttttaacagagcaaaacaatctctatactcacagccgtactttttctatgcaagatgttgctttacattactatacaaaagatgtcatgaaagatagtgcgttgatcaaaagttacatagaactgatcaaacaaaatgaaatggaagagatcattcaagaattatggaatgaattaggtaatgtcagctctgctgcaaaaacgctgtttcttcatcggaatacgctaaaatatcgaatcgaaaaatttcaagaacaatcaggtttcaatctaaaaaaagccaatgatttactgttttgctaccttttattgattcatgagcatgattaaagataagttaaaggggttatgacaataaattttgtcacaaccccttatttcaaatgaatagtgttcaaaagctagtttctcttacatcattttttcaacaaaatgcataagccgatcttttacgtcttcggttgagtctttgatggaatcaccgtaaacagagattttcttttttcctgattttatttttgctaacatccccatcaaagaatccaagtcactatctgacagatcatctacgatttccatcaatttttcatttccatcgaatttgtcgtggacgaatttttttacttttgtccgagtagtcatatgatggatcttttccattacttttcccgatacgacgactgctgtcgctacactggcagcggctgctacgcttaatccaattgttacttttgttgatgttttcataagtatcagctcctttttatctacttcaatcatagcatagacaaaaaaataaacgaactaatccactcatcgaaatcagcgaaatcttaatcctttaggaaaaaagttctttactgttccttttacttgtttaccaaaaccgacaggtatcttatccaatactaataaaacccatccttgatccccatcacgttgaaatgtttctcctgctgtgtaagattgccattccttttgagtgatcgacaaacaagggatgttttctgtctttttcatagcaagtgctaaggcatagctaggttcaaatcgattctttttgaaatctcctaaatgcaaacctgtacgcatgactttcaaaccatcaagagaagggagcaactcaggaacttcccaaagatgatcgttgaacactaaaagtctcccagtgatttcataatggaaatccattgaaaattccgtccaaagtttttcctgttcttttgtcaattcttctttccgtttcttacgtactttcttttctttacgtgttgggttttgtccatgaaaagtcaactttgcgacaaaatgcccttctccttgattttcatgaggccatatacgtactgttttgtccaaaccatctacgcttccccattcaggacgtcctgaactaacggtttgagacaaagggatttcttcaattgttactggataattttctacaagccagctaataatctcttcattttcttctggtgcaaacgtacaggtagagtagatcagctgcccttcatgttttagcatctttattgctgaagacaaaatctcttgctgacgtttttgacagtgtagcggagattcttctgtccactcttttactgcattcggatcttttctgaacatcccttcccctgaacaaggcgcatcaaccacgatccgatcaaaaaaaccggaaaaatgaggaacaagctctgcaggtgcatgatttgtcactattgcgttcgaaactccccatcgttctatattttctgataggatcttcgcgcgtttcggaaatatctcatttgacactaacaaccctttgcctctcatttgagcagctaattgggtcgatttaccgccgggagccgcacacaaatccaacactttttctcctggttttgctgcagcagctgttccaacgatcattgcacttggttcttggctatattcgtacccagcttgatggaggaaagactttccattcacggtgccaagaaatccctcattgctgtagggagcgggttgcaattcttcgctatggtaagtttgaaccatagccaatcctgccggttttagtgggttccaccgaaatcctttttttgcgcttccttgctcaagtgcgcaaaaaaattcagttgattcttctcctaaaagaagacgatattttttgataaattgctgtggtaacgttgtagcttcctccttcattcaaatgtttcgttagacattttacaatcttttttacgaaaaataaaggtggctgatctactttttcatgttgcttcctaagataactgttcctttaagatactttccaagtattcatccgtcacctcatttttatcccaaacagcgttcatcgtttcaaaaaaatcttgagaaaaattatctgagctcaaacttcccaatgcattaagccaaagcaattcaagcaacttttcctctttgattttcgtgtggcctttgatgtatgaaaaaaatggccgtttaaatagcgaattcatgtctaattcagattttgcaatgattccacggatactttcatggatagaaaaaaaatctttcagcaagtagactgtgcttagaacatcattggaattgcattcagctaagtatcgttcaaagcaaacagtgatttcttctaatattttctcctttaacccgctgatcgatttgaaatgtgtataaatcggatatgtagagcacccgcagaaatccgccaaatctcttgcagtaattgatttcattccatattcttccacatataccatacttttgaacagcaagtattctttactataatttgttactctccccatcatccttacctccgtccctcttcatctaccctctaataaataacgtacaaaattaaaaaaaagtgaaataatcactgataatcttcataatcactttagatatatccattaaaaatcaagtatatttacttatgatacaagaaaaacttgacaaaacgccctatgaaataaacaatagaataaacaaggtgataacaagatttaaataacaatatatacaaacaaaaggcgatactctgtaagaataacacacactgaaatgactttccactcacagtttttgtctaactatatacaaaaacagaataaaaggaggctattatgttaattgaagcaagaaaaaaagagttgcttgttctgcacagggtcattcaaaaaaaaaattgttctttacaggaattagccaatgaattgcatattccaaaacgaacaatcaaagagttgattcggaaagtaaatttttcgctcaagcaatttttattgatggaggaatttatttattctaaccataaaggagaaatctacaccaaagaaaccgatcagtctaaaaagctagctgtattttataagttaagattacgctacctacaagaatccaatcgttttaattatttaatgttgctgattaattatccacaatctgctgtaccaaaaaagtatttacttgaacaactttatatatcgccctcctatctcgaaaagctgacaaaacaactcaatcattcattaaataaattccatttaaggatcgtatctgtacaaaactgctgtgttcttgaaggaaacgaattatctatccgcctttatctttatttttttctttcagatacattcgaaggagacgattggccgttttcctctcttgaattaaatacactaaaaaagaaaagtaaggatgagcacagagaaaaaaatccaaaacaagaaaaaaacatctatttattacttgctttattcatatgtcgtaacagacaacaggcacgtttttcgaaaatttctcctgaaattactgaattaatggatttgttgcagcgtacacatgattattcagaatgctttacttctttttcagcgatttatccctgtgaagaggtagaaacggaaagagcctacttcaattattttttctattgtttttttccaaatcaaatttcattccaacaaaaacaggtgattggtttcttattttccacaagcaaaaaccttatttgccaacaagtcgatcaattgatgacttacttaactcaacagtttcctatcaatcatttggaagacaaaaaaccgatctatttttattttctcgtactagcagttattcttttggaactgttaggtgaatctagcagtagcttttctacactctgttttccagaaactacctccaatcaaacggcttcttttatacaggaaaaaaaattaagagaaaaaatcgacacaattttttcaaactctagaaaaaaatttcaattaagtcaataccttattcaattgatccaacacttattacaaacagaaatgaaagaacaattactcatccacttgcagataaccaaaccattcacagggaattaccatctgcaagatcatttacagaaactatttcgcaatgaagcaatcaagattatcgaatgtcctaaacatgctgatttgattattacagatcaacatgagaaaatatcagctgaaacggaaactttctatctagatacaaaccacgatacagtattattcggtgagttgataaaagcgattcaagaactgtatatgaaaaaaagatatgagaataaaacaaagagcgtgggacaaaagtaaagaacacttttgtctcacgctctaaacacgtataaacggcggaagcagaagcaactccttcggaaataagctgaaattcacaaaaatttgaaaagcaattttcgtgaattccttcttatttcttggagttaaacgcttctgtcccagcctctttatgttaatctcttcggttgccgccgaacaataaaatcaagcgcaacagctgaaggaatgtcgaaagcgctgctgcaacgtaagtcaatgccgctgcaaacaatacgtgtcttgccatcggtacttcttcttccgtcagcagtccgccctcactcaaaatttggattgctcgacgagatgcgttgaattcaactggtaatgtcaccaattgaaagagtaacgctaaagaaaaagcaaaaatcccgatattgatcaacgtagagttccaactaagcaatacacctaccataatcaatgggaacgaaatcatcgaaccaaagttagctgcgggaacaagtgccgcacggatcttcaatgggacataccccgaagcatcttgaaccgcatgtccgcattcatgagctgctacacctatcgcagcaactgaagtagattgtgcagtcgcttgagacaggctcagcatcttattacctgaattgtagttatctgtgagatctccggcaatttgttgaacgccaacatcatttatttgttggctttgcaatatatattgtgctgcttgtgtaccagtcacgttgtttttgcttctcacttgatcatatttgcggaaagtactattgacataagctgacgcaattccggaaatgactaatccaagaatgaccaaaagaaatgtcggatctaaaaaaccatacattccataaccatacattgtcgtttcactcctttttgtttcctttattttatcattagtagcaagaaaagaatgtgaaaagaccttgaatattctttaattctttttcacaaattccgatttcagtttcatcggtccaaatccttctaccttgcaatcgatattatggtcgccttctactaagcggatgttcttgactttcgttccttgtttaatggcacctgatgcaccttttactttcaaatctttgatcactgtcacgctatcaccttctgacagacggtttccatttgcatctaataccactaatccgtcttctgtgacagttttttgctcttctttgctccattcgttcccgcattctgggcaaatcaacaaacctcgatcttcatatgtgtactctgagccgcattctgggcaatttggtaatgtcatcttctttctcctttaaaatctttagtgagcactattgtaacggaaaaagaagatgttgaaaagatacatttgtgatttttaccacaaaaggaacgttttcgaatgaagttgttacttcgtttctctactcttatacgattggcaaatgtcttgaatctctttatagatttcctctacttctgctaaatcttttgcattcgcaccacttgctaatgggtggcctcccccatgatggcgtttcgctaactcattgatgactggtcccttagaacgtaagcgtacgcggtaatgtcctgaaggttgctgaacaaaaataccccaagctagtacttcgtcgatcactccaggaagagaaacgattgaagccgtctctgaatcatcgatgccatatttatcaagaatttcttgcggaaggattattcttcctgcaccattttcatccacctggatattttgataaagataaccggaaagtttagcgactttcatcggcatttgctcaatctctctattcaaagcacttgcatcaaatggataatttctcaatatcgatgcaatctctaatgtacgggacgtcgtggagggatacaaaaagcgccctgtatctccgacgattcccgcataaagcaaccgtgcagcttccacgttcatcttaaataattcaggaaacatcaaagcaaattctgcaatcatctcactacaactgcttgcttttgtatttacccacacaagatctccataagggtcatcattgggatgatgatcaattttgatcagcttttctgctaactgatatctttgatcactgattctaggtgaattagctgtatcggtcacgatgactagcgctccttgataaaaggcatcttcaacttcttgcatttctgctaaaaagcgaagaccttcaatcgtttcacctacttgtcgtatttctttttctgggaaactttcccgtaatagttcggctaatcctacttgtgatcctaacgcatcaggatcagggcgcaaatgcctgtggataatgattttatcgtatttttttattgtatctactatttcttgctgtactgtcatttcactcctgctttctaagaacgttccattacttgacaaacaacgattgctttggaaacgatggtattttcaataaatacttcgatatccaatttagcggaacgtctgccgatttccaatacacgtggacgaatgtccaactcgctttccaattggatcagccgcaaataatgtaggttcacttgttcaatcaagatgtttcgtttttggttcatcaccattgttttttgtgcgacatcagaaatgatttcgctaagcacgccaaaagaaatggttccaacaccattgaccatttgtggtgtcactacaaatttgaacttaggattttccaaacgattcccttcacgatcggtatcaatcgtatggatatttccagatatctgatctgaaatcgtatctgcaatctgcggttgtcgctggacaagctgcatcgctttcattacatcttgccgggtaatcaagccttccaatgtcaagtcatcggagacgaccggcatgacctccagcccatcccagatcatttgatgactaacagaagcaatactcattgttttctttacactaattggttctttcgtcatcactcgatcaatgatctgatttggtgatttccctaaaacgtcttttgccgtaacgatccccatcaaacggtgatggcgattaacgactggaaaacgtgaatgttgcgtttcttctgacaaacgttgataatcagaaatcgtatccatctgatgcaaataatgtgtcttttccgccggcatgtagatatcgctaacaagcatgatatcttttttgattaattggtcacttaacgctcggttgatcatggtagcgactgtaaatgtatcataagaagtgcgcaagattggcatttcaagttcatcggctagctttgcaatctcagtagtcgtattgaatcctcctgtgatcaatactgcagcgccatcttccaatgctaatttttggacttccgcccgattgccaacgatcatcagtgatcctggtgtaatatagcgttccatggcatgtttagtcatcgcaccaatgacaaatttattcaagaccttgtctaatcctgccgagccacctaaaacgtccccctcaataatcctgacgacttcgccaaatgtcaaacgttcaatatgtttttttaatttacgttcgatacggatcgtacctactcgttgaatcgttgaaactagtccgacattttccgcatctttgattgcacggtacgctgttccttcactgacattcaattcttttgcgatgcttcttacagaaattcgattgcccacaggtaaactttcaatatattctaaaattaaatcatgttttgtcgccattttctgcctacacttccagcgtttccgagacgctcattatttttccttcgctatcttccagtaatgctacaaaagattcaggatcttgttcaatgacagggaacgtattgaaatggattggaacgactttcttggcacgaattgtttgtgcagcccgagccgcatcctctggtcccatcgtatagttatcaccaatcggcaagaaagcaacatcaatatcgaactcttctgcaagcaatcctaaatcactgaaataagctgtatctcctgcatgataaatcgttttgccttctgcttggataatgattccgctaggctcacccatatactgaacgataccgtctacttcatagcttgaactatgctgtgcatgtacgaattttactgtgccgaatggaaatgcatgttttccgccgatattcataccgaaagaatctactcctctgctatttgcataatcagcaatctcaacaatactgataatcgtggcttgattttcttttgcaataggaatcatatctcctatatggtcactatgtccatgagtaatcagcaaccaatctgtctttacttcttctgcagttaaatctgacaacgggtttcctgtaataaacgggtcaatcatcacacgttggccattttccatttcaatcgttaaacaagaatgtccatgatacgtaattttcatattctacacctcacgttttctctgtatcttttttattaaaaccgatttcattacttgcacatcaatgaaaaaatatagttaataaatatattttcattggattgatagtacagtatgcacaaagcaattgtaacagataatacaggatgcaccaagtaccaagcagatataatctcaagtttgagctctctgcttggctccccttctcgtcacttaactaattaaatcagcgtaaataggatggacgattttttctaaatcagctacttttatctggaggcttctcccgatttcaccgctcgacacaatcacttcttctttttcttttaaagaactgtctgctaaaaaacaataatcaggatgtgcgagttttattccaataggggtattcgctccgtgaggatatccggtatgtgttaagacaaaatccatcccaggaaaaccgactttacgatcgttcgtcacttgtctcgtttttttataatctaaatgatcattcaaaggaatcaatgcgatgatcaccccagttttgttcccttttactacgagagttttacatatcaaagctggatcaatccctcttttttgtagttcttctgtgaaagatccctctactatatgactaaaatcaagtggttgatagctgattttttgttcttctaaataacgttcgacttttgtttgactcatcattgatccactccctttattctatcgtttattataaagcgaaggatactgtattcaaaaatcatttgtttccctcaaaaaaagagcaagacgagcactctatagggagagccatcttactctttgtttatttcttatttcgacgttgagtagcttccataatgactggcaagatcacaggacgtcgttttgtttgttcaaataagtaacgacctaattgatcacgaatgtcttgctttaatttgctccactcaaaatcattgctttctaagtgtttctcaacgattgtttcaatcatattgctactttctttcatcagatcacggctagcttttacgtaaacgaatcctcgtgaagtgatttgaggttttgagatgattttcttctctcttcggctgatagtgacaaccgctacgaaaatcccatcttctgataagattttccgatcacgtaaaacaatgtttccgatatcgcctatgcctaaaccatcaatcattacattttctgcacttgtagttcctgcaacactcatacgcttattcttatattccagcacatctccgcgtccagtaatatagatatttttgtaaggcatccctactgcatgagccaaatctgcgtgagcagctaattcccgatattccccttgaactggcacaaaatatgtcggcttcatcaaattgatcatcaattgcaaatcattaggattggcatgaccagaaacacgcatattctcagagatcaatttcactgttccaccagctcgataaatgatatcttccgttttcgccacgattgtttccatcgcgatgcttggcgtagtagtgatataaaccaaatcgccttcttcgatcttgacattacggtgtgtgccgtttgccattttttgcagagacttgatgggttcacccattcggccagtttctaaaatgatcagttcttctggatcatagtttttcatgtctttcaatgtaacaagtaaatcttcacttggtaattgaagtttttctaaacgcatcgctgttcgaataattcgttcaaaatcttgaccagtcaagacaacttttcgttgtgctttttctgctgcgtccaatacttgttgcactcgttgcaaattacttgctacacaggcgacgatgatgcgtccttcccaatatttgattgtatcaaatacttcatctgctatctgagcttcagaagctactggttgaggattctctgcatttgccgattcactcagtaaagctaagactccttctttgccgatttctgccaatcgtgcataatctgtttgatacatcgggatagccgtttgatcaaatttaaaatctcccgtataaacgatactaccttcttttgttttcagattgatccccactgaatctggtatcgtgtgagtggtacggaaaaagctcactactgtttcaccaaagtcgatttctgtatgctcatctaccacatggaaatccttaaatcctttggctgcttcgttacgactgacattcaattttgctaactcgatcgtcaactccgttccaaatactggtacagaaattttcgacaacaagtagggaagcgccccgatcgcatctgcgtgcccatgtgttaaaaagacaccagctacacgatcaatgttttcttctaaatacgtaaaatctgggatgacgacgtcgatccccaacaactcattttcaggatattttagcccacaatctaatatgaaaatatcctcgcccacttctgcgacatacatgttttttccattttcgcgaacgccgcctaatgggataattttaatggtactcacaaatttcacctcttcttatgacatccaagtttaaagatgtcgattttcttctttatctaaatttacgagccattccaatgaagcacatgcaaaatcactagttctcaacttatggagaatcagcaggaaaattaccggcacatccgcgttctgacagttggttgggcattttattttggatatacttcattaacaaaatggatcttttgcgaaacgctatagccagaatacttatatgagtattcggctgttccccattattatacaacaaatgaactaaatcgctagtatcagcaattgttagaatcactaaacaaatgaaaattcctctgtaacatctaggatttcttttgctgtttctctttcatctcttcttcgtcggtttgaaacatacttttttcattttaccacattttttgcaataactatagtgactttttatatatgcagaacctcgtgttgatgatgtgcaaacagcataagatttaagctagctttaagattggttgtctattatcaaatgcatctactaggagggatgcaagatatgaattttatgaaacgtgcatggaaaagtacaaaagtaaaatggggacgttcattgtttttgtttgccgtgttcacagccattcttatttttgtgctagctggcctcacgattcgaagcgctgcagaagaagcagcgaatcaagcacaaaaagaagttggagcaacagtgactttaagtgccaatcgagaagcttcatttaaaaaacaggaacaaacttcttcaagcaattctaccgctgaagaacgtccagatccgggcagtttttctcttaccccagtatccttaacggacgcggaaaaaatagctaaattagataatgtaaaaagctattcctttgaaagttccgcctcagctatggcaaaagagggaataactgccatcactagttctgattcaagtgaagacagttcagaaactaccgatgcaggcggtggtcctgccggaggaatgggcggaaatccgcaaatgactcaagcagatttccaaatcagcggtgtgtcagcaactgcacaaaatagtactttttctgatggaacagcaaaaatcacggatggtgaaggaatagatgacagcgacaaaggcacaaacaacgtagtcattgattctacgctagcagaagcaaatgacctgacagtcggagatactttcacaatcacgagtactgaagatgaagataccacttatgaaatgacggtcaaaggaatttatgaatctagcgaaacaagtagcagtatgggtatgaaattcaacttcatgaatccgtcgaatacactttacacctcttatacttttgcaaatgaattaaatgggacatctgacgataacacgatagattctgctatttacactctatctgatccagatgaaatggatgagtttctcgaaaaagcagagaagctgatcgacacagatacatttagcttacaatcaaatgattccatgtatcagtcaatgttggaacctttaaacaatgtggcaagtttttctaaaaatgttgttttactagtggctgtagccggcattatcatacttactcttattattatgattaccatccgggagcgtcggcatgagttaggcgtcttgttatctttaggagaatccagaagtaaaatcattctccaattgtttaccgaagttgctatttgtatgattcttgcattaggagttgcttcgattagcgggaacgtcgtcgcgaatgccgtggggcagcagctacttgaccaacagacagaaaccacgacacaagaccaacaagctcctggcggtggacaaatgccaggtaacgaacaaggcggtcagcgtggtggtcagcaaggaaacacgaataatccatttgctgtttctgatcaagtcagcgaattggaaatcaatgtcaaacctacacaattaggactactagccggagtagcatttggaatcagcctgctttctgtctttttagcttctatagggatattaaggttaaacccaagaaaaatcctattaaattaaaggaggaatttgatgttacggacagaacaattgggattttggtatcaagatccgcaagatgcgctttataaagatgtagaactgaatttcgaagctggaaaaatgtacgctattttaggagcaagtggttctggaaaaacgacttttctttcgcttatttccggattagatacaccaaaagaaggaaaggtatactatcaggatcgttcactgaacaaaatcgggttaagaagttatcgtcaaaatgatgtctcgattattttccaagcttataacttgcttccttatttatcagctctagacaatgtcataacagcaatggagattactaaaaccaaacaagaaaattatcgtcaagttgctttagatcgactagctcgtgtaggaattgatgaagtattagcaaaaaaacaggtgaccaaactttcaggaggtcagcaacagcgagtcgctatcgttcgtgctatctgttgcgaacatcaactgattgtagctgatgaacctactgggaatctggatgagaccgcatcacaagatatcgttaaacttttccaagaaatcgcccatgaacaaaatcgctgtattatcatcgtgacccatgaggtcgaagtagcaaaaagctgcgatgaagtctttgaactaaaaaataaagaatttcaaaaaatagaagtttaaaaaacaggataacgttcaaacaaaaaatccgaaccatatctatatgaagcagatacggttcggatttctatttgcttgattcatttagtaatgaacgttgtttatttgttttcatcttttcgagagaatttgtctttgatttcatcgcccaaatcacgagctttttctttgatatcagaacctagtgattgtgcttttccttctgtttctttgctcttgtcgtctgttgctttgccgtatgcttcttttcctttaccgactactttgtctttcatatctttagaacgtccttttaaatctgccattgtgtttcctcctcttaatttgtttattgatctactttcagggtaacatcaacaacagatacagacaaacagaacgctcgttttctaaaaaaggatgcgtcagatagggaatcaaaaacttttttcgaaagttccccatactttgacttctttttcttggatcattatttctcctttagcaataactgtatcgatatcaagcgtttctttgtccaagatacacaagtctgcatctgcgccaatttcaatttttccttttttatccaatttcaatatacgtgctgggttactggttatagctcgcaaggcgatttccagaggaatattttccttttgcacagcttctttgatccctactagcaatgccttagcacttcctactcctagccctaggaaatgattgttttcatcaaaataaggcaagcttccttgtccatctgaggtcatcgtgaaattatctaaagaaacatcttcctcaatcaatcgtttcagtgctttactgaagcgcacttccccatctgtcttctcccaaaaatcaggatcttcgctagcggtgaagtcaatcgtgccgccacgtttagcaaatgccacgcaagcttcaaataattctggtgtacgattcgcatgagtaggcaaaaactgtgtgatcggaatttctgtttcttctacaattcgtgtcaataactctagctttctttttcctccgcctaagtggacattgatgatcccagcttttcccgacaacatgcctcctacacgagcgtctgctgctgcacgggcgaactcttcaaaacttggctgagaagaacggtgatcggatactgcgatttctccgattccgatgattttatcgattgttaaaaagtctttgatgatcgaatctgttactgtttttaccggcaatcggtacgaaccctcgtacacataagtagagattccttctgcttcaagtcctttcgctttgctgatcaaagcagtcatatcacgaccttctccgtctgttcccaagcaaccgacaactgtcgttacaccagctgtagtcaattgacttaatgtaacttctggtgttcggttttgataaccgccttctcctcctccgcctaaaatatggaaatgacagtcaatgaaacctggagtcagtactttcccctcacctgaaagttcttctacttctactccttcgtagccgccttctagctgttcttctacagccaaaatcttcccaccggcaatcaatacgtccatttttcctaagtaatctggtgcaaacacttcaatttgtcggatgatcttcatacatttttcctctttctttaagtataactgatgataggatcttaaaaaataatccaaacgatagaatctttactcctttgattttaccgtaaaatgacggttcttggagtcatttgtctactgtttggattacttttttacttacttatgtctccagtactactgcagaccgatcgcaatagcaatcatgatgaaaatagttcccaaaacaaacaggaatccttgcatcttgatttggaaccttgcccattttgcccattcgattcgagcaacacctaacacaccaatcaagctagctgatacgggcgtaaaagcatccatgaaaccagaaccaagctgataagcaagaactgctacttgtctagatacaccgactaaatctgccaatggagccataatcggcatggtcaaagctgcttgtcctgaatttgatgtaacaactaagttgaacaaactttggaagatgtacatcgcccaagcgccaatgacagctggcacaccggtcaatgccgtcccgattccatgcaaaatcgtattcaaagctgaaggaacagacgcatcggatccacctaagacgagaaggattcctttggccatccctactacgattgctgtaccagctaaatcagctgcaccagattggaaagaagaagcgatgtcattgactttcattccatctagtttgaaaagaacagcaatgattccggcaactaatcccatcacaaagaattgagaagcgatttcggggatgtaatagcctttttgagtcacgccccaaacgatccaaacaagaacagctaacatctctactaaaatcagtttatggccaagcatgaattttttattttcatcagatgtctttttgatatgagaacgaaaataatcatctgatttgtaagtcaacgaactttccggttttttacggattttttctgcatatatcatcatatatccagctgctaaggcagtaacaactacccacataatcaatcggaatgtcgcaccagacaacactgggattccagcaatcccttgagccacagctacgctaaacggactcatccaagaggtcgcatttccgacttgagatgcgacataagtcacggttactgctacgatcgagtcatatcctaaggcaatgacgaatggaaccatcaccattgagaatggaattacctcttctgccatcccaaatgtagcgcccccgaatgaaaaagcaaagaataatagcggtaaagctaaacgctccagtcccttcgttttactgataaacgcatagattcctgcatcaatcgctccggtacgcataataataccaaaagcacctccgacaacaaggatcaatgcagcaattcctacagcagatccatatttatctccagatactagaccttcaaaaacaaaatttaagaagccaaagccaccaaaatcgtctgttccccatattttggctgttttatgcaattttttagaagtatcatagatattttcgccatactcatcataaagaacatcatctgttaaggaaatttcatctagtttttcttgcgtaagatttttttctccgtcagcaatgactttttccaatcctttttcaggaacatccaatttttcacgttctgctggatggtcttgcagttcttctaattgatcaaatacatacgatttatccagctcgtaagcataacggaaggaatcttggcgtaaaacagtacgagtacttgtttcgccattcgcatctttatattcaatgtcttgcgtgctgaactttcctgctggtacgacaaaagtcagtatccatgcaaagatgactacaccaaaaataatgacatacgtatgcggtgtcgataatttagtgaagtcacgtttcggttttcctgaagaatttgttttcttcaaatttatttcttcctttcttttctcagtaattttgatgaataaaaaatggataatcaaatgaattatacagtaaaaatgtcaattccacatgaataatttattagaaaatcacttttttctattttgctttttttctcatatgtatgactatttttttctttttccatttatattaagtattttatttctctgtttttccttaaaattctttttttatttttagattagcggaaatcccgtcctgattttttcattttataatcgtgaataaattgtatttcattgcaaaaaaacaaaaaataataataaatatccatctcatatctttcattttttgtatattttctttctattagaaaaaggaatattcttcgacaattttgttatatcaggtaaacttcattgcaataatgataacaaatgtactataattacgttgtaaagagttttggggaagactctttcatcaacgtgtattaagagacaagaaagaatccattcggattctttcttgtctctttttccgctatttttttatctatctagtattacatatttttgtagctctttttttctcattgtgaaacaacttataaaaataacgcactttcgaaaaaaaaggctgacctctggaactaaacaaacttaaaataacaaaaaaataaaaaatgatcattactgctcttctttaaaaatcgttttcttcgtttcaaacactccatatttacgtggaacaccatttttttaaagaaaatttggtcattatgtggaaaactattttcctcttgtttcctgaactagctgttttgctgtaaaatacaaaacttgttgaagcaaaaagatcgttgcaagagaggctgttccacagattgctggatctaaattcggcaaagtcaagactgcatcatgcagattggcatggttatccaaaactaaatcagcaaattcaaataatctcaaaccactgctatgctgggacttgatgcttcgtgacaaatcaaacccagtaacaatgatcaaaggacgtccattttctttgatccattgagccaactcaatgattgctggatttcttccttcattcgaaagaagaagaaaaatgtcttctggtttgacagaaagctcatcaataatcgcttgtcctgccccttctagcgtttcatagacacctccggctgggttctcaatcaatatacttggcacaaggtccggtgtttgatcccaaaattcaaatgctacaccacttagtgtgcggctagcatatatctgcaatctgccgccttgattgatttgtttcgcaatccaagttcctgcttgaaccatcaacggctcttctatccttaatttctcttccaattggtaataatagtcaaaataacataaactcatttttctctcccgcctagctatacttgacatgaatagaaacagctgcctaatctaaggaactacataaaaaacagaagataaacagtaacacatgcggtctttgctgtttcaaacgcaaaaaaggtattgaacgaatacgcccaataccttgacatagcaaataaaacaacgtgcagaccatagaaaatctctacataggggtagaattttccccttagattaggtacaataaataaggtcgatgcactgcattgactatggcaaaatgatcggtcagggtgtatgagtgtgactggtcattccctgattcttagcgccaactaagggtcagggagcctttttttattcagctgtttctatctgaactcattgtaagtaatctcttattcaagtgcaagtacgaaaatacaaaaaaacattggtatgatttttttacaaataaataacataaaaaaaaggaatgacttgtccctatgtagcaagcattcctttttgaaaagattcttttaaataagtaaaaaaagttttttttcaccaattaaataaatctctcaactcaataatttatccattcttttatctttttttgcgtatacatactaaatattaccgtcttcttctcgctcttctgctttgttctggagaatctgtactagaaaaagtagcggcatgtctacctttttttccgatccgagactttcttttcctataaggaatataaatgatcagatacaatacagcaaaaaataaggcaaatatgcaagcttcccaactacctaacgccagttcaatcatcaagctagcaactgcaacagacgctgcataccagataaaaatcaggaatctttctttttttctgaccattttgaacatgataaatagactaatgagcaatagcggtaacacaaatacccaattacttccttccatcagccacttgagtatatcaagtagcgactgcgcaacagcgactaattttcccatagtggacacacaccttttttataattaaaaaaattcgcctttttattctactatgaatcttctggattggctttcatttctcttatgtaatcattttcttttatgtaacttaaaaaaaaattaaaccattagcagaaaatttcctaaatatattcacgaaagtctttttttatctttcatttttcctcgtcttcattcacttaacgtcaaaaaataaaaacgacagttgcgcaaatgacgcacatgctgccgctttaacacccatttgatttttattctcagcaggtcacttatttccagttaattttctgttcttagctctttgcccaactggataatatatgcgcttaacgatgcaccgatttccggatgatgaagtccatattcaatatttgtcttcatatatcctagcttatcgcctacatcatatctttttcctttaaattctctcgcatagaccgcttctgtttggttaagggtctggagcgcatccgttagttgtatctcgttccctgctcctggttcttgagttgctaatatctcaaatattttgggagtcagcagataacgtccgataatggctaaattgcttggtgcttttccaagttcaggtttttctacaaaaccatttactctgcaacgtcccttttcgttatccgttttaggattaataattccatatttagaggtttcattttctggtacacgcatgacggcaacagcagaagattgtgtttcttcataatccatcatcaattgttgagtcagtgggatatcatctttcatcaaatcatccccgagcatgacaacaaatggttcattccctatgaatgcttttgcttgaagaacggcatcccccagtcctcttggatgagattgacggatgaagtgaagattgacatgagtcgtttcttcaactaaagcgagtagttctgttttttccttttctcgcaaattgttttccaattcgatatttgcatcaaaatgatcttcgatgggtctcttttcttttcccgttacgatcaagatatcttcaattcccgaattcaatgcttcttccacaataaattggatcgttggcttatccacgattggaagcatttcttttgccatggcttttgttgccggcaaaaaacgtgttcctagcccagcggcaggaataactgcttttttgaccttcacttgctgttcctcctaaacgacgattacctgttaatcatctatttaacgaagagaaaattcattctccatttttccgtcacgtagcatgatttcttttgcggcttttttaatatcttctccattatacaaaacattatagatggtttgagtaattggcatctcaacacctagctgttgtgctagctcgactgctgcttttgtcgttgccacaccttcaacgaccattcccatgttttccaaaacttcttccagtttatgcccttgtcctagtaagttaccggcacgccaattacgggaatgaacacttgtacaagtaacaatcaaatccccaacgccgctcaaaccgataaacgtcagcggattggcacccattgctacaccaagacgactaatttctgctaatccgcgagtcatgattgccgcttttgcatcgtctccgaaccctagcccatggatagcaccggcaccaatagcaatgatattttttaatgctgcgccagtttctacaccaatcacatcattatttgtataaatcctgaaataatcattcatgaataattcttgtacataagcagctgctttttgatcaatacttgcagctgtaatcgttgtgatatcatgaactgctacttcttccgcatgactagggccagataatacgacgattgcctgtcgtttttcttctggaatttcttcagccaaaacttctgagattcgtttatgcgtatcttgttctaggcctttacttgcatggataatgacgggcttagtattcattttaccaataagttcctgagcgactgaacggatcgcttttgtcggaacgacaaacaaaatagcatctgcgtcatccactgcttctgccaattctttatatccgataatcgattctggaatcgtcaaatcaggtaaaaaatgttggtttgtatgatacgtattgatttcgtcaatctgttcaggtacatttccccaaatacggacatcatgcccgttttctgccaatgtctgtgctaaagcagtgccccatgatccaggaccaagaactgcgattttttgtttcatggatattcctccaaataaataattgataatttccattatagtatacatttcttaaagtttggactaatttccattgtttttaagtgtttgtttaattcttttatcgactttcacttaaaataatctatttaatgttgcaatagcgtacattttaatttttttctttttacacttgttatactttatttgtcactaagagaaaggaggtttgactatgtttccattaccattaccattgggaggctgggaagtttctcctaacaacccttaattgaagctacatacaagaagaggctgggacagaagcgtttaactctaagaaataagaaggaattcacgaaaattacttttcaaatttttgtgaatttcagcttatttccgaaggagttgcttctgcttccgccggttatacgtgtttagagcgtgagacaaaagtaaagaacacttttgtctcacgctctttgtttaagtcaacacatggtagaaattttgataacagtcgtatcctccttattccgagtaaatgatgtgacatgcagttatacatcaggcttatcgtttcttgatacacagtgttcaatcagctcaccctcgatattagattaaaaaacggcaaaatatgaaaaactattttgccgttttgtttctgtaatatttaggtcaaaatactgattccacaaccgcttgatataaacggtgttacagaagtagcctctatcacgacctcatcatcaacttattttttgccataaagagaaggccgtatctggtgcccaatgtgcggctgcaatatgcgcttgcacgcaacgatattgaataccattatatgtgactatgtctcctacttgataaaaagtaccgactgtccaagaatttccttggccgttctcgtctagggttcttgccgtgacagactggcttagtaaagaagcgcctgtctgaatgactgcacgaacttgatagcgatacgcagtagaagctgtcaaattttgatcttcaaatacagcggtttgtgaggtagcgatcttcttgccatctctgtatatttcataataaagtacttcttccaataagctgttttcttgccataccaaacgaactgttgattgtgtcacatgattgatgctcaacccgtttggtatagaaggtgctggtaaaactgctgcttcttgagtgcgaatgttcaaatcatcagaacgtgcagaaatatttcctgatgtatcgacagcttcaatcgtataagaataagtcgtttctggttgtaaacctgtatgtatataattcgtagtgttgcttgttcctactaatcgattgttttcataaatattataatgtgacacacggacgttatctgttgattcagtccaagacaatgtgaccgtcgtacttgttgctgttcctcgaagattggccggtttagaaggtttctctgtatctggttcttgttccttaaatagattttgataagctttcgcaaatgattcattataagaaataccagctgagtttaccccttcgtcccagttcacgctccaagtcatcaaaccttttaaaggtgtacgttctttttccatttgttcgaatacttgatagacaacggatggatcttgcacataaccgttggctgccgcatcgttatttgctggaatccccaaagccagacgatctgctggtatccgaatgtatccactctctccgttatgcaaggcttttgacataccatataagaaatcatattttcgactgtcattgttctgagcaatccattcgtcgcccacgcttaatccgtcgcccgcctgattatatagttgtggtgcaataaaatcgtactcattttctaatgcagtgatatatgggacatagcctcccgctgttctcaaataagggaattcaggtgccatagaaataataaagtgtttcccttgctttttataatgatctcgcacgattttcaacgcttctggaatcacttgctggttatcacctgccgtaatggcgctttgttctaaatcaatgtctaacccatcaaatccataggtttctaccaatcgaatcacttcatctgcaaatgcttgttcttgccctcgatacaattcgatatgggaatccgctccgcctagagaaatgataactgagcgtccttcttcattcagggcagccactttgcttctgaattcttcatcactcatattaaatggctcaaatgtaggaatcccttcgcctttcataaaagatactgcgatgacattataaaacggattgatctttcctaagtctgtctctgctggtttcccacctctatatcccgcaccttgctctggtacccaattatgataataaccaacagcaatttgcttttctgagatatccggcatcaatgccgcagaatcttgtgcagcatatatagtttgtccacctccagcgaaacagccgattgctgccaatgacagccaaaaaatttttttcattcatcatacctcctaatatttggtaactatagtttattttaacaacgactgtttttcattttttgtatgttattacaacataaataaaaattgcttttaaagaatgagcactttttatcaaaaatagtgcataattgacattttcgtccttagataacagccttgtgttatcttatattcataaaaaacgtatggaggtaacttacatgataaaacatgcttctttaattcgaaaactaagaaaagaacgtggactgacacaagctcaattaacagaggggctttctcagcgagggacattagctgcttttgaatctagaggaacaaaaatcagttttgaattgttagtggattaccttgaacggatgaatgtcacacttgaagaatatcaatttttgctgaacaacaatactcttacaggtaaacaaaaactttctaattacctgatcacaacaaaatatttaacaaaagagcaagagaatgaactactaaaagaatataaaaaaactgggaatatttattatcgcctgctatatacgcaacgtatactaattgatcaatatctgggaaaccgaaaactcactcgttcggaaactttgacagaagtttctattatcaaaaagtacttggaaggtatcgatacatggggacactatgaactttctattttttccaattgtttatttatattcgatgacgagtatatttatcattcttttcagcgtagtgtcacaaaaatgaaagcatacgtcgatactgctcattattccgaattattatcaaattttcttttgaacgggatacatctatcttttcatcgttcttctgtttttcttagaaaactatttttaggagaatggaaaaaagtaagtgaccgttataaacatacgttagacttagcccgttacaaagcattcactgctttagctctattagcagatggcaatgaacgagcactagaagaaattgacgaagcaatccatttctttgaatggctaggactagaggaagtgaaagaagagattattgaattgagagattctcttttgaaaaaaactatacataaaaatgataaggctatttatcaatagtcattcttctagttttttatttttgttgcaataccatacaaaaaaataacattcagataatacattttatactatcttatgaaaaggaaaccctttcttaaaatattttatctaactggaggaatcatcaaatgaaaaaaagtactttattgggattaggaatgttacttgctacaacaggaatcgccgctttgtcttctgtagatgtctcggctcatggctatgtttcacaacctatcagccgtggctatcaaggtgctctagatagtaggaataattggcaaagtgcttttgaaaagtatggtcgtatcatcaacgaaccccaatctttagaagcaccaaaaggattcccttcggctggacctgcaaatggtcggattgcttctgctaatggtgcagtaggtgactttgttttggataaacaaacagctacgttatggacaaaaaacaacttaactactggggcaaaccgattcacttggcatttcacagctgaccacgcaacgacgaaatggcactattacatgactaaaaatggttggaatccaaatgccccattgaatagaaatgacctggaattcattggtgaagtaaataatcgtggcaatatgtctaatactaatccgactcatacaatcaatattcctagcaatcgtctggggtatcatgtcattttagcagtttgggatgtagctgacacagataacgcattttataatgtgatcgatgtcaatgttcaaaatcgtaatgcattaactgacttggaaaacaactaaaaaataaagggagcagttgtcgctgctctctttattttttatattcttttcatccaatcgatcctaataatcaaactgacgatagtagcggcgtatctctaatggatgacaattcatctgttcgacatgtgcatcgatacgctgtgtcactgcatgcatcaataagaaagacaacacacgtccgcgatatttttcgctgataccttctactggatagtcttttgtatctatcaatgtataattactacaaatttttggcaaaagtttagctacacgttcagataacactctctgttcatcttcgcctaaaaataaagtgactggggtcgtttcttcaacgatctctaacgtcccgtgaagaaactcggcagcatggatagatttcgatgggagccagctttgttcttcccaataacacatggcatatgaataaacagctccccattgattccctgctccgataaaataatgcatgctatcacgtcgatgcttttctgcaaatgataagccaaatgcatctgcttttttctctgcttcaactaaccctgttggcaaataatgttcgagctgttcatagtactctgagtaatcttcgaattccccatgcaaatacatcaatcgatctgctaccataaaaaatttgatttgttctgttccgggagctggataagtaaccacaaaatcgcatagttgagacaacttactctccgctttatcgataaatccaatcagtgtcgctcctactttcttgatttcttctactgctttcactacttcttgggttgtcccagtaacagaggacacgacaacgatagaatcttttgttaatcttttattcccagtagtgtaatattctgcagcatgctgtacaaagacaggcaagttgcttttcccattcatataagtgacagcttgcatcgaagaagcatacgttccaccgattcctaaataatagacagcatcgaattttttcgtataaagtttatcgatgattttttctacttgcggacgtaaagctagtgccccttttattgctttgatttgttcttcttcattgaatttcaacatgatttccacctcttataatttacttttcaagactgtatcaaagtcttcaaagatttttttgttcaagtcgattcctttagctgctgcgattttataagcgaatagttgaaatggaacgacaagtgctaatatagacagatattcattacattctattgctaatccaagtgttttttcgtctcttgctttttttgtggtaattgtgagagtctctccaacatactgactcatatatctccgcaacttttgtgaacgttctttattttcattgtcaccttcaataaagaacaacaaatgggaagcatcagcctctagatatgggccatgcatgtaagcttctaactcaaatccttgtgacgggacacggattgtttccgtcaatttcgtttctgcttctttcgctgttccccagtttggaccataaccaatagtgatgaagcgttgtgttaaacgaaacaaactttgatgttcatcaaaaaattcttccgttttttgaataatcactggtaaatgattgattattttgtgtaactgttgcatgtagttttgttctatttctttgctgatattatttttacttatcccaattcctagccctaagagtagtaactgtaagacagtagcagaatagccttttgtaacgaagccaactgtttctatcccagcacctaaatcaataatctgtgtagcttctaaagcaagtggactttgtacgtcatttgtgacagcaataatcggtatttcttgtttttggatcatttttactgcttcaacagtagaagcacttttcccactttgtgacacagcaatcacagtatcgattgatggagaaagttttccataatgagcaaaatgaaaaggttcttgaatatcgacagttagctcgccataagattccaatgccggcttcgctgctaaacaagcgttgtaagaagaacccgttgctagcatcagcagattcgttgtttttttcatttgttttcttgtcgaaaaatcattctttttcaagatcgtacttagtacttccttttcttcataaatataatcttgcatcgtaaccattttctctgctccttttctaaaaaatccctatccacgaaccaaaaatcccaaagaaagctagtccgatcaaaatcgttaatggttttacttcttttttcaatagataaaacactacaccaaatgcacccagacataagatatttgggacaatatcatcaaaaatactttgaacagtcacagcattttctcctgaaccgatttttaaaggaatattgatggtaatcatcgtggcagtcattgctccgacgaccatcaacccaatgatagacgcgcctaatgtcaaactttccatcatcccgtttgcctgaatctttttcaaaaaacccgttcctaagcgataaccccaacctgttgctagatagcggaacagaatgtgcggaatattgaaaatcaaaatgaacaagataggtcctaaaatatttccttgcatggctaaagaggtgcccacacctgtggcaatcaatcgcaaagttccccaaaagaaagaatcccctaaccctgcaaggggtcccatcaaagatgttttgatactgtcgatcgcggtcacatcaaattcaggatcatccttattttcttcctccattgcagccgtgatccctaaaatcaatgtaacgatatgtggggtcgtgttgaaaaactctagatgccgtttcaaagctgctgccatttcttctttcgactgatataactttttcaaaatcggaatcattgcgtaaacataagccatattcatctgtcgttcatagttccaagaaaactccatttgaaaagaacgccagaatacatgattcagttcttttttcgttattttgctatttttactctcagaattcttcatcttcttcgacctcccctacagtggtttgaagtggcagttgacggacattcatgatattgactaccacaacggctaaaattgcaccaaaaatagctactccggtcacaggaatctttaagtaagaagctatagcgaaacctaagaaaaagtatggtgcaacttgtttgttaatcagcaagcgagcgagcatcgcgaaaccaagagctggaatcaaccctgtagctactgacaagccattctgaacgaagtcaggaatcttattgagtagattcccgatcgtattgcttcccaccatatacgaaaccattactacaacaccaagcatcaaggaaagaccgaacccggcaagcaagtgcatatgctcgactcctttatagtttccttcttctgcataactgtccgctttatggttcataattggaatcaaaagacctaagtaaatatttttcaatatcaatgtcaacgtagcaattggtaaacctagtaaaagtgccgtttccgtaccagctccagctgtgatagcaaaagccgtgcctaaaattcctccggtcaccacatcaggggggatcgaagcacctactgagaatgatccgataaatgctaactccaaagtggcgcccatgatgatcccagtttttacatcacccaacacgattcctgtaaacagtcccgtcacaattggacgagaaagcagtgatgtccctaatgcatattctgattgtgcgataaatgcaacgattcctaataagactgcttgtacaatcattgagtttcttcctttcttacaaaacttcccttacgtccacttttttatctgccggtacttgacggatctccacttctatttgtttgtcaatcaatcttttcaatcgttcctcctcttctggtaaaatattcaccgcttttccaatactgcgagtaccaggtttcgccttgattcctcctaagttgatggttttgatttctggatacgcttctgccagcttatatgcgtcctcgattgattccactacgatgaatagcttatatttatctgtcaccccgcttttcaatgcggcaatcgagtcatcaatggatttgattactagtttgactccttgcggcttggctaatttgatcgttgtctttcgtatctcattagtaggcacatcatcattcgcaatcaaaatacaatctgcacctattgtttgtgtccaagaaaaagctacttgtccgtgtaataaccgatggtcaactcttgtcaatacaatcattcttcttcctcctaaaattcatcttcttctatttcctgattgatccgttcgttacaaaactggatcattttttttgaatcagttagcacctgctggatcaaaacagttgtctgtacttcagcgtccaaccgagatactagctcaatcaagagtggcaaattcaatccggcaacaagatagacatgatcctgattgatatattgtaagaattcattgttgacacttccgccaaaaagatccgtcagaacaatgatttctttatctttgtacctcataaacagctgacttactgattccgttaaatcaaaattctcatcagtatagcagtccaatgcagtaatagaatgatttttcccatagattagctctaatgaatctagtatccctgaagcaaatttaccatgggaagctaagataatttctctgtccactttttcatctcctctttttacttacacatactaaaaaagcaagttgtgtgccaaagttagtggccacaacttgcttatgttcaaaattcttctatcgagagtaactctgtactttcactcaaaatatcacagatataggcaatctcagaacgagggatcatgacactataatgctcttcaatgacactaaatgcagatttaatggcaaatatctcttctttttgacactgttcccatttctctaatccttgataggtttcaattggcatttgtcgaatcaaacgttcgattagacaactcacatggacatataacgctagttttttgggattactgattcttcgattcaactgcacctctaattctcgcataaaatgatcgatttcctccatcaccttttctgtatctagaatagtcacagagtccagtactttctccaatgaaaaattgcgaatgatgttctggttgaatgtttccttatctgaaacattcatagcagaatccaaccattctgccagtacagacatcttctctcctgagatgaggtcttctaatgaaagatagtcgatatcggtgatagcaggatctgcggtacctatgatccctacgatttcgtatatggaaaacagtggatccctgtttttcttatcttttaatcgctgatattcatatgggatgattttcaactgacaagtcgtaggcaagcttttctctagcagtgcacttaggtgagccgccgtgccgattccagtgaagcaggtagtaatgagtgctttgggtttattttcttgtggatagaggagccgccattctggtttggtttgacgaacagcctcttctgctatttcttctaatgctgcatttttttgcaagcattcccctactgtgatggctaaaggtgtcgtcacattatttaaaatcaaaagtggtacagatagttgttttttaaaaaactgatggatttctttcagagatcccatatctactaatatgatcaatccatttgaaacatcgctgttttcgcaataatccacaatttctgaagcaatctgctgtggagtgacatctagcggcatatcaaatgattcaaatagatcttcttgtaataaacgattgaccacatttgccatactgctagcagttgcataaccgtgcgcagcaatcattgcttttggcagtcgtttttcttttgaccattttgctttttttagatagatcgtcagtaaaatccgatccatactagtgacttcaatatctaatttaatcttactcagttccaagattcgctggacataatgatagctagatggataagattgagaaacctgtttttctaattctttgattagttggataatcgcatgttcttccggtaaccatttgacagtgcttcgctgataaagatagtaactcaaggcatagacactgtttccatcgaacttgatttgataggcagactccatttgtcgaaaggtctcacggatagattgagtccaataaaccaacagctcgtgtttttcttgtctactggtctcaaacagcaaaaaatcaaataattggatcacttcttgttttagttttccttcgcaagaatatagaagacactcattttttttgaaatcaagcaggatctgctcaaaacttttaacgattcgttgctgttctggttgttgcttttccatcaattgttctaaggtctggtcttgcgtgatatagattccttgctgtgctgtatttttggtaatgggctcagcgagtagttctttttgcaaatgatggatggtgacatggatctccgactgttcacgttgttcagcatacgcttttgccgctgaaactttgacaatatttttcagctctcctatgtttccagataagttttgacctgctagaagtgacaaaactgggccactgactgacaaagggctccccatttttctttgttcctcgataaaaaaagagtaaaccagttctagccgttcatttcgactacgctgattgagtgcaggtagttcgattcggataggtattcttcgaatgaaagtggttaagaaatgactagtggtctcctctgttgtggcaaaaaaaagacgtgttttgatccgccgtgacacattaggttctcccatacgataaatcacaccttgatcaagataggtgaatagtttttcctgcccttctggtgttaagcgatgtacctcgtctaaaaacaagattccaccatctgctgcttcgaaagccccttttttattttcttctgctccagtgtaagctcctttgacatgtccaaacaaattgctagtcaacagttcaggattatctgcatattgtgcacaattgaaagtgatgaatggtgcagagtcctctagtaaatcatgaagtagacaatactgatagactaaatggactaaataacttttacctgtgccgctttcgcctgtgatcaaaagtggcagtccgccatctggatagtaaagagctgttttgatttgttcgatactttctttcaaactggcgtcgtgtccgatcataaaagagaataaatcttttggttgtgcgaaaaaaggctgttcttctttaagttcattgatagaaaaataaaaattcgtacgtaactgaaaaaattgtttttcaaaagcttctttgtggaaataaaccactggacgagaattgattttgactagtagtttctcctcattcaactggttcaaataatgactgactgtgtttctttttaccccaaaatgttcagccaatctttgtgctgtaaagacctcgttcatatggttgagatcgaaaaaggctgtctggttctctaagtagcataaaatttcgttttttaacaacttattcacccctactccatcatagaaaacggattcattttgtcaataaaatctttaataaagagttgaaaaatatgtcttgttatagacagcagcttacttatcccttataatttttattctaaaaacgaacagttccttccggtttttatactggaatttccaaacaataaagaaagaacaaggaggctatgactattcaatgaaatcggataaatctaaaaagaggaagtatacttcttggaaaacttttcgcgaaatcatcggatcttatctcgctgtggttgtgtttttacctttgctttatatggctatgacagaacaaacccgttttatcgatgtagatacgcaatatatagccgaaacaggatttttatttatctttatcttgatttttgcgttctataaatccttccacacaaaataggaggcacagctctcaatttttctgtctgctttttgttattacaaatccttatatctggtataacaacaatttattggcgtaacgaggaaaaacgagttatgatgctttcagagagtaaagaggtactgttgtcaccatcctttttattgattacgtacaccactcttagttttttcccattgattaagaaaacaaggtagaaacatcactgttcctgccttgttttctttttcgtgtgctgttttgatatcaaaatcgcaaacggctttctacatagcgatattgataatgagaggttgtattcgttacaccaaacttaatagaagcgtttcttcctactccgatgttcacccctgcattccaagttgttgaaccattattgaagaagtcgccatttacaatgtaaaaaatacggttagcatcttctaaatgaacataaacagttccaccaaattgtttcgacaaaccattatatccgcggatcatttcaactcgtaggattcttttgatagccctaaaatttccactttcactggtctcgcaataaaagcgcatcgtgggtctataactagcattgactgtgaaagattgcgataatgttctgtatgttgctcttgctgtacgtgcttgtcttgcactttcatctgtgaatccaagctcttgttgtgcttgggtaatagggatgccgttttcttttgctacttctcgcaccatttcatcaaaagtgagtacggaacttatgtttatctctttcttttcatttgatatgtcgatcaatgatgcatccacttctacagcaaacacaggctgtccgatattacttccccccctaaagttgccacacataataaaccaatcaacgattttttcaatctcatatcccttctttcaacattaattagctttcccacaaacaatttgttacaataactttacagtataaaatgaaaacgatttcaacaactttaaaaaaaggagaataaactatgaaaacaaagcttttattagatttaataacatcgttacttttaattttttcgccaaaaataacgttggtttttatggaaaatgaagcttcgccctctccattttatgagattttattcattactaagatcatttgctttatactcgctgttttttacttaaatcatggaatcactacttttttattttcaaaaaataaatagcgctccattgatgattctgtacctgatccaccttttgcacacgattcatttataaaaaaatcggacaaaatagacgtttggaggaacgaagagaccgggatgaatttcccgttctctttctttttttctaaaaaatactctattcaatctctaaaatctcttcataataaaactttcatttatgaaaaggcttgttctcttttcattctaaatttcctaagctacaatgtggtagtacttgttttttcaactgtagacaaataaataataggaggaatcatatgattcagttattacgttatgcaaaagattatcgtaagcaaatcattttgggtccgttcttcaagtttcttgaggctgtcttcgaacttgtcctacctttaatgatggcttccttgatcgataatggactaaaaatgaatgaccgaggaaaaatcattgaaatgggcttatggatggtcgctatgtctgtgattggtctgatttgtgctatcatttgccaatactacgcttcagtagcttcacaaggatttggtacagagttgcgaaatcagctgatcaaaaaaatcaatactttctctcacaacgagttgaatcattttggaacagataccttgatcactcgaatgacaaacgacatcaatcagcttcaactagctttagcaatggtcattcgtttattgattagagcaccatttttaagcatcggttcagtagtcatggcttttgtgatcgactgggaagtaggtctgtttttcttagcattattgcctattttctccatcattttattttttatcatcagaaaaactgttcctctctatcaaaaagtgcaagaaaaactagaccagctcaatgaacacgtcagccagaatcttagcggcgttcgtgtcatacgtgcatttgcacagacaaaaaaagaaacagaaaagtttgataaaagcacaaatgatctagcgaacaattatttacgtgtttccaatatctctgcccttttatcacctgctacgaccttgatcatgaatgtcggaatcatttgtttgctaacagtcggcgggatcaaagtaaacattgggagtttgcaacaaggacaagttcttgctttgatcaattatatgaatcaaatgcttttggcactgatcgttgtttcaaacctcgtcgtgatcttcacacgtgccgaagcttcaggtaatcgagtaaaagaggttctagacacagagaattcgattcttgaagccgagatcagtactactcccgatttttcttctgaatcgattctcgcttttgatcacgttgacttccgttatactcctgattctgggctttctcttcaagggattacatttcagctgaagcgaaatacggtccttggaatcattggtccaacgggaagcgggaaaacgactttgactcaattgattccgcgcttctatgatgtcagttccggtacagtcataatggatggaatggacgttcgatcttggcagctggatcatcttcgtcagcaaatcgcccttgttccccaaacttccgtgttatttactggtactattcgtgaaaaccttcaatggggtaagcaagatgccacagaagatgagtgttgggaagccctgaaaatcgctcaggcagaagaatttgtacgtcagcttccaaatggtttagatacaaaagtcatggaaaacggaaaaaatttctccggcggtcaaaaacagcgactaacgattgcaagagctttgattgccaagccagaattactgattttagatgactctttgagtgcgttggattatcagactgacttggatttgcgtaaggcgctgcaaacttatcttggcagtacagtgatcattatctcccaacgtgtccgctccattcaagaagcacaccatatcttagtgatggatcaaggaaagatcgctgctcaaggtacgcatgaagaattacttgctcaatcagcggaatatcaggaaatcgtcgcatcacaggaggaagaatagttatgaaagtaaaaaaattatccttgcagacactccgtcgcttcatcccttatcttactgcttatgcgaaagacatttggctagctgtattactagggattatcaacgggatcgcaacagttgtgatgacgttacaaattggccaaagtatcgatcaaatgatcggagaaggacaagttcgcttcaatcgactattccatttactgattctgttcggtggaatcgttttgatcaatgtagtcagtcaatggctcatccaagtattaagcaatcggttagcttacttgtccgttgcaacattaagaaaagatgcttttgcccatttaaatcgattgccacttcgttattatgatcaaaattctcatggaaatatcgtcagtcgatttacaaatgatatggacaacatttctattgcgatttctgcagccttcaatcaattgttttccggagttgcgattatccttctttcgtttatttttatgatgcgtctaagtccacttctgacattggtcgttctttgttccacaccgattattttccttgtgagttggatcgttgctcgtgcttcgcaaacaaatttcgatagacagcaaagaatcattggggagatttcgggctttgtgaccgaacgaatcggtaatcagaaaatcgtgaaagcttttcagcaagaagaagctagtcaacagcaatttgaactgttaaatgctgatctatatcaaaaaggacaacgggcacaattttcttcttccttgacaaacccgtcttctcgttttgtagatcaccttgcttatttatcgattggtttggttggcggcctattggcatcgaagagtggttcgtcaatcactgttggtgtgatttccagctttacgatctactcaagtcagttttctaaaccatttatcgaactttctggaatcacgacacaactgcaaaccgctttttctggtctagaacgagcatttgatttgatcgatcaaccagaagaaacgcctgatttgccagatgcctatgccttggaacccaaaaatatcaaaggaaaagtctcttttgatcatgtttctttttcttatgaccccaaacagcgtttgatcgaagatttcaattttactgcttatccaggtcaaaccattgctatagtaggaaaaacaggagccggaaaatccacacttgttaatttgctgatgcgtttttatgacacaacaaaaggaacgattacaatcgatgaccatgacatccgctctatccaacgtgatacattacgtaaaagttttggaatggtgttacaagatacttggctatttgacagtacattgcgagaaaatcttcgttttgggaatccggaagcaagtgacgcagaaatcaatgatgccctaaaagcttcttatatgtatgaatttgttgaacgtttgccggaaaaattagatactaagattggcggtcaagggttaaagatatcagatggacaacgccaactgttgacgattgctcgaacgatgatcagtaatccgcctatgctgatcttagatgaggctactagctcagtcgatacattgacagagaaaaaaatccaacaagccttcttagcaatgatggaaggtaaaaccagttttgttattgcccatcgcctctccacaatcaaaaatgcggaccagatattagtgatggatcagggagccattgtcgaaatgggcacccatgatgagttgcttcaaaaagatggttattaccgacgactctatcaagcacaattcacagcacaataaaaacaagcagtcttctgggatgggaagactgcttgttttttatttagcgtggatcgctaaacttcttaaaatttttttgtaaggaatactacgtcctacgtaataaatggcaattgattgaatcggtaaccatatcactgtttttaacaggcggggcgcccaaacgacccagctgaacaatggcacatggtacatcaacgcaagccataatggtgtcaaaaataagtttatgatcagtgtgacactaagcgtagccaaaatcgcatttttccaagtgatttcttttcgatagaaaaagaatccgtagattgctccttcaataaatgcattcaatgtaaatccaataaaaaatgtagattttgagaagagagccattcctactaaatcagctaaaactgcgcctatccctgaccaaaaaggaccaaaaagaatgcccatgatcacttgtggaataaatgtgacactgattttaataaatggggtctcgattgctaccagacgggacaacgtgaccatcaatgcaatcagtaagcccataatagcaatcatacgtgcgtctaaccggtgtttcttcatttttagcatctcctttaagagctgctacatcgtatcatgcagcgaatgcgaaaataaaaccgcgaacattacgtccttcgtccaagaggcaacatcccatcctcttagcacttaacgctttattttctactctgtattatttttgggatcttttcccacagaaactatagcatattttcacatttactgcaaacacgaaaaactaatattattggttatattatacaatacgttcgtattatattgcatattttcagtttgtttagcttttatagctacatatagacgaacattaaacgttatttttccatacacttgtccatcaaaatgaaagtggacgtttgtctatttcatggacgattcttcgaaaatctaggaagccggcttccagtcctcttagcagcacctcagctgttccgatattcgtagccaacggaatctcataaacgtcagataaacggataagtgctgttacatctggttcatgcggctgtgcagccaacgggtctcgaagaaaaatcaccaaatctaactggtcctccgagatcattgctccaatttgctgatctccgcctaacggtccggatttaaaccgatgaatgggcaagccggtcgcttccgtgatacgttgtccagtcgtcccggtagcaaaaagttcatgtttttccaatattgttttatacgctgttgctaatttcaccatcatagatttttttcggtcatgagcgatcaaagcgattttcataagagacactccttttgatatggttaacatacttatttactccagtgtatcagtttttatttcttatggatatttattgaagcctaaaactagcacattgacaaaaaaaagaaaaaattcttgttcaacatgacattgaacttagttaacgctttcatttatactttaatcagttaataaaactaaaaaagaaagtgtggaacgtattatggtagaaatggctctgaaaaacgtatataaaaaatatgataatgcagaaaattattctgtgactgattttaatctatcaatcaaagaccgtgaatttatcgtttttgttggtccttccggttgtggaaagtcaactactttgcgaatgattgcgggactggaagatatctctgaaggagaactaaatattggcggaaaagtcatgaatgacgtggcacctaaagaccgtgatattgccatggttttccaaaactatgcattgtatcctcacatgactgtttatgataatatggcttttggtttgaaattacgtaaatatgataaagcagacattaaaaagcgtgtggacaatgcagcagagatcctcggactgacagaatacttgaaacgaaaaccagctgctttatctggtggacaacgacaacgtgtagcattaggacgtgcaatcgttcgggatgccaaagtcttcttgatggatgaaccattgtcaaacttagatgctaaattacgtgtagccatgcgtgctgagattgccaaacttcaccaacgtcttgaaacaacgacaatctatgttactcatgatcagacagaagcgatgactatggctgaccgaatcgttatcatgaaagacggatttatccagcaaatcggtacaccgaaagaagtttatgatacaccagtcaatatgttcgttgccggctttattggatctcctgccatgaacttctttaatgtgacattgaaaaacggtgtcatcacagatggacatgggcttaagcttcgtattcctgaagggaaaaacaaagtattagtcgaaaaaggttatgaaggaaaagaagtcatcttcggcattcgtccagaagacatccacagtgaacaagtagcccttgaagcttcacctgaagccgtagtcaaatcagaagttgtcgtttccgaattacttggagctgaaacgatgctttacacaaaaactggttctactgagttcatctcaaaagtagatgcaagagatttccataaaccaggcgaaatagtcgatcttgccttcaacatcagcaaaggccacttctttgataaagaaacagaacaagtcatcaaacttccataaattgccccctgttagagctgtgccagaagatgttggtgcagctctttttaggacaaaaaactctcctcttagaggatttattatccgttagcagatgagagttttttttgagaaatcatgtctaatatgtcgttttcttcgcgtacccttgaatcgattctttccgatttcctttttttgctgccgtaaataccgggatatcaaaatatttgctgagtgttcttgctataaaataagcaatattataatcaaccaaactgtggatgagtccaccaattcccatcaagatgaacactgtataaaaatacccttgagagtaatacgtgtcaggcatattaccgatgaagtaaaagatgctgactactagcatttctactaaagaatgaatcacacctatcacaaaattgaacccttgaaaacgccaattagtaaaagtaaactgtccattctttaaaacgatactcggatgcttctgcaagtaccatgccccaatcaatgcaaatacaagatgtgacaatgcgcgcaatgcaatgataactggcgttgtcaaaaagaaaccgaatgtcgtacctagcgcaacagccactgcaactcctggtgtaaaaaacatcgcaataaataatggcacatgagacgctaatgtaaaagaagcaggtggaatcatgattttaggcataaccattgggataatgacccccatcccaatcaataaagcagaaatcgttagttttcgaactgaattttttctcattttttctctctcctaatatgtcttgacacttaaatgtcgacttagtataacttacttactaataactgtcaagacacatattcttttctaaatccatacaaaatgagtgtgagtatcaagtataagaatttttgatcaagagacaaaaataggagatgtgacaaaatttgtgtcacatctccttgttcataataggaatcaaaagcttgcctcagcggcgataagaccaaccaaatcaaaaataggagaagctattttttgaaattgctccttgtacctcagagttaaatggcaggctcacaacctctttttttactgcttattttctgacatcgcattgcttaatgcggcaaattcttgtaatgacaacgtctctccacgacgttttggatcgattccagccgtttccaagctttgtgctaaccatgtttttgtctgatcatctttgccatacgaatgctgcaaattattccaaagcgtttttcttctttgctgaaatgcagcttttgtcaatcggaaaaatgctttttcgtccgtcacttctactgccggtgtatctcttcttgtcagtttcaaaatcgctgaatctacatttggctgagggacaaatactgtttttggtacgatgaaggctaaactggcttccatataatattgaacagcaatcgataatgaaccgtatgctttcgttcctggttcagcagagattcgatcagctacttctttttgcatcatgacgactaattcatctacgaccaaatccgattcaagaaaatgcatcatgatgggcgtcgtaatataataaggtaaatttgctacgacttttaacggaagctcttcatgaaatgtttctcttacggctgttgataaatccgtcttcagaatatcttgatgtatgatggtcacattgtcatagggttgcatcgtatcagccaatacagggatcaaacgatcatcaatctcaaatgctacgacttgctttgcatgcatcgctaattgttctgtcaatgcaccgattcctggcccaacttcgatcacgttcgttcgttcatctatttgcgcagtttctacgatttttcttaaaatatttggttcagtgagaaaattttgtcctaaactttttttaaatgaaaaaccatgtttcaataaaatctcttttgttctagagggtgtcgcgatttcacgatattcactcatgttgttcctccactattttcattgcttgtgcgagctctttcggcgtgatacgaaacatcttcaaacgtttttccaattgtttgccattcgtataaccgatacgcaactcatcacctagtttttctcgtttttcttttgcttgtgctccagctattaaaccatagtctaaaaggtcttgtctagtgatttcagaaacagccgtttgggaaatatctggcgtcacaacctttttcaatgcttctaaaatagcagcatcacttgcatgctcaacaccaagacttccctttttctttggtttagcttgtgtacgcggtaaaaaagcatgttttgcttggggaacagcttccataatgatttttcttattttttctcctgaaaaatcagggtcggtaaaaacgatcacccctcgagtctcttgggcatgttcaatttgcatcaggatatcttcattgatagcagaaccaatcgtttctatcgtatctgcatcaactacttcccgaagccttcttgtatcgtcttttccttcaacgactataatctcttgaatcttcatcttatccatgttcgcttagaccaaataatcggtgcgcatttgaccatgtttgggcagccacttcttctgttggcagattccgaagttcagcaatcttttctactgtataacgagtatagcctggttcatttcgctttcctctaaaaggaactggtgccagataaggggcatctgtttccacaagtaatcgttcgattggtacatttgttgcagcctcttggacgtctaatgcttttttgaaagtgacgacaccgctaaatgatatatgcatccctaagtcaagaaatcgttttgcccattcataatcaccgctgaaactatgcatgattccaccaatatctcgaacatcttcttcttttaggatttgatacgtgtcttcaagtgcttctctagtatggatactgattggaaggttcatttcttttgcgatagcaatctgtctgcgaaatactttatcttggacttctttcgggtcttccatccaatgataatccaagccaatttcccctaatgctacaacctttggcaaagtcaattgttcttgtaatttattttcgatttctttcgtataactgccagcctctgtcggatgccagccgataatactgtaaatatttggatagtcatggcttaattgcaaagacttttcaatcgttggcgtatcgaagcccacgaccgccattttcgttacccccatttcttgtgctcgctgaatcgtttctggaatatcttcattgaactgctcagcatttaaatgggtatgagaatcaaatatcatgtttatctctccttttcattcttactttagcacataagcactgcttgcagaagtagcaaaaatcaaaatagaagaacttgttttgttgaaatagaaaaagcacgaagatccagaggacttagttcgtactttttctgtctgttgttgaaatattttactcttctgagcgttttttctttttttgataatagactggaataccaatcaaggtaacacctataccgatcaatgctaatttcgtttgcgtcatcatcgtcatacctaaaatgaaaatagcaccgagaatcgcaataatcggaacgattggataaagtggtactttatatgggcgtggcaattccggcgctttttttcttaaaataaagacaccgataaaaatcagtaaactgaatagccacatcacaaaaatcaacatgtcggttaaaaagtcgaaagaaccaaggctcatcataatacaagctactgctaactggaaaatcgcaggaacataaggtaccgtaaatttctttgaaagctttgtcagctgtttgctgaaaggtagctcgtcttccaaagccatcgcataaggcacacgaatcccagttaaggtatacccattcaatgccccgtataccgaaatcaaaatcccaatagtgaccagttttccgccgatttctccaaaaatgacgtctgatgcttcagaagctgcgttcaaattaccggcaagatgatcaatcggcagagttttcaagaaaacaaaattgatcaataaataaacgacagtgacaaaactcagccctagtataatcgctttaggcaaatctttttccggccgtttcatttcaccagccattgcgccgacgcctaaccagccgtcataagcaaacaatgtcgctagcaacgcactgctcaagccttcgacaaaagtaacctcttttccagcttcgattggaaatagctgaacagttccttgtcctggtgtcaataatccccatacgacaatcacggcaattggtatcaatttaacaatcagcgtcactgattgtacagacgcaccgacttttgttcctaataaattcaatcctgtcacagaaacagcggtaatcactgcaatcaacaaaagatagtcggtagataattgtaataagttcgtcaattgtgtcgcaaagataatcgataatgcagcaatattagcggggaaataaatcaagctttgcgcccaccctaataaaaagctgggcagctttccataagctgcttcaatatatttgacagctccaccagtttctgggatcgctgtagctaattcagccactgtcaatccagcacagatcgttaagaaaccacccaaaagccaagctagtaatgtcaaacttgtagactgcgtgcttgcagtaacagcagcggttttaaagaagacccctgcgccgatcacggttcccataacggtagctaatgcgccaaacagattgatttctcgttttagtttgcctttcattcccatcctctttcttctttgaaatttggtataattttcagtataactgagaatattttaatttaccattcttttttctccactttcaatgaaaaactccctcttaagacggatgtatttcctctttattttgcgtatactaaacctaccttttccacgaaggaggaacagtttatggattttaagcgttcttatccgaaattagcagattatttatccaaccgaatcgatttttctcgtaaagaacagcagcagtcccgttggcattggttcacgttgattttatttggattattgaccattgcgacattatcacaaaaattgatattgctgacggtgttcatcgcaattgttgcattgatcaaaggtcccgtgatgattttgtgggggatgttgtattcctttctagtggggctattcccacctatcggtattttgctttcagcgattttctttttgttgaacattggaacatttacaaagaattggcggatgaccttagtaggaatctatttttatttttatcccttcggagtgatggcacttcgtgaaatcatgcattggaataatcattggttttcagctggtgccttgcttttaggattgatcttgcttcatgtgatgttgacgaaactgtatcagcgttatggtattggaagaacgattttctggtacgtcttttcgattccatttgcactgcttactgctctcttgccaagccgtttgaagacaaaaataaaaggttatcataaaatcaaataataggatttttacaaaataaagaaaacaatcatcgattttgacctcgatgattgttttctttattttgaatactattagtagatgtaaacaaattattgctttcaaaatccttggatgtaagagacaataaaataaaaaggagtacccagatgaatcaattaaaaaccgcccgtccacttatcattatgttgcttctttctgtctttacgattcctattagcctttttcttaattggcagacagatgaaagaatcacaaatattttattcaactattcgcagccactttttcttttgtttttaggaagctgcagattccatcggtgggtaaagctcgtccttctttttataggatacattttatatggttatatgtgtctttattatatgattggcttccataatcaccattggggcaattgacaggaataaaaaaaactcgcaagcagcattgtcttgcgagtttttcttatgattttatgcgatctctgagccattcggcatggattttggtgcttcaatcacttgtaaagagccatctggtgcttctgcggaaaggatcattccttgactgatctgtccacgcatctttcgtggtttcagatttgcgacgatcactacttttttcccaatcagttcgcttggatcaggatagaattcagcgattcctgacaaaatttgacgatcttggctgtctccagcatctagtcggaattgcaacaacttatctgccccttctactttttggcagttgatgacttctgctacttttagttctactttttcaaatacatcaaatttgatttgtttttctttcgttgaaacaagttctgtttcttctggatcccatttgactgtatcttcgtttgtttgagtaccttcagacattttttcttggataaaagcaacttcttcttccatatccaaacgtgggaagattggtgtaccttttgcaactacttttgttcctgaagggaattcgccaaaatgcaatccttcaagattcatcgtttcagagtccaatcctagttgattgaagatcttctctggcgtttctgtcatgattggttgaagtaaaatcgcggcgatacgcaaggattcagctaaatggatcatgacactattcaattcagctttcttttcttcgtcttttgctaatacccatggttctgtttcgtcaatgtatttgtttgcacgagaaatcagcacccagatttcagctaacgctgtattgaattccattttttccattgcatcatggtaacgtccgacaacgttagcagccgtcgtagacagttcactgtcaaatggagtgacaagtgaggcataatcaggaacgagaccatcacaatatttgttgatcatagcaatcgtacgattcaataagttccctagatcatttgccagatcataattgacacgagaaacaaaatcttctggtgtaaagacgccatctgacccaaatggcacagcacgaagcaaataataacggagtgcatctaaaccataacgttccacaagcatttcaggataaacgacatttccttttgatttagacatttttccatctttcatcaataaccagccatgaccaaatacttttttaggtagaggcaaatcaagagccatcagcatgattggccaataaatcgtatggaagcgaacgatttctttaccgaccatctgaacatctgcaggccagtatttttcgaatagactttcatcctcggacccgtagcctagtgcagtgatgtaattggacaatgcatcgatccatacgtacaccacatgtttcggatcactcttgactggtaccccccaagtaaaggttgttcgtgaaactgcaagatcttctaatcctggtttgataaagttgttgatcatttcatttttacgagattctggttggatgaattcgggatgttcttcatagtattccaacagacgatctgcgtatttgctcatgcggaagaagtaagattcttcttttaccaattctacttcgtgtccgcttggcgctttaccgccgatcacattaccttcatcatctttgtacacttctgcaagttgtgtttctgtaaagaattcttcgtcagaaacagagtaccagccttcatattcacctaagtaaatatctccctgttctaataaacgatcaaatattttttgaacagctgctttatggtaatcatctgtcgtacgaatgaatttgtcataactgatatcaagcgttttccataattttttgacatcagccgccattttatctacgtattcttgcggttttacacctaattcttctgcttttgtttcgattttttgaccatgttcatccactccagtgagataaaacacatcaaagcccatcaaccgtttataacgagcaattgcgtcacatgcaatcgtagtatatgagttgccgatatgaagtttgccgcttggataatagattggcgtagtgatataaaaagtttccttttctgccacggggctcttcctcctttatcgcatgatgcgaattcgtttccttgctagtataccataaaaaaagcatgctgttagctttttttcaaaatgaaaaagtctggataaatgacttgttctctacgatgactccctccttcaaaaggaaggacagagggaataaatgctatttttcatcttgtttcatgtttagtcggaaacggctttttatttctttcctgactcgtggtataataaagactatctattttagtaagggactggaacgatcatgcagaagaaacatcttttttttacacttagtattgcttttctttcattagcacatttgatattcagctatttttatattcgtatgtatggttattttaaccttcatgggcatttgaacagtttcatgacagtcgcatggcttttacgttttgtcattgacgcatatatcgttatttgcggcttctttgccgttcgtgaagagcggtataaagtattgccgttttatctgcttttctttttattcaatctagtacttccatttatttttcatatttaaggaagaaccaaggatttttcaagtaaatccttggttttttttcagagtctgctacaataaggtaaaaagtacttttaatgtcaacggaggtggtctgatgaaccgatttgcttctaaagaagaagaaaaattatattatgaacatgaagcaagtgaagaagattttcttaactggtatcaaaaacaggaacgtccagaatatgacaagccctctttgactgtcgatatcgtactgatgtgctataacaaagaagaagatcagctgaaagtattgctgatccaaagaaaagggcatccttatcgaaattcatgggcattacctggtggttttgttcaaaaggatgagtcaactggagaaagtgtcttaagagaaacaaaggaagaaactggtgtagttatctctaaagaaaacattgaacaactgcatacattcagcacgcctaatcgagatccgcgcggttgggtcgtcacagtcagctacttagctttcattggagaagaaccgctgatcgccggagacgatgctaaggaagtacgctggttcacattggaacgtcacggcaacaagatcaatttatcgagcggagaagtggctatctcacttgacttagtcactggagagtcttctggcaaagatactttagcttttgaccatagtcaaatcattttgaaagcattcaaccgtgtagtcaataaaatggaacacgaaccgcaagttttgcaagttttaggtaaagatttcacgattacagaagctcgaaaagtatttgcaaagttcttaggaatcgattataaaacgatcgatcattccaattttaagaaagctatgctccaatatttcgacgagattggcgaacgtcctgtaggaatcggtcgcccttcaaaaatctatcagctcaagccgggacatcatgagtaagaattgtgaagaaagggctccgttctgaacactcaagataaatggaaagccgctctttgtgttttgcgtttttcgctccatactttggcatatcagtaaaattcttcgaataaaaaaataacaatagcagaaaaaactcgtacgaattttttctgctattgttttattggtttgtcataattagtgagcttttcttcaaaagaaaattcctagaaacaaaagtcaatcagactttttattaacaaggcgaaccctaacgctcctgtcagtttcattcattttttattccttaatgaccgaatgcctgcctagttgttctaacacttggctctttcttacaaaattgctttcttctgctccgtcggtattgatcaaaagaaattttttattataccattgggacttataacgcaattttgttattaatttatgccagtcatgaatagaaaaatcagcatgtgcatcttcttttggaaaagattctacaaataagtagtcatattgtttgaccaatttcccagataattgttcaagataatcttctcgctggttcttttgtttcagataaagatccattacttttctcttttgtttctgataattgcttgcctgatctaacctggtctttctatggtgagcggagcggacttttacgcttaatttccgctgtgcatgctgaagtttttcttctgtctggtcaaattttggtaaagttacttctatgggatgcgatgtttcgatcaatgtttttggatgataggcaatcccaatccatttagctgacgattctttttttattgatgaaacatcacaaagtagtgcgacatagaactcttcattatatcgagcagaaatcgtagcggaacgaatcgtgccttcgactggacggtgctggtttatcttgattagttctttttgttttggtaattttaagtggccgtttttcagatagaccgtatgagtttgattattcgtcgtataagattgccacatactttttttcgttttaagctttgggaagctggcacgtcccttgaaataattgcgaaaagctcggtccaaattaagctgtgcatttgctaaagcaagactgtctacctcttttaagaatgggtattctttttttaacgtagcaggcgtgagcgaaaaatcgaccactcctgtttgttgccaacttttctgccgttctttcagcaaatggttataggtgaatcgaacacagccaaaagtacggatcaattgctgtttttgttcttctgtcggatacatacggaatttaaaagcttttagcatctatgtccctcctagttagcaaccagaagagattccttttgtcgttttaatttttttgcgtaatatggtacttcctgctcagttgcatagacaaaatgttctggtgcgatttcacgaagctgacgtacttgtccgtcatctggttcgggttgatatttgattcttctgcgctttctctcatgatctggatctggcagaggaatagcagataacaaactttctgtataaggatggacaccgtgattatagatttcatcactttttcccatttctaataacaaaccgttatgcattacaccgattcggtcgctgatatgtttaaccattgataaatcatgcgcaataaatagataggtcaattgatgttctcgttggagatcttgcaataaattgacaacttgggcttggatggaaacatctaatgcagaaatcggttcatcgcaaatgataaatcgcggttttactgctaatgctcgtgcaataccaatacgctggcgctgtccgcctgaaaattcatggggataacgagtgccgtggctcggattcaatccaacggttcttaatagatcatcgacttttttggcacgttcctctggtgatttagctaacccattgacatcaattccttccgcaatgatatctctgactttcatccgaggattcaacgaagcgtatggatcttgaaagatcatctgaacatcatgtcggaatttcgtcaatccttttttgtctttgatcttcgttacatcttgaccgtcgaataatatctcaccgtcagtaggttcattcaaacgaatgatcgttcggccagtagtggattttccgcttccagattcgcctactaaaccaaatgtttctccttcatagatgtgaaagctgatgtcatttacagcatgtacttcattcttttttcctacattgaaatactgtttcagtcctttaacttcaagtagtttatttggcatcagcaattcctccttgaccataagtatgtttttgtttctctttaaaaatagcccagcgacgttggatttctcctggcggcgtcactttaggcgcttgtggagcaagtagccaagttgctgccttgtgtgtttttgatagttcaaaaaatggcggttcttgttctgcatcgattttcatcgcgaattcatttcttgggtagaatgcgtctccttttggtggattcagtaaatccggtggagaaccaggaatggcatacaatcggtcgttcgcactgtctaatgtcggcattgacccaagcagtccccaagtatagggatgttgcgggttgtagaaaatttcttcggatgttccaacttcaacgattcttcccccatacataacagctacacggtcagcaacgttcgctactacaccaaggtcatgagtgataaagatgattgatgtatcgatttttgtctgaatttctttcagtagttccaatatttgtgcttggatagtcacatcaagtgctgttgtaggttcatcagcaatcagaatttccggataacataccagtgcgatcgcaatcacgatccgttggcgttgacctcctgaaaactgatggggataactattgatacgtttctcagcttcaggtataccaactaatttaagcagttctaacgcagctttttgtccctcttttttcgaaactttattatgctttctaagtgactcagcaacttgtttcccaataggcatcgtcggatctaaagaggtcattggatcttggaaaatcattgctatttcttttccgcggattttttgcatctctctttctgtcttttcaacgatgtctttacctttaaaaaggatttgcccagcatctatattggcattgctcgacagcaagcgtatgatgcttctggttgtcactgattttccgcttccagattccccaacgatcgccaatgtttctcctttatttaaatgaaaattgacaccgcgaatcgctcgtacctttccagcatacgtatcaaaagagatttctaagtctttcacttctaaaattttcgtcatcgtcctcactctttcattttaggatcaaaggcatcacgcaatccatcagcaagtaagttaaagccaatcatgataaccgataaagttactgccggaatccataatagataaggcagatacaggaatgtcttgtacccttcgctcaacatcgttcctaatgaagctgacggaggcgtaagacctaaaccgataaaacttaaaaaggcttcgaagaaaatagcagatgggatgctaaacatcatttgaataataatgacactggagatattcggcaaaatatgtttgaatgcaattttcattcttgactcacctaatgtcaatccagctagaacatattcttgatcttttaatttcattgtttgtgcacgaacgatacgtgccattggtatccagtttgtgatggccatagcagccacgatggaaaaaattcctggttcgaagacgaccaacatcaaaatcatgacaacgaggtttggaattcctgacaagatttccaaaaaacgttgcatcgcattatcgacacgtccgcctaacaaaccagatattaacccgtaagctaccccaatcgttacatctagtaatgcagcaataaatgcgatcagcaacgagattctcgttcccataaataaacggcttaatacatcacggcccaaaccgtctgttcctaaaaagaaacttacgtttgaaggaacgtttgcttgagcatatttatcaaccagttctccgccgaccattgcttttccattcaatccatcgatattgattcccggaatacgaggaggcaaattgatataagccacgttttgggcagttggatcatgtggcgaaacaaagatcgtgaccacagagatcaaaatgatgaccaacagtaaaaacattgaaataacggcagctttgtttttctttaaacggcgccatgaatcttggataaaattcaaagaaggtgcagtaatctgctcacgttcttcttcggtatttttttgtaatggaagaaactcatccgcaggaatatctgcgactgtttcataacgcttgggtgtcatttccatttatcctcggctcccttctgaaacacgaattcttggatcaactagaccgtacagcagatcaacgatcaaaataacaaaaatcaacataaatgagtaaagaatcgttacagccatgatcgtaggataatcatttgttgtgatcgacttaacgaattgttcaccgataccaggaatagcaaagatattttctaccaccagtgatccggtcatcaatgcgacagccaagggtcctaataaagtcatcaatgggatcaaactatttcgaagaccatgtttaaaggcgatttcccaacggctcaatccttttgcttttgctaattccacgtaatcactatgcagtacttccaccatttccgtccggataaatcgagcagaatcagcaagcggcgacatggccaatgcaattgtcggcaagatcgtgtacacaaatccatcccattttgcgattggtaaaacttgtaatttgattgcaaagatatattgtagtaaaacagcaaatacaaagtttggaatggaacgacctaatattgctacaagtgtagaagatgtatctgcccatgtattttgcttcatggcagaaatcgttcctaaaatcgttcctaggactgttccaaagataattgcctgtaaccctaattgcaaagacggtccgattcttccagctaacaaatgtgcgactggctggtttttaaattggaaggaaattccaaaatctccttgaagcaaattagaaagataaatcccatattgtacgataactggtttatccaaaccgacttgtttatttagcatctcgattgtttcaggactcaaacgttcctgattcgtatatggcgtgcccggcagcaattgcatcaagaaaaaggtgattgttgcaattaaccaaagcgtgatgatcatgaaaaagacacgttttaatacatatttgatataactattcactaatgtttccccctagcttttgacttctgacagatgtttcgctacattattagataatgaaccaaaaataaaggagcaatcaaatgaaaaaaaaatctatcccctacgcagtagcttttctactgattctggttattttaataaaaaacgtcatcaaccattcctttacactcattcaattatctaatgatctattcttatggtcattgccgtttctgattatcggcggttttttatgggtcttttcttcgggtttcttcgatcattttcagcgatcggtccatcttgcacgaacaaggaaccgaaagaaaaaaccagaattttcctcgctctcgtctgccagctacggtatgtacagcttttggctgatcattgccggaatactaattgctctttctgctattttcatgcttttttctttgttaggataagtgaatatgagaacgaggttgcgacatttgccgcagcctcgttttttctcatgctcacggtattaacgattattcttcaacgtatgtccatttgtaatcccatgaagcgcctgcagcatggtgaacgatacctttgattttttcattcactaggtgaccttctgctttttggtacaccggaacgacacccatatcatcagagatgatcttgattgctttttggaaatcatcccaacgggcttgttcatcgccagcatctgttgatgaagctgctttaactgcttcgtcatattctgcattgctccaacgaccacggttgtatgaattacctgtgacaaacaaatcagtaaagctgcttgggtctgcatagtcagcagcccatccgcctagtactgcgtcaaagtcacccgaagttgagcggtcaagacgcacagagaatggaacaggtgttggtttgactgttacgccatccaagttttcttggattgagttttgaacatattcgattacttttttcgatgaatcatcatcagaagccatcaaatcaaattctaaagaatcaacgcccaattcttttttcgctttttcccaatattcttttgccttatctttgtcataagaaactaattttccagcttcttttgcaaagtcttcgttcgttgttggactttttaccatatctgatgggatcaatcctgtagagacaactgatccgtcacctagtacttgttttactaaagcttcacgatcgattgaataagaaatagcttttcttaggttcacattgttgaatggtgaattcttttcacgttggttgaattcgatatagcttgtccgtgcttctttaacagaagtataagctggatcgtttgcgttttgctgtgctaattcaccagacaagatcacatcatctgcttggccatctttgaataagttcaacgcagtagaagattcttttactacactgactttgatttcagaaagttttactgtgtctttgtcccagtaatggtcatttttcttataagtccattctgtatctgttcctggtccatcgaaatcttctaatgtgaatggtccattataaacagctttatcacttgcagatgcataggcatccccattttcttccactacggattgtttttgtgggaaaaatgatgggaaagcaagcaggtattggaaatatggtgtttgtttcgtcaatttgatttctaattcatagtcgccaactgctttgatccctagttctgatttatctttctttccagctgtgatgtcttctgcgttttcaactggcgcatacaggtaagcatattcagaagctgtagctgggtctactgttcgttgccagccataaacataatccgctgctgtaacaggatcaccgtttgaccattttgcatcttctcgtaatttgattttgtaagttaatccgtcttcactgacttctgccaactcgctagctcctgccggctgtggtttgctgtcttcatcaagacggtaaattccttcataaacgttattcaatgctgtaaaactgattgtatctgttgcaactgataagtcagctgtaggcatttcttgaggcacgactaagttaaatacgcctcctccatctgcagaaccgctttttgctgaactactgcttgtggctgaactgccgccataacatccagcaagtacaaggccgcataccgcaaccaaaccaaatgtaaatttctttttcattttacgtacccctttattggaattttcagaataattaatattttctgaagttgtttaagagtttaatgaataattattaaaaaatcaacactttttttttgtcttttacataaaataatgattttttcgtgaggtttcaaggaatttttcagaaaaaaatagctttgtacaaggttttctattgccttccagtaaccattaaataatttttgttatattgtctattattgccatacaaagataaaaaagaataaaaaaaaggaactgtgacaaaagtcttttcacagttccttatccgaataaacggtgttctcctgccaactcctcggtcacaagtcacaatagacatcaaacatgagaagctgttttttgaaattgttccttgtgactcagagtgaaacggcaagttcccgacctctgggtaaacggtgttcaatcagctgaccctcgatattcgctcaacaaacggcaaaatatgaagaactatttttccgtttgttgagctaatactcaggtcaggacgctgatttcacaacctctttttattattgagaatctggtcgaggaataatcgtttttgccatccaaatatccggtttgtcccaaccatttgcatttggtaagacacctacgattttataacctaatttttcatagaactcatacggatgttcacgaaggttctggatggaagccactttatcaaacgtatgctcatacaggtccgtttgacttaacgttgttccatggtctaaatcatccgtacctaaataaatcgttattcctcctctggaagctacttctttttctaagtaattgactaatcgagtacctatttggttctttcgtcgagagctttctacaactaatggatgcaattcccaacctgtgataccgtattgagggattgcaccaataaatcctactaactcatcttggtctaccgctgctaccgcgattcgttctggattcatcatttcttctacttcttctgccgagctgtctccatattcttccggccaagtcagtctcagtaaatcagaaagctggtctttcaatactggattattacggtcaaattcactgattatcatacgtcttcccccttgttcttgcttattctaacagtccttttgaaaaaacgaaatgttctcgctcaaattctttagcagtcaattatttctctagcaaactaatcggctgccctgcttataaagcaaaaaaaactccagaaatactatttctgctaaggtacacatattctattgcagtacgacctctaaaaaaaatggagggataccttcacggagcatctgtcagttatggtgtactgaccttattgatgatggatcagcagttcgatttgtttgataaaatctatgtgtttatgaaaaaaacaacttccagtatcgttaaccgacatgaatctcaatatcacgaccgatttagaagcaatcttagataaagccatgaccacaaatgatatcaaacatgtgccttatgaaatctcccgagaaaaatttaaacaggccattcttgacgtagaaacttatcatgctacacaagaaagccagcaaggatataagaaaatcagttaaataattgctaaaacccccatcaagcaggctgtcatcaaattgacgacatttctttgcttgatgagggcttttcttgtcaaaaaacgctttataactttcgctatagaatcttttcacttatttaagttggacagttccttaattaataaaactgctccttttatggtaattgaaaaaacgaagcaggctacaattatttggcagctgtttttttcatttgcttgcttcgcaattgtccgcaagctgcatcaatatctgtaccatgttctttacgtatcacacagtttacgccgtttttcttcaatacatcataaaatctcaatacatcagcttttggactgcgagaatattgatcatgttcactgactggattatatggaatcaagttgacatatgctaactttttcttatcttttaatagatctgctaattgttgcgcatgctctggtctatcatttacttgattcaacatgatatattcaaacgtgattcgacggtttgttttctctaaatactcatccacagcttccatcaatttctcaattgggaaacttcggttgatccgcataatcgatgttcgcacctcattattcggcgcgtgcaaggaaatagccagatttacttgcaagccgttattagcgaattccttgattttgtgtgctaagccactagtagaaactgtaatatgtcgcgcaccaatcgccaatcctttggcatcattaataatatgcaaaaagtccattacattgtcgtaattatcaaatggctcaccgattcccattacgacgacatgggaaacacgttcgccaagattgcgctcatcaaaataatgttgaaccatcatgatctgcgcaacgatttctccagcggtcaaatcacggttctttttaagcaacccgcttgcacaaaatgtacagccgatattacatcctacttgtgtggtcacgcaaacggacaagccgtattcttgtctcattagtacggtctcgatcatatttttatcaggaagttcaaacaaatattttactgtaccgtccgaagcttcttggacgaccatttgtttcagaggattgatgataaaatgtgccgataatttttctatcaattgttttgatagattcgtcatttctgtgaagttacttacacgtttttgatacaaccattcccaaacttgggcagctcggaattttttctcaccgttttctataaaccaattgattaattcttcattcgtcaagccatagatggattgtttttccaaagtattttccctctttttctcaaagtttcgctacatactatacatgattcgtttagttaatgcaatacttcacaaataaatcgaatagaactttcatctcataaaaatcaaaaaagacaaaacatcgtaccgtattagaaaagatgggaaaaaagccattttttctcttggtatcatcatgtcttgtcttttttatatagttattcgtttttcaaccgttcattgaacaagttttacatatcattatcttccggcagtggttctgatgtttcctcttgatcaatgaatactttccgaggcttacttccttctgatgggccaacaactccatgagcttccagttcatctacgagtcgagcggctcggttgtaaccgattcgaaatcttctttggagaagggagatacttgctgtttgcatttcaacaacaagtgcttttgcttcctcaaacagctcatcttgtggctgttctggggcacctgccgtttcaacttcatctgtcggcatcattttctcttcataatgagcttcttgctgatctgtaacaaattgaacgatccgctccacttcatggtcagagatgaacgctccttgcacacggataggtttattctcacccattggcaagaacagcatatctcctcgccctaagagcttttctgctccattagagtcgatgatcgtccgagaatctgtaccacttgatacagcaaatgccattctagaaggtacatttgctttgatgatccctgtgataacatccacacttggacgttgagtagctaggatcatgtggatgcccgctgcccgagccatttgcgctaaacgaataatcgcatcttcgacttcgttgctagctaccatcatcaagtcagctaattcatctacgattactacgatgaatggtaaggttggatgtttcgttccgttttctaagtttttctgctgaacaaattcattgtaaccagaaatatttcttacaccagttgccgcaaatttttcatatcgttcttccatttcttgtactactttttgtaaggcttgtgccgcttttctagggttcgttacgaccggcgtcaacagatgaggtatcccgttgtacatatttaattcaaccattttcggatcgatcatcatcagttttacttcatggggcttagcacgcatcaatatacttgtaatgatcccattgattgctactgacttcccactaccagtcgaaccagctacaagtaagtgaggcattttcgaaagatcagccgtttgtactcgtccagaaacatcacgtcctaagggtacttccagtaatttatctggatggtttggctgagcttcgatgatttctctaaaggaaaccatactgatctttccatttggtacttcaataccaatcagtgatttacctgggatcggcgcttccatccgaacatctttcgctgctaaagcaagtgcgatatcatctgttaagttcacgattttacttacttttacccctacagctggttggacttcgaattttgtgacggatgggcctaaactagctttgacgaccttagcatccacaccgaaactttggaaagtttgttccaatacaccgatatttttttcaatttttttatactcatcactttgatccacagttggtatagaatcaagcaagtcaactgtcggcaattcataatcttgattttcctgttctgcttcgatctcaaattctaatgaggtaccgtcatcctctggcaacttattagcataaccttctgctgtattggtctgttttggtgtatctgggactggtttttctagattcgcaggatggatattttcttgaaaactgtcaattggaacaaaacttaactgctcaggttcggcattttcttgttcctgccattcatcaggagtatttttcctttgctggttcacagcttttttcttctcatattctactgcttctttttctgctgcttcttgtgccgctaagcgtctcgcttctttcgcttctgcacgctgtttcattctttcttcctttgccgcttgcttttgagcttgcttggcaggatcaccttccaataattcctgtacccgttctccaattgattggataccattcagcagctgatagccttccaaattactgaacaagaatgctccacccgccagtaatagaatggctactaaataacttccaggctgtgcaatcaagaaataagtgaaatgataaagaattgctccgatcatccctccgccaacgttattatctacttgactttgttttatatcgctagccaataagtcccatgtcgtccccatgatatttggttccccagtatggagtttgccgaataaatgggcatgtagcaataataagataccgaaataaaagagtataccgccaaaccagcgtcggtttttgccaattgaaaactctgtattcttaatgacaatccaaaatcctaatacggctaataaaagacagaggatttggtaagtatttcctgcaatgatccgaaagccgtttgcaatcaatattcctaaaaaacctaattttaaaaagccgaatacagcaaatagaatcaaggcaaatccaacaccaatcgtcagcatttgttcttgctgctgtttttgctttttcgtttttttcgtctttttccttttcttagtaggccgtttcttttgtgccatttattatccctcatttcatcaagtttcattatacaaaaaaaagcaagggaactaaagttttgtttgaaagaactgacgctttctttcatttttcagcttattttacagtttttcttaatttctaaatgattttatcaaaaaaaggcacggccatatccagccgtaccttcttgttttaagcatgagaactaaaggttctctccattttcttcaatcagtttttggtaccagtaataactgtctttcttatatcgttccaaagatccttcttgtgtttcatcttgatcgacatatacaaatccatatcgcttttgataaccgttcagccaactcagcaaatctgtataagaccatgtacaatagcctaatacttctgcgccatccgaaattgcttctttgattgctttgacatggctttgtaagtaatggattcgatagtcgtcatggatttgtttgtcttctgacaacttgtcatattctcctaagccattttccgtgatcagtaccggcatgcggtaacggcttgtgatacgacgcaatccgatccttaagccttctgggtcgatctcccagtcccaatttgttcgttcgacaaatggattctcaacttttttatacattccaggaacccctgtttcttctgatgaaccttttttcccagtcgtattcatttttcctgctccaaccccatctaatggattgaatgcattcgtcgctgtttgatagtaattgatcccaaggaaatctggcttggctgattctagcaattctgcatcgcccgttacaatcgttggcgcccatcctttttcttctaagaatctcatagcagcaataggatatttaccccacatgtagacatccatccaataattggccatcagatcttctgcattttcggctgccagaacattttcaggattactgtcgattggataatttggcgtatacgcaaagcttggtccgatttttccaggcatttctaactcatggaatttgttgatgacagatgcatttgctagatttgcgatatggttgacttcatacattcgttttggatccgtcacgcctggcggatgtgctgctaataaatagcctaatgaagtaaagatattttgttcattcaaactaatccagtaatggactttcccgcggaatgcctcaaataatgtttctgcataattagtgaaatcttcaatgatctgacgtgattcccaaccattatattcatcttgcaatgcttgtggaagatcccaatgatacaaagtcaacataggctcgataccgttttcgatcaattcgtcgatcaatctctcataaaaagcgagccctgcttgattgacttctcctcgtccattaggaaaaatccgtgtccaagctacagagaagcggtaagctttcagaccttgttctttcattaaagcaatatcttctttataacgatgatagtggtctactgccagatcaccgtttgttcctttaaatgtctttcctggaatccgaacaaatcgatcccagactgattcgcctttcccatcttcttgccaagctccttctacttgatacgctgcagatgcagagccccacagaaaatcttttggaaatgaggtaagttctttgtgttccattcatctcttcctttcctataaccttcaatcgttcctcttttagaataacacgaaaccccttccacaacaaaataaaattatgtaaaggaagttgtgaaagaagtggtcagcttcaagaaataagaaggaatttacgaaaattgcttctcaaatttttgtgaaatttcggcttatttttcgaagaaggtacttctggaacaccgtgtataagaggttgtgaaatcagcgctttgtcctgagtattagagaaacaaacggaaaaatagttcctcatattttgccgtttgttgagctaataccgagggtcagctgattgaacaccgtttaagaaagaggttgtgaaaaagtcgcttagtttcgagtattaagaaaaattttgtggaaatggctttctacatttttgcataaattggacttaataccgagaaactggcttttgaacaccgtttaaggaagaggttgtgagcctgccgttcagctccgagtcacaaggagcaatttcaaaaaacagtttctcatgtttgttgaatatcgtgacttgtgaccgaagagttggcaggagaacactgtttattcggaaaaagggactgggacacgtcttttgtcacagtcccctatttgttaatttctcggcgtgacatcttcaccaaaccatttattggagattttttggaattcccctgttttttctaatcgatcaaatgcttcatttattttcttcactaacgtatcatctgacttacgcacaccaaccgcaaaatcctcactttcgtaagagccttttgtcatgttgaagtcttctagttcgtttctttgtttcaaataatagtccgcatatactttatccatcagcaaaccatcaatccgtccgcttttcagatcaatcagtgcttcattaaaactatcgtacaaaacagcatcttggtttttgactctctcttttaacacttctggttgtttcgtaaatacatcataaccagatgacccattttgcgcacctaatctcttatttttcatttgctcaaagcttgtgattcctgattctttaggtgtgatcagcacttgatcattttccatataaggttttgtaaactgcactttcttttctcttgccggtgtcttggaatagccattccagatcaagtcgattgttccattgttcagttcaaattccttcatcgaccagtcaataggctgaaagtctaccgtaatcccatattgttcaaagactgctttggctaaatcaatatcgaatcctgtaagcttcccatctttatctctaaatcccataggaacaaatgtatcgtccaaacctataacgatttttttctcttcgttgatagccgcccaattatctgctgaagcctttttattcgaacagcctgcaaaaagaagaagacctacgagcaaagcgaatagaaaactgatttttttcatctctatcttcttcctttcttaatgaattggggaaacttttaatagttgatcaccgacattttctgcaaatacgagatcatgggtgacaatgatttgggttaccccgtcttctttcaatgataggatcaaacgctcgacttgctgacgcaactcagggtctaaagcactcgttggttcatcataagccaatacccgtggattcatggccaatgctctagcaatcgctacccgttgtttttgtccgccagaaagctgataaggatagttattcaataaatcgctaatccctaatgaagccgctaattcttctgcttttttggtgtattcttcttttgtctgtttcaataccattttcggtgctaaggtaatgttttcaaaaatattcagatgtggaaatagctggaagtcttggaatacgactcctacaacttgttctttcattttaagttcgaatggattgaacggtacaccgtctaaataaaattctccgctgtcagagctttctaagccagccaagatacgtaaaagtgtggttttaccgccaccggaaggacctacgatagctaatgttttcccatctggaatgattagatccaaatctttgattatttctttttcaccaaatgctttgttcactttcttcaattcaatcatacttcttcctcctatcagttagcggtaataatttaattttccttcaacttgtttcattacgattgttagaataccagtcaatgtaagatagatgattgccactcctagcaaaggcagtaaagtcgcgtcgcgttccatcgcgattttcccggcacgcattacatcacccaaacctaatatatagatcaaggaagaatctttgaccaagttgataacttcattacctacagaaggtaaaacaatctttgtcacttgcgggatgacgattttcgttaccgtttggaagggacttaattgcaaaacttgcgctgcttcatattgaccttgaggaatcgattgtatccctccacggaagatctctgcaaaataagcggcatagttcaagataaaagcaatgagcgctgcttcgaatcgatcaaaaacgatcccaatcgtcggcaaaccataaaaaacaaaaatcagctgtaacaatagtggcgttccccgcatgatccatacatatgtttgaagaaagtagcgtagcggcttaaaatgcaaggacaatcctagtgctaaaataatccctaatggcaacgagccaatcaaggtaaataaaaataatttcaatgttgtgagtgctcctactaataattgcggcataacttcaattaaatactccatcttcttttcctcctttaaaataaaaaaatcctcttggcaaatgccaagaggacgtattatacgtggttccacctctgtttattttttccttgcagaaaaaacctcacacagtcgttgcaaatcagatgaaaacaaaacgtcctttgatccgaagatcaaaggacgttaatcacgtggttccacctttttttaccggctcctcacggaaaagccagccttacctggtcatctagcaacgaccgcagctgtaacgggctccccggattttcctactatacgcttcagaaaatcgactccaagatgtgtttcacggttaactgttgtctctttccaccaaccagagactctctaaaaacacctaactgctactcttcttttcgatgtcatttgttttaactttacgtgtaatttacatgattatttttcatttgtcaactcttgtcaactcttttttatgatacactaataaaaaaaggagggtgatgcgcgatgaatcgtgcaaccgaacaagaagcttatgaactactaagaaaactaggtatctcttttcaaaaagttgatcatcctgcgattacgtcagtcaaaaatatccctttttccctacctggtccgcaagtaaaaaatctattattgaaatcaagaaaaggaaaaaaaatctatcttgtcatcttgcctgatgaaaagcatgccgatttaaaacaactagctgaacaattaaaagaaaagcgcttatcttttgtttctgaagaacagcttcctgaccttctaggaattccagcaggtacagtgactccattagcattgatgcacgacacagagaaaaaaatccaagtcgtgatcgattctgctattgatcgtcaagataccgtaggctttcatccaaatatcaataccactacgttgatcatggatttttccgactttgaaaagatacttgtttacttagaacatctgccagtttatgaaaatttgtaatgatagagtagttttcttaattcccaattcaagcgtctttttctttatttagcacaaaatatatcagaaattcttttagccaatcaaacaatgtaacaactagtatgaacgctgaaaactagagtattcttccatagttagccaaatccatatttaatgattctacgaaaagaggctgggacagaagcgtttaactccaagagataagaagaaattcacgaaaattgcttttcaaatttttgtgaatttcagcttatttccgaaggagtggcttctgcttccgccgtttatacgtgtttagagcgtgagacaaaagtgttctttactattgtcccatgctctttttgattataaagcggaattttatccttttgctttcagtcatatttaacaaaaaatattatattctgaataacaaaaattattctatctaaacttttttatatttttgtaagaatatccctgtacagatagttactatcaataaaccaatgattacagcaaaactagattttttactacttgttttaggaagaatgttttttgatttatttgttatctgtttaggtacagctctcttactaatataattggttctttgttcgctagattctcctgtatgagcaaatatttgcaatttttgagagaatagatttctaattttctctctctctgtcttctctggaaaatttttccacggtgttatatggctacctggtatagatatatttgttttgcccggtgtataactgtttttgatgttatacccgtcaattgtcgtactgtattctggtacgttgtcttccgttacagtatagatgatttcttgcccgtctttgtattttggcagatttgtgaaacaatagtgccaatcatctttttcacttacttctttatgttggattggttgaccgtcggctaatagattcactgtgatcgttgtcggtcgtttaccgtcttgattctcattgtcttcccatgttttttgtcctgagaccgaaatgacttctctattctcatttgtaacgactagcccgttttcaattttttgataacctgaagggacgtaatcatttccgttttggtctacttcttgcactttaaacgtatattcgtttccactatcatcatactgttggatatcttcccaagtcactgaagttattccattatctaatcgctttgtttctgcatcaggaactggttcccaattgtttgtactttctctgaataatttaaaataaatacttggtctgggagtggttccaccgttccaaattttagttgctgtgatgttcgtaacctttttcttgttataaataggtaaactgactccctctgtatcattttcatttatggagaatttgagttcatttgaacttagtggatcaaaatcaatccaattgggtgcttctttttcttttacaacataatctcctacttgcagacctttgatactaacttctccctgttcattcgaagtcaacaggatactagactgtccttgaataggctgttcatctgctcgtcttaattcgaaagtcacatttgggataccaatctctgtgccattgatatatttgaaaatcttcaattcgcctctaactgtaccgttgactccaccagaagctgaaatatttttaaccgtatgattgaaaccatctccatcaacagcaggtttattaacttctttaaaccaagctttcgaatgattctcaaaacttgtttgttctggggtttctataatcgtcttataactcaccattattttcctaagattgacaaagttttttggtatagttatttcaatgtaattatcatttactgaaaaatcaaatgtagcaccggggaaatcttgtaaaaattgttggattccctcttctcctctgtaaactttctgttcacctaagtgtatttgattaatttcaaacgtacttggatctaatctttgtccactttggatttcatcactgattttaactggttgttcaacgtaagtgccgtcattgttaatattcaaaaaccatcgaatgtgctcagtatcttcaggaagcatgtctcctgttttataataaaaaacgctagaagaagaaccagaagctggctttgtcacatttacagtagccgttttgtcaccactcatcacggtgaatggccccgtattttcttcaccagtatcggttacgtttctggcctggatctcaaattgcccccacccttctactgagtctatgtttttaatattttcattaaatacaacctgtgcagaatcttttctgaccgttaaagttccaacatttttattttcaatcattaatgggatttctttctggaatccttcaccgcgaatatttccttcacttggccaattgatccaaagataatcacctggctggatatcttgttttttttcgtcaaacgagaattttacttttatgtttcctccatctgtaatattcgttgggtccacggtcaacgaagtgacgttactgctgatatctctgcctgcatccgcatagacatgaacaggaatcagtgatgttatattagtaataataaataacattgataaaataatatttctacactttttcattttttctatctcccctattctaactaaaaataaaacctaccatatcatctctcgaaaatcctttcttcaattcctcccctactcatttccaatcttttaactaaaaaattgataggtattttacaaatatttataaaaaataaatatgccaaaaaactgtttttacaaggtttttcctaatgtaaattattttttcgcatatattcattttattttacttattgctttcattttttcaatctatatttccaatttttaacttacaaaaatggaacgtgcataaataactatagttgcataaaatattcttttaattagcattattattttataacagctgtttttatattaaataaagaataaaacacaatataaaaaatacagactttgttcaaataaacgaacctagcctgtattctgtgattgacgctactttttaattcattgagatgaataatccatttttataaatgcccaaaagtaatcgatgccgaagccattcctcgacctaattctttttcaaattttcctattgttgatatctccatataaaacggtgagactgctttagacaattctcccttgattgctaacggacgtaaactacgttccaaattattcatgactttaggataatactgacctttttctaagcctgtttttgcttctatcagaagtatacgttccttttcattgatctctggatttaaagcgagatcatataattttagtaccatgttttctatttcttcacttttagacatcacgatttcctcccagaaatatatttctccccactacattctatacacaaagtatacgccatttttagtggtttttaaatcacacagacataaagaaaaaagacagatacccaaccagggtatctgtcttttgctttatgccagctatagggatcgaacctacgacctacgcgttacgagtgcgttgctctaccaactgagctaagctggccttatccaaaagaaattatatactctatttggctgattgtaaagagttcgatggaaaattagtttaatttcatgatatttttcataaaacgtggtataattgatgtgaaaggcaggttttatgaaaatggcaacttttggaaaatttgatacaactatcgtaccatcggaaattggtgaaaaattcaagatcaatactcacgtaatgttcacgattcacggcaagccgcaaactggaacgatttcaaaacaattgaaaaattccgctgttgttgagattgatgaaactgcagaaaatgcgaacttgatgacgcaaagcaaaggtgtagtaatcgttaactacaaagaacttaaaaagatttgaatttgaccatctctgcatttttgggatggtttttttatatacaaacgaaagctgtgaaaaagctgctctgcctcaaacattaaaaatgaccaaaaaaggatgtgacaaaagttgtgtcacatccttgatttcgtttttcgaaatctttcagcaactcatttattataacttgtcgtttgttatttgtcaagaacttttttgaagtttttttcgatagaatcaagcttcacaagctgttcttttttaacgactcagttatcttatcacgtctaaaaacatgtgtcaactcttttttggaaatttcacaaaatgtttcaatcagatgcgacaacgttgtttaatatatcattaaaaaaaataaaggtcaagctaaaataatattttagcttgaccttattataatttcaacgattgtcaaaagtattgtttgcaactgtgttccctgtttctattgatagaatacagctttcgaaacataagttttgaactgcttcgattcgtccaaattcttttgcagttattgtacaatgagtaaagcagacatcttctatagttttttcaggaaatgctaccaagtcaaaagcccgggaaggaagtggatagcctggagaaagacttgcctgtacatttttgacatgtatgtttctgacttttgtcatttgttttgattcaggtatttcttcagccactgcttgccagctttctggcattcgttcaagatcattgctattttttctattatattcattatgccagtccattatccaagaaaacggaaattgtacatccatcatattcaggttttctaccctgatattttcaatcactccccctctttctcttgaagatttcattcgaataccacagtctgactgaaaaaaatcgatatcgtgaatatacacatcactaactccagcactaacttcgctaccaatagttacaccgtaacctgaacgaatgttacatctcgcaatctcgattcttgatgattttcgattgactcttgcaccgttaccgtccctgccagatttaatagcgatacaatcatcaccacaggccaaatcacattcatagatacgcacatctgttgaagaatcaatatcaatcccatctgtacttggcccatcattatgacggatgattattttttctactaatacatcgttagaataagtgatttgcaggttccaaaaacctgatttttgaaaaatcaaatcacgaatgacaacatgttctgcatgatacagtaaacacgcccgcggacgcttaatagcataatctgcaatccaacgcagtccctttcgatcatattcagctcttgttccgcttttttggtctttcccccaatatagttcccaccaatgctctccttgaccgtcgattattccttttccttctataagaatatcttttgctgagagaacattcaaaatcgctgctggccatttcatttctactccagcaactcgtgtatcaatctctggaaatgcttcgatctctgtttttcccttgagaacagccccttcttcgaaaatgagatggctcttatcttttaaaaaaagtgcgccgactaaataaataccttttggaataaatacgggcgagtgttcttttgcaccttgattgattgccttttgcagcattactgtatcatcttgttgaatgtcgtttgttttaaagtctaaagcattgatgaactctttttttgtctgcaatacttttctccttatctttcattgattttttttaattcttcaccaataaacacagttttcgaacgattcagcggataccctactaataaaatgattgcggatacaaataaacagaatgctggtagcaagtttgccatcgtataaattctttcttgtactaaaactgattggatggctccacctgttgtagacgattggtaaccaatgagtgctagcataaatcctccgactgctcctgcgcatgcttgtcctacttttctcgcaaaagaattcactccgtatactgttccatcttctcttaagcctgtcttatattgatgatagtcaatcacgtcagtaatgaatgcccagaccatcaaattgaataaaccagatcctaaagtagcaataaataaaagaatcagatatacccatgcatttgttatatgaaggaaatacatcagcaagtacatacatgaagaagcgagtaacgcaaatacgcttgcttcctttttaccaaataattttgtcagctttgtagcaaatggtgctaaaactactactgttccgtaagtaaataaaagagcgacagacattgcttgtttattatggaagtaatcattaaataaataagtcatattcgtcccagctaaaatctgattgatcacaatgaaaatgtcaacaatgactaaaataatcagtgctcggttagctaacaaaccttttaccaactgagaagcagacactttttcgtttttgacaactcttactcgttcagtagtcaatttacaagtcagcatgtatgcgacaaatgcaattgccgcacatccgatggaaatccaaaagaaatgattccccgaaacgacttgctgcccactcttgttatgggtgtacatcaaaatcgggataaagaaccctgtagttgacccgccaatcgcagagccaatgcttcggaatgtggataacgaggtgcggtcattaggatttgaactaatggctgctgccattgctccgtaagggatattgattgttgacagaaaaataccataaacaatatatgaaacaaaaatatatgcaaccttcaccgtcattggaagatgttggacgaatggcaaaaacaaaatgactgtcactaagcaaaatggatatttcatttttctgatccaaggaataaatcgaccattttctgttaactctgagacatcgcataatcttccaaccatcacatcagcaaacgcatccaaaattcttgaaatcaagaataacgtacctacgattgctcctgaaacaccaagaacattcgtataataaatcatcaagaaactattgaccaaacctaaaataaaacagttacctaaatcaccgaacatgtagcctatcttatcggaaatcccaaattcctttttttctttttttactgtatttgctgtaacagcattttgtgaaagcatttgaattcctcctacctcttctagtaaacgttttcaaaattataactctttttttcttgttttgatattcacaatattgacattttattgcattatcttgacagagaaaaaacaaaaataagtttaaaaacattggcagaaaaaggcattaatattattttcataatatcatagataaacaaaaagattcactaactagcaaaaacgagttagtgaatctctatttattagagagatagatcattcatgatctttccatcatacttaaaaaattcaaagtcagcataacttcctctttttctatttaaatcatgtacgactatcccgataaaattccccgtaaatccacctgagagtatacacatgtttttttgtagacctacttccttccattcttcagatggtgtgtctttcaaataaaactgtgctgtctctttctttacggctactttcaagaaagtcttcttttctgtgagtggaatcctccactcttctatttgtgcaactccgttttctgattctatcatacgaagacattttcccttgttttcatcccaagtaacatagcaataaatataattggattcgtttaggtacaataccagtccagccatctgattaaaattattaggtgtatattcaaatgctgtctccgcatcaaaagtaaaatccgtttgccgaatagctaataagtgatggtcaaaggtagattgaagagattcaccggcaatcagtcgtaaaaaaccaggtctagtttttgtatcacaccaatcagcccttggcaaaatacgtctggcattccagttcttttttagctctccttcgaatgtatccataaactgatactctctttcttgttgtgcctcttcattcgtctcaatcattatttcttccatcggagctgtctggctatcttttagtcttaaccaatcgtcggacgtccaatacacttcttggatagcggtttctcttcccaaaatagccgcaccgtttaatggtctggtacaaagatatgtcatgtaccatttttctgacggggtttgtactaagctcccatgtcctgtacactgcaatgtagaagcaggtttgtcactagctgtcagcataggaaaaccaggatcaagctcgtaaggaccaataatattctttgctcggcagactgtgactgaatgtcctcttcctgtacctccttctaccgtcatcaaataataatacccgttacgaaaatacaaatgcggtgcctccgttttcgctaattctgtacctgcaaatattttatagatgggaccatcaagcttcttctctgcatcatactcttgcaatacgataccgctggacttattcggtgtgtccagacgataatcccataattcattgacaagccattttttcctgtttccaaatcatgaaacaaagaaggatcaaagccgttactatttaaataaatcggttcggaccaaggtcctgtgatctcagatgcagtaatcaagtaattgtggacatctttaaacggacggcctgcacttttgacatctgtgtaaacaagatagaacaatccatcagcataactgatttgcggtgcccatatgcttccgtttgtaggatttccttgcaaagatacttgagtggtcaaaatatccgttgtatgtgaccaattgactaaatttttcgactcatatactcgaattcctggaagccattcaaaagaggagacaataatgtaatatcggtctttcgctcttaaaatattaggatctggattgaaccctctcaaaataggatttttcactttgatagtctgcatgattcaggcttcctttcttattcttactcgatacaaactgaatgccccagcggcaaaataaaaaaacgcaaaaggaaacgcaataaactgagtgccgaccaacaatataactcctgttataaaatacaagccagtggcagttgttaagtattttcctttagccgtcaaaaatagtgctactgctaaaaaagcaagtgaaataaacaatacaacggcaaacagaccagtcatgtcctttaatagctcaaatgtattttctaaagacaaagatggatgatcgacagcaagcgactgataactttttttaaactctgacgcagacatattacttaaagtaactgctaacccgccaaagaaaatcagagataggctgccaccgatcattcctagcaatagttcccattttcttttcatttcagaaccccctgcttttctaaatggatccattcaggtcttttgattggtgtttcataattgttatttcgttcagagaatttggcagtctgttcatttttcttgtcatcccaattatcccaaccagttgggtgaacatgcccacctatcttacatgcttcaaacacgacatttgcatacggacgccacggtcttcctaaatagacgtttctagtatcaggctctgcagtcaaggtacagctttcaaaacgataccctgatttttgtttttttggcgtagatgctgctgtgatatatccaggatttttactggctaagctatggatacggcactggcgaaaaattgcatctgccccaccaaatatgaaatccaccgttccttcaatccagcaatattcataggtctgacgacaataatcaggattgacagaagccggtgtacaaaaaggtgtaccatctttttgcaagtcaggcaacggacccgtgcataaagtatcctgataaccagttagtcgacagttttttaacaacacgcgatctcctgaattgaataaagcaacagcttgacctactttttctcctggacctgctgtattttcgatgtgaagattttctaatacgacattcgatccttctaagaagaaagtagcacttcggaaagtccctaactggctaccgtcaagatactcctgttttgcaaaacgattaccggagatcactactgttcctgttcccacaagtttaaaattggataatctgctttctatatattcatcatatcttccttcttttactatcaagacctttggatggctatccggcaggtctgccaaataatcgattccttcttggatagtttcaaaatccgtcggggtatctatagaattttttccaattatcaatttgtctttcatcctcataaatgctcctttatgaattgtttccaaatgtttctcatttcttgtgtttccatatgaccgcctgttaaagaaaaagaagaaaagttttctggactacccattgattgatactttttgtccagcccttttctcagcttcagtacgccttcgtccaagcacatcgtatcgttttttccaactaagctaagacgagggcgcggagcgattttttcttggattgctaacgttgtataagctgtcagtaggtttggcacatagtaataaaacccatgatgatctaggcgacgatgtagcaaaagtgtttcgatgtccacctgtgctgctagatcaatacaaactttgacacgagaatccaatgccgccacccaccagcttaataagcctcccatagaaagaccaatcgttgcaatccgttgagtatctgtgtcttcccttgtctccaaataatcgatcaagctgatcacatcataaatacgcattccccataacgtttttcctgttaataaaaattgtttgaacaactcactttcggaaatacctccgcgttcttcaaatccccaaacatcaatcgaccaaacagcatatcccattcccgtcagtacttctgcaaaagatggagaagctaagtaaggagcaccatggatcaattcacttttcccgactgaaaaatctccgccgtgagaatgcaggtaaaggaccgtcggaaacggtccttctttctccggataagcataaagtgctggtactgtttccaattcatttaagtacagttgataatattcaagcataaacccattttgtttttctctgtataatcgctttccactaggagtaagtctgctagatggatcacctaaaaagtcattcaactgcataagcaaagtttttacgaacaaccagctcatccatattttccgattgagttgaccggaatttctcaatacttatttctttcgtattttctaatagaaatgctggtccttcatgattctcaatcgtcatttgattaaaggtaaccttatccgcaaaaccaatgtaaaatccttgcttgctcatttcctctatccctgtcatcatagcagggacaccgggaactgcatcttgggccattgaaacatcaatattatcaaatgtgatttcttgtataaactgttctgctaatccataaataaatcctgcagaagcatggacattccttgccgtgatattcgaaaaatggatccttctgaatgctggtgtccgctcatctatcggataagccgttttttcccatacatatggttcttttcctcgcggaccgcagaaataataaagattcagtataaatggacacatcacattatccatgactatattggatactcgaatgtcttcaacgatcccgcctcgacctcgtctagatttcaatcgtattcctcgatcagtttcttggaagatacaatttgaaatggtaatattacgtatactaccactcatttcacttcctaacacgacccctccgtgtccatggaccatcgtacaatttgtgatcgtgatattttcacaagcaatcctttcgtacgtatcttcagtccctgctttgattgcgatacagtcatctcccacgtcaatatggcaattactaatacgcacatttttgcaggattctggatcgattccgtctgtatttggtgaatctgctgggttcaaaatcgtcaagttgtcaaacgtcgcgttgctacaaagaattgggttgatcgtccagcttggtgactggatcagtttgatatctttcacagtgattcgatggcagttatggaaactcatcaatttaggacgaggataagccaggttatctggttcgtttcggaaagtattccaccatttttttccatttccatctaatgtaccaaaaccagtgacagagatgttctctacattttgagcatagatacaggaagcatagacttttcgatggactccttcccaacgtgaatgaacaataggataatcttttggatcgtcagagaatttcaaaaccgcccctgcgctcaaatgaagttctacattgctttttaaaaataaagcccctgttaaaaattcacctgctggcacaaccacggtcccgcctcctgcgcttgctactgcatcaatcgcttgttgtattgcttcagtattcaattcatcaattgatgcgccaaatgtcaaaatatcatacatatttataatgcctccacttcgattaatgcttgcaagaatgcaccgacacctttttgatcattacaaataatcggctcactgatgtagtaagcgtatgaaccatctcgttgttctgctccgcctaaccctgctacttgacagtttttgttcaagttcaaccagccttcttttgtttcaagaacaaattcatcgagtagtccttgatgagattttttcacttgcggcagccactcttctttgttcagcaagcctaagcgtatccctttagccattgcgtaaacaaacatactgctgccagaagcttccagataatttcctttccgttttgtttctgttgttacttgataccatgtcccactgttttcttcttgatacggaagtagtgcggtcaatgtcttttctaaaatttccttcagcaaagaacaatccgtttccgcatgaagcaattcataggtatctgccgcagccatcagataccagccaatcgatcgactccagaaatgatgagataaacctgtttctgggtcagcccatggttggactttcttttcatcccatgcatggattaataaatttgtttttggatcgaataaatgtttatagctgatttcaaactgtctcaagacatcttggtaatctttttcttcactaaaattctggataaattcagcataaaatggtgagcccatatataatccatctaaccaaatttgataaggataaatttctttatgccaaaaagccccttcggatgtacgcggatggtttgccaactgctgggaaaggagttctgctgcttttttatatttttcttcgcctgtttctttgtacaataaaaagaaaagctttccggtatttacatggtcgatattgtattcttcaacgctgtagccacggattgttccatcttcttgcacgaaatagtcgatattgtcttttatgaaatcaaaataaattttttcttgggtttgttcccaaagtaattggaaccctttaagtacgacgccatagtcataagaccattttcctttataccacttttcttcatataagcgaggtgttctttccatgatgctttttgctaatttctttgaccagttttccattatttactctcctttaaaagttaaaataggatttgggacaaataccaagaagtatttgtcccaatcatctatactattgtgcggctttgtaagcttcctcgtactcttgtgtgattcggtcgccaccttgtgctttccagtcttctacagctttcttgaatccgtcttcgtcaagctgttccatgatgtattgcactgtagcatcaataacgattttttcgatttccgaccctacttcattgttcgttgcagaatccaatggtacagaaggatccattacagcgaattcttcgttttctttgatcaattgattcgacaattctttttcaggatctgcatctttgaaagagaacgtcacttcactagggcgagaacttgatagcggttgcacttcttgttgccaaaggtccatatcgataaattcaatagaaccatcatcattcaattcataatgtgttccctcaataccaccagtcatcaatttatacatatcttcttctagaagatcatcaacaaattgcagtaatttcttcaattgtgcttcgtcttttacttgtgatttagggaatgctaacaaaccaccaataccatttccttctgaccaaacatgataaccgccgccttcaccatctgaaatcttgtttacagggactaattccatatcatcttgaataccttgtcccattgtcttcaggttcttgatatccaccatcccagtgtagattcctgtttttccttgtgcaaattgttcttgctggtcagtcttttgagtaaccgcaaaatcttgtgccaaatagccattctcaaatagatctcttgagaagttcaacgctttcatgtattcttctgtatcaaattctggagtaaatttgccattatcatctacagcccagccattcggtgctccaaaataagaagtgaacagcttaaagctggtataacgaatatcactaggcgcacgatcaccaaaaccaactgtatcatccacaccatttccatctggatcgttttctgtaaattgtttagctacttcgtaaagttcatccatcgtagttggaacatctaatccaagattatccaaccagtcttttcgaatgactaaaccagcacgagcatagtccttttgcattggcacaccatacaatgctccgtcgatacttgcagcttcgattctatcctcagagatttggcttaagtttttatagtcttttaaatattccgatacatcccagaatacgcctgatttcaacgcacttcggacagaagagtttttcagcatagcaatttgaagtgtaacgatatctcctagttcgtcagaagccaatgcagttgtcagtctttcttcttttgaagcatcaggaatccaattgaatgtaagttccgtatcggttttttcttctattagattcacgattgtgtcagttggtggggaagcatggtgtaaaatattcaaccaagtgattttggttttcccatcttctgtttctgaagaactgttgtttgaactgttgccacatgcggcaagtgctaaaattcctgcaaaactaagacctaattttacgagcgttgcttttttcataaattttctccttcactgttttaatgatatttttgttttcttctgttttttctgtatatgagttcttccattccaaatggcaaaatatagaatttgctgtccacgtgactgcggaaaagaagagactgccaccgataaaggttaaaacacctggcattgtttggatgatcatcaggtaaatacccaccagacttagtattaatactaatgaataatgaagatgagagaatccgaacaaaaatgccattttcattttgaaaaaatatcctttccaatcataatgtgccataattggaaaaatatagagtgctgagagcaaatacaagaacgcagcaatatacaaagcgattctaagataccaattgtgtatgaaagaaagatccacaagtaaaacaactccgatgacgccgtatatccagctcatcagcaaggtttcacgatagttttctttaaaatatgagaagtacgttttcgtcaaaggaaatgtttcttttgtgcgcagccattttctaatcactgcaaccattgcataagatgcaggaccaaaagtaaaaacccccagacctgcaatgactaaaccaccccacagaaaattcaaataaaccaactgtaaaatacgatttagccttccatttattttatctaatgactgcagcatgtcttttcctctctttctaaattagtaaacgccgtcttctcctagctttttggcgatcttgttagctaaaattaccatgaataatcctacgacccctttaaacaatcccattgctgtactgaaacttaattgtccattcttcaatccagctgtataaatgtaggtgtcgaaaatttctgcaacacttcgattcaatgaattcaataacaagtacatatgctcgaaacctaagtccagtgtctgaccgatttttagaatcagcaaggtaatgattactggacgaatcgccggcaatgtaacatgccatgtttttctcaagcgtcctgcgccatccatttcagctgcttcatataactgtgtatctactgcagtgattgctgaaaggtagatgattgtagaccagcccaactctttccagattacttgtccaatatagactgttcgtgtccactcaggagatgtcagaaaactgattttttcgaatcccatcgttgcaaggaattcattcaatacccctccgtcaacgttcaaaaatacataagtaatcgaaacgatgattacccaagacatgaaatgagggatataaatgatcgtttgaatcccacttttcagtcgcttgttcgttacttcgtttaatagtagggacaaaataattggcatcggaaaaaacacgaagatatttaacccgaacaagatcaaagtattccttaataaagtaaagaaagtcggctctgtaaacaaacgaatgaaatgtttgaatcccacccaaggactgcccattatccctaaaaatggttgataatcttgaaaagcaataacgagccctcccataggaagatacctaaagatcaggaaataaaggacccccggcagaatcatcacgtataaaaatttattcgttttgattcctgcaattattttttttcgtcttctgagcttttcttcttttttcgatagcgtcagttgaaatggttcttgtttctttacactttccataagcccctccttagttttatgaatgtttgctgcttatgactttatgatagataactatccgaattacgtatataatcatttttatcgcacgtaaaaacgcttacacgacaatgatttttatactcgcaaaatataaaagtgtatttcttcacaaataagatacgcctagtaactattctatttttttctatctggcacttaacgtaggaaatgattatatacgtaatctttcaccgatgataaattgaatacatagaaacagaacatttaatttattttgaggaggagcctatctatatgaaaaagagagtctctataggagaaagaagttttacatttttcaacaatacgtttctgatcttgctagctttgatctgtatcgtgccttttttaaatatcatcgctacatctttcgcttctacacaagaagtcgtcgcgaaaaaatttatccttttccctactaccttttctctagacgcgtatcgctatattctatctacgccaactatttttagagcacttgctgtttcgattggcgttaccggggttggaacgatcgtcagcatgtgcgcaacttcactgatggcatacgggctttccagaaagtacttgtttggtcgaggattcgtcaactttcttgttgtattttctatgttgttcagcgggggaatgattcccacattcttggttgttcgttctctgggactggtcaattcttattgggcaatgatcttacctgtagctgttaatgcaatgaacatgatcattatgagaaactttttccaagccttgccggatagtttggaagaatcggcaaaaatggatggttgcacagattttggtgtatttttcaaaatcatgctaccattagcgttaccgtctattgctactatctcacttttttatgctgttacttactggaacacttatatgaccgctattttgtatatcaacgattcatctaaatggccgatacagatccttttacgtcagatcgtcattgtatcaagcgggatgcaagcagaaagtagtgccgttgatgtgattccaccagcacaaacagttaaaatggctgttatcgttattgccacagtccctatgctgattgcttatccttttgttcagaaatactttgtcaaaggcgcactcgtaggttctgttaaaggttgattgtgtatgggacataaaatggaggttgtgaaagagacgttcagccttattgtttataagctgtctcttgaacaccgtttattcgcaaaaaggactgtgacaaagctttagtcacagtcctttttgcgtgcttagccttgaaatttaactatccataaagtcaaatactaaggttattctcctttcttttattgcttgaatcagatcacaagaaaaacagcctcttgattaaacggcgtttatcttgttgattctgcggcaataaaatcagccagcacaaaacatgaaatgctgtttttcgctgtcctcttttattgcttgaatcagatcacaagaaaaacagcctcttgattcacaaatatttttttcgatattctcccggagtgatcgattctttctttttgaagaaacgaataaaattttgcggatttcgatattgcagtctttctgcaatatcttttacagagagatttgtttctttcaaccactttttcgctacctctagacgatgattttggacgaaatcaccaaatttttctcctgtttcctttttaaatacattgcttaaataattagggttataatgcaacctatcagcaatcacatctagagatagatcacggtcatattctgtatagacgatgtgcatgatattctccgaaagatttttaaattcatgatcagtgattgcttgagaacattctgtgattggcaagactaattgttctaaaacaagtttttctagctctttaggatgataattattcaatgcttttacatagatttgtttcatgttatcaaaattttttgaatctactcccaataactgccctaattgaacgagctcattgatcaaacggaccgaaactacttctcggctcagaggatttttattttgtgcgaacaatgcattaattaattcatgtaccagcttccttacttcctgatttccggaacgaatagcttcaaacaatcgattctgttcttctactggatatctaataagcgttttttcatgcgcagcaggaacaatttcctgataaaatatgatcgaactcggaccagtatttacacgataatacagggcttcttttgctcggtcaaccgattgcttgctttcattcagcgtttcgaatcggttactgatacctatactcacagttaatttcaagtattcttttacacgtttttgaatgagtcggcaatactccatgacttttttgcttgcttctgcatcgtctttatccattcgataaatagtggcttgcatttcttcattcaaaacgatcggcagcattcgattttcctttggcacaatttccgtgatcatgttgttgattgctaaaagtagcaaatcacgctccccaccgtgactatcttctaacagatcgatttgaaccaaggccgtataatagcagtcattttgagaactataaccaaattgctgcaaccgctggtctagttctcgcctttctactcgatttctaaataaactaagtacaaataacgtttctagttgtggcttttgggtaactaagtgtgcacttaacgcttctttttctcctatgatccgactgactgattgagcgaccaaatctagttctttcccactgaatccttttgatttaagattcaaacgttcctgaatttgagaaattggacgggcaaatctgtccgaaaataaataggaaaggagaccgatcagtcctaccagcgtcaaagacactgcaactaacccgattctcagattgcgaatcgttgctccaattgcactagaatcaacttctaatctgtaaatccaattattataatctgatttcagtacgatataggatgtcccattttctcttatcactttcaactggttgtactctagatccacatccgctaatgcttctggctgctcttcttcttttactttctgtgtagaaaaaagctttccatcttcgttttcgatagaaagtatatcttctccactttccccaacaacttgttctattgtatgtttctctatcgtagcaattcccaatgcatatttttctttttcaaacattggtaaaggaatcaccatttcgattcctttatttttcttttgccaaaataaattatctttgttatttatgtacttttgttgatacctttcaacttcctcttcagtcagttgagtcaacgatctattgattactccccatttaccagctaaactgagtaaatcataattattatcatccataacaattgtttctataaagtttagctctttcctgatttcagaataagtggagtaatttgtatatgtcagcggatgcttgaatatatccgagaaatttttggtcgaaccatacgtagaaaacgaatattcgattgttctgattttccattcaacgttcgttttgacttgcctgagtaggttctttttatctgctaaataactcgattcgatcgactcataggtattctgataaataaataaactaaatcctatgacaagtacggctcctaataaaaacatcggtaaaaatattttataaaacactgtacttttcttcattttcttcctctcttccctttaagtaaaaggctttcatttttctgtaaaattgatactcatctaattaaatgagcattccccgtttttaagaatagcataattaaaaataaaaagccaagtaatttttaacgtgtgcaatcttttcataccaaagatctattgacttatcgtagttatcgtaatatgatgaatgcgttaacaaaaagtgaaaaagtaaggaaaatgatggaatggtaacgatcaaagatatcgctaaagcagctggtgtttctcatacgacagtttctcgtgctttgaataacagcagtttaatcaaaaatgaaacaaaacaaaaaatacggcaactagctaaggaaatgaattatttgccgaactatagtgcaaaaggtttagtaaatcaaaaaaaatatcttatcggactgtttttctcaagtttgcataaaggaacttcatcaaatttcctagcagattccattgcaggtatccattcagtgttggacacaaactacagcttatctgtcgaaagtatcgatgctgttgatttaacagaaatcaatttgcaacgttatgatggtctaatcgttatgagtcaaagtgatgaagatcagccttttatcgattatctaaaagaaaaagagtttcccttcgtagttgtcaatcgtcacatcaatgatccagcggttatcaatgttactgccgatgatgcggccggtgttatgcaggcagtagattacggtattgggtgcggacatacgaagatcgcttatattggtgggaaaaaaaactttcgttcgacaaaagaacgggaaaaaggtgtattggacagtctaaaaaaagcaagcatccctgccaatccagcctattttttaacaggggactacagcttagaaagcggcctccaaaacatggagtacctattatcgctttctgacctgcctactctggttttttgtggcaacgacgacatagcgattggtgcattgagagctgtacattcagctggtcttcgtgttccccagaacatttctctgattgggttcgatgattctccagtcgtctcctatcttaatccaccgcttactacagtacacaaaccgttgaaagaaatgtgtcaagtaggaacaaagcttttattggatttgattgaagacaggccgatcgaacaatctaaaatggagctctccaccttactgatgcttcgtgagtcgatcaattacttgtaaactgcaagtaattttatataaaaatgttaacgtgtgcataacacagaaaggaagtaatctatgaataaactgacaaaagaattagtgaaaaaaaacgaggctcccgtaaaagttcttcaattcggcgaaggcaattttatgcgcggatttgttgattggcagattcagcaactgaataaccaacaattgtttaaaggaaatgtcgccatcattcagcctttagaacaaggtcttgggaatatgatgaaccagcaagacaatttatatacggtcattttacaaggactcagcaatggcgaaatcgttgatacttccgagattatcaccatagtagaacagatgatcaatccttatcatgaatgggatgcttatctttctctagcagaaaatgacgacttagcctatatcgtctccaatacaacagaggcaggaatccaatttgtggagactgatgaacgaacagatacgccaccacagagcttcccgagcaaactgacagcctttttataccgacgttttgaattaaacaaagctggttttaccattattccttgtgaattgattgacagaaacggtgaacgtctaaaagaaattattttacgctatgcagaaaaatgggatttagaacctgcttttattgagtggttagaaaaagaaaatgttttttgttgtagtttagttgatcgcatcgtaccaggttatcctcgtgaggatgcagatgttttcaatcaacgacataactatgaagatcaattgatggtcaaagcggaaccattcatgctttgggtgatcgaaggacctaaagagttggaaaatcaactacgattcaaacaggctggcttgaatgtcatcatcacagatgatatgactccttatcgtgaacgtaaggtacatttgcttaatggaccgcacacagcgatggtccctcttgctttgttggcggaattggaaactgtagaagaagtaatgaaagatcctttattctccgcttatgttgatcagctattcgatctagaattgattcctatgctttctttacctaaagatgaattagccatttatgctgatcaaatcaaagaacgtttcttgaatccttttgcccatcacaaattagaagcgatttcattaaatagtgtttcaaaattcagcacccgtctgcttccggtcttcaagaagtatatcgaagaaaaaaatcaagtaccaccgctaatctctgtttcactagctgcgttacttcttatgtatcgaggcgatcaagtaaagccccatgatgatgaaaagacgataagcgaatttgttgatgcttggtctgataatgaaacagctattcttcgattattgcaaaacgctgcgctttggggagaagatttgtctcaattaccgaatgtggcagatactgttcaagaaatggctacaaaaatcgatcaaaaaggtgtccgagcagtattacaagaaatgaaaggaacgatggtccatgcttgaaaccctgcaaccaacaatgaaattaaatcaacgagacagtgttgttgtcgcattaacacctatcccaaagcaaacacaactgacgattgatcagcaaacgatcaccactcttgaagatatcccgcaaggtcacaagattgcattgagtgatttgaaagctggagacaacgtgatcaaatatggctatccaatcgggcacgtgacgacagacgtaactgccggtcaatggctgcacactcataatgtaaaaaccaacctttctggtgaattggattatcgatatgaaaaagatgtccatccaagtcattatccttttgagaaccgaacatttcaaggctacttacgaaaaaatggaaaagtagggattcgtaatgacttgttcttagtccctaccgttgggtgtgtgaatggaattgctgaactgatcgtcaaacagttcaaagaaaaacatccggatctgggacagtttgatcatattacgattttaaagcatccctacggctgttcacagcttggaaaagatcatcaaaatactcgagaaatcttagcagacgcggtaaaccatccaaatgctggcggagttttagtgtttggattaggttgcgagaacaataccgttcctgaattcaaaaaaattttaggtgaatatgatgaagaacgagtgaaatttctagtggcccaagatgtctatgatgagatcgaacaaggcgtagctctattagaagaacttttaaccgcggtcgaaaacgaccagcgcataccagtcccgctctctaagttgaatgtcggtttgaaatgcggcggttctgatggtctatcgggaataactgccaatcctttgcttggtgcattttctgattacttgattgctcaaggaggtagcacgatcttaacagaagtgccagaaatgtttggtgcagaacaagtattgatggcacgagcggaaaatgaaaaagtttttggttcaatcgttgacttgatcaatgacttcaaacagtatttcttgtcttacggggaaccagtttacgaaaacccatctcctggtaataaagcaggtgggatcactacattagaagataagtctttaggctgcacgcaaaaatcaggaagctctcctgtcgttgatgtactgcaatatggcgaaaaaatcagaaaaccaggacttagtttattgcaagctcccgggaatgatcttgtagctgcctctgctcttgcttcatccgattgccagttggtcttgtttaccacaggaagagggactccgtttggctcatatgtccctacggtcaaggtatctacgaacacgactctttttgaacgcaaaggtcattggatggactttaatgcaggcgtcttattagaacaaccaatggaagtgatcttagaatcatttgttcaaaaaatcatcgctgtggctagtggagaagaaacgaaaaatgaacaaaatgacgttagagaaattgccatttttaaaaacggagtaacactttgattttcataaaacagtataaaaagaaagaaggaagatttatgtttttatctgatgattttttattaaaagacgattgggcgaaaaatctttatcattcctacgcaaaaaatatgcccattattgattatcactgtcacttagatccaaaagaaatttacgaaaacaacaatttcagcaatctgacagaagcttggttaggaggcgatcattacaaatggcgcttgatgcgagcttgcggcgtgcctgaagaaaaaatcacaggaaatgcttctgattttgaaaaatttttagcttggtgtcaaaccgtaccaaaaattatcggcaatccgctttacagttggtcacatcttgaattgaagcgtttcttcgatattgacttgttgataaatgaagaaaacgcagagaaaatttggacacaagcaaatgaaattttggcatctcctgatttccgtcggcgggaaatcgcgaaaaaatcgaatgtagaagtgatttgtacgacagatgatccagcagatgacttacactatcatcaattgcttgctcatgaagaaccagatttgaaagttctcccttcattccgtccagacaaagcactcaatattgaaaaagaaggatttaatgcatggattacactactggaagaagcagctgaccaaacgattaccacctatcaagaactgatcgaagttttagggcagcggatagaatacttccatcaacatggatgtcgtgtttccgaccacgctttagacaccttacgctataaagaagcggatgaaacagtattagaagagatttttcaaaaagcacgagctaacaaactattatcttcagatgaaatcgatgcttatcgtacagaaacactgatacgtttgacccacttctatcattctcataattggacaatgcagctgcatattcatgcttatcgtaattgtaatacacaaatgttggaaaaattaggacccgataccggttatgatggaatgaatgatctttctttgactattcctctgcaaaaattattgaatcgtgcagaagaaacgaatcagttgccaaagacgatcctctattcactgaatccaaatgactaccctgcgattttagctttgatgggctgtttccaaaaagaacagaatggaaaactgcagttaggttctggatggtggtacaacgatactcgagctggtatgcgcgatcaattgacacagtttgctgatggtagtgctttggggaattttgtcggcatgctgacagattcaagaagtttcctttcctacactagacatgaatatttccgtcgtgttctttgtgaatttttaggcgaaatggtcatgcgaggggaagcacctgaggatgaacaacttttaggaagtctcgttcaagcgattagttatacaaatgctaaaaattactttggcttttttgcctaattgattaatagtaacagtaacgaatcaaaaacaggatagcgaaataacggaatccgtttatccacgttttagagaagaagacggaccaaatttgctccgtcttcttctcttgctgttctgcttcattgcctataaacctttatgaaagaagagataacatgcttactatccatattgccggtgattctactgcggcagaaaaagatgaaaacaagcgtcccgagacaggttggggagaaaaaatatctgcttatttttcacctgagatccagattaataaccaagcaaagaatggacgcagcactaaaacatttatccaggaaggaaggttagcccgtttagcttcacagtttcagccaaatgatttcttatttgtacaatttggacataacgaccagaaaatccaagaagaaagaggtacgcttccattcggtagctatttaaaaaatctgcagatattttttgaatgcgcaaaaaaagcgaatgtccacatggtcttgctgacatctgtgacgcgacgagattacttagaaaatggaacattgaatccagatatacttggagactatccaaaagcgatgcgtgcatttgctgagaaataccatattccgcttttagatgttttctcacgatcacaagaatatttccagaccttttcaaaagaagagacaaaaaaattctatctgcatcttatgcctaatagttgtgaaaattacccagaaggactaaaggataatacccactttagtccagaaggcgctgataaagttgcccgaataattgctgaattgataaaagaatcccgtctgcctcttgctgattatttacaaaaaggagtttgaaatgtttccattaaatttaggcattcgtgcccatgatctagaggttcgaaatcgtgaagaaatcgttcaaaaagtatcacagcttcacttgtcccatatccaatttgcaccgcaaaaagcatttcctgaacaacttaaattaaatgccatgacacttggaagtgctgcctattttggtgaatacttccaaaaaaacaatatcgaactttccattttaggatgctatatcaacctatccagcaaaaatcaagaagttcgtgcacaagcattagcaactttcaaacagcaaattgctctgtgctctgcctatcaagccaagatgatcgctacagaaactggtagtgtctctgtcggttacacaaaagaaaattttactgaagaagcttatcagatcgctagaaattctgtcattgaattagtcgctcatgcagaaaattttggcgtaactgttgctgttgaagcagggatcaatcatccaatctataactatcagttagccaaacgtttagtcgatgaagtagcttcaccaaatttaaaaattattttagattgtgcgaatttgatgcataaagaaaatcatactgatcaggagaaagtgatccaaggtgccttggacaatttacagggttgtattacagcccttcatctcaaagactacatcatggaaaatggaaagatccgcatggttcctgttggcaaaggctgtttagatttccgaccggtactgcattatatcaaatatgagcgtcctctaatgtacgccactcttgaagctactcctgagatttatgttcctgaagcaatagaacacttgcagtttatttaccaagattgttaaggagaagattatggaggaacgaatacagaaaagttatcaaaaatatcatgcaaatgcttttcagacattgctgcatctttatcaggggaattattggcgctttgccatgtcaggactcttttttattatcaaacatcttccatcttggttaatgccgatcgctattgccaatgtaatcaatgcagcttcatcaaaagattcctctcaattgcaggcgatttatttcaacgcttttttgatgacttgtctgatcggacaaaatatattgacgaattattttcatgtaaaataccatagcacttcgatccggcaagtagaagctggactaagagcgacccttatcaagaaaatccaagaactttctattccctatcaaaaagaattgcaatctggccggatccaatcaaagatcatccgtgatgtagaagccatccaaacattgtcctctcaagtatttgtcagcggattgaacattgctgtcaatttattcgtggctttaggtatcacgctttatagaagtcctgtcgttttcttgtttttcttattgactgtccctctcgccgcgttagttactctttttttccggaaaaggatcagacagtccaattcagatttccggcaagaaatggaagaaacttctgcaaaagtgatcgaagtgatcgaattagcaccgattgctcgagctcatgggttagaaaaacacgaaaccactcgcttaaataagcattttacccaaatctatgaaaaaggattccacttagatatcctgcaatctgttttcggatcagtcagctgggctagttttcagatatttcagctgatttgtttgattttcactgggatattagctttacaagggcgtatccaaccaggtgatgtcgtgatgtatcagacatatttcacaacgatcgtcaattccgtttctggaatgatcacactgattcctacgatttcaaaaggcatggaatctattacttctattggtgaactgttgattgctggcgatgtagaaacttatcacggtaagaaaaaaatccaacatttggatggaaattttcgttttgagaatgtttcttttcattacccggactcactcaagccgattatcgatcatttttctctagaggtgaaagctggagaaacaattgcttttgttgggccatctggttctggaaaatctacactccttaacttattgattggatttatccagccgtcttcagggaggattttcttggatgatcagcctttggatgaattggatatgcgaagtgtgcgtaattatttagccgttgttcctcaaaccactttgttgttctccgcttcgatcaaagagaacatcacttatggcttgaaaaacgtatcaaaagaacgtttaaatgaagtcatcgaagctgcgcaactttcttcactgattgaccagcttcctgatggtctggataccttagtaggcgaacatggcaacaagctgtctggtggccaaaaacaacgtatctctattgcacgagcattgatacgtcagccgaaaatcattttgctagatgaagcaacttcagctttagataaccagtcagagaaaaaaatccagcaggccctgaattacctgacagaaacacccactacttttattgtggctcatcggctttcaacgatcaaagaggcagataaaatcgtcgtgatcgatgaaggaaaaatcgttgagatgggtacttacgaagagctgttagctcaagagggctatttttaccgtttgaaaaatgaatgacaaaaaaaggagagacgacaagagttttgtcgtctctcctatttctaaataaacggtgttctcctgccaactcctcggtcacaaatcacaatagtcatcaaacatgagaagctttttttgaaattgttccttgtaactcagagttaaacggtagtctcacgacctcttggtaaatggtgttcaagcgacagtctatcggcaataagaagcaattttgtcatcgctcaaggctgaacagctctttcacaacctctgttgtttcataaaataattctattcgctgtaaaggtcgcgaactggcgtcatgataatccggttcaagtcattaatgatcgtactgaacccttgttctttttgcattaaatcattgattacttcttctgattgaattttcacagccatttcttgtgctttcattgcatcttcgtcgctgaattcttgtccgctcatttgtttttcttgtaattcgatttgcatcgcttggaagtctttgaatagcttgtgtgcttcttcgtttgcttgtactttctcgtacgcttctttcaacgctttgaattctggtaattcacggatctcacgttcgatctgatttgcgctatcgtagatgtttgacatgttatgccctcttttcttttagtagttactctctattgtaacatggggttattcgttttcaaagggtctactctccttgatatttccgccagaggtctttagccgcttcaccaattccctgaacgccttctttcaccatatcgccgaaattcttcaatccttcttttgcttgttcaccgtattgattcaagttatcttgccaatttccagactctccattagaattacctgtgtttccaacttgatctgctgctaccacttgccctcctgtggcataggcatccgctacactaaatcctgttttggaagtataaggaaggataccttctgccgctgatttgaagactttcccgacaacatttccacttgtcccttccaaataatgcaacttgctggattcttcataccccatccatgtcgaaatcactacgtctggcgtatacccaatcatccattggtcatttgctttcgtggcatcgaaattagtttctgtggttcctgttttccctgctatcgtataacctgcaggattcgcagcagctgctgtcccatttgagaatgtaccaagaagcatgctagtcatttcatcggctgtttcctttgatatgacctgttttggctttttgtttgtattatcgatgatcaccgctccagttgaatcaacgattttcgtgatgagatgcggcgtatacatctgaccttcattggcaaatgcactgtaagcacccgccatgatcattggagatactcctttttctaatccgccaagagctaagccataatacttatcagattttgctaaaggcaggccgaattcttctgctttatcatatcctttttgtaaaccgatctcatgcaaaagccatacagcaggcaagttcaaactttgtgcaacagcctgatacatcggtacttctccttggtatgtcccgtcaaaattatgcgcatcgtaataactttgcggttcatctttcaagacactagaaggcttgtagccagcttccaacgctggtgtatacacgcttaatggtttgatcgttgatcctggagaacggcgcatctgtgtagcaaagctgaatcctctaaagacatgatctcctcttcgtcctactaatgcttgtacaccgcctgtattcggatctaaagctactgaagcagattggaccatggcaccatctgaagcatttgctgggaataatgcattattttgataagtagcttctaattgcttttggtaatcctgatctaaagctgtatagattttatagcctttattcatgacatcttcttcatcaagaccatactcgttaactgcttcatcgatcactgcatcaaaataataaggataacgataaccagaatctgaattgtcgtatgtgtcatgaagataagcactgatgtctgtctggctttctgcttgttcttgttcttttgtgatttttccgttttcttccattacgcttaatactgtgtttttccgatcattcgcatttgctgggtgatcaatcggattataaataccaggacctttcagcattcctgccaaagtagcagcctcagatagcgtaacattcgttgcatctactccaaaatactttctggaagcgtcttggacaccccataccccgttgccaaaataggcattgttaagatacatggtcaagatttcttctttgctgtacttcttttcgatctcgattgccaaaaataattccttcgcttttcgatcaaatgtttgatctaatgtcagataagcatttttggcaagctgctgagtgatcgtacttcctccgccccctgatgttccgccagacaaaaccatccgaacagccgcacgggcgattcctttgatatcaaatccgtgatgttcgtaaaaattcctatcttctgtcgagatcaccgcatcttggatatagggagaaatcgcgtttaattctacgtatgtccctttttgggcgtacagtgtgccagcttcttcatttttcttgtcataaatgactgtcgattggcttaatccagattttaacgtttcgacatttgcttgtttggctaaaataaaaaggtagatacttgtcactaagacacagatcaaaccaatcagcaaaatcaatttgttcacatgatattttttccaaatgcgctttcgccatcgatggaattgtccgagatatggtctgatccatcgccaaaaactgatcaaagcagcttttatctttcctaaaatgctttgaaaatccattcgcttcttctcctgtctattcaattcaatcgtcttattttaccataatgaaagagtgttttcttcctgcttaagttgtagttcgatttgttttttttcgctagtgcaagtagagtaacgtaagaatgaacagaaaaatgtaagttttttcttaaatatgttttaaaaatggtacaattagtctgcaattttaccgaaaggagtacacttgtgaaaatcacgattactttacctatgaaccaccctgaaacaacgattcgcgacttgcttgaaaaggaatggttagttcctagaaaggttcggcactttttgcgtatacgtaaaaacgtttggatcaatcaacaacctgctttgttccatcatgaagtaaaaggcaatgaccagatcacattgttattcgaagaaacagattataattatcaagaagtccaattaggagatgcgaagcacatccgtgttttatatgaagatgaacatttgattatagtggataagcctgcaggaatgaagactcatccaaacgaaccaacagaaaacagtaccttgctcaatcacttagctgcttatctcgatacgaaaaaacaacgaccttatgttgtccaccgtttggacaaagaaacaagcggcgctgttttatttgcaaaaaacccatttgtcttgccgatacttggaagaatgttggaacaaaaaatgatctatcggagatatcaagccatcgtatgggggaaaatcgccaaagataggactattaccaataaaatcggacgcgatcgccatgatcggagaaaacgggtcgtagatgataaaaatggtcagaacgccttgacacatgtcactgtcgacaaagtactttctggaaaaacacaagtgtattgtgttttggaaaccggtcgtacgcaccagatcagagttcacttagctcatatagggcatccaatcgtcggagaccctctttaccaaaatagaccagctgaacggctgatgctccatgcattagaactgcacatgattcatccatttactcaagaaaaaatagttggtaaagctttacccggattgtggaaatagaaagaagatcgtagtcctatcattatctgctgataagactacgttctttttgtgtaacttgtctgcttacttttgatgttcgtgttctgctaacagcaaactaccgataatcccactttcattcggcagtccccaacgaacgatatattcacttacttgaggtgtttccatgtagccacccatcaattcaacaaattgctgacgaattttttgaaggagatgatcctgattcattaccccgccgcctaaaataatcttttcaggtgctaacgtcaacgtatagttgatcagtgcttgagcaatatagaaagcttgaatatcccaaatcggatgatcttgtggcagatcttgccctttgattcctatacgtgcctcaatagacggacctgctgctaatccttctaaacagtctttatgataaggacaagtgccttcatattgatcatctggatggcgttttacccaaatatgtcccatttcaggatgtgcgattcctgaaaaaatttcctcattgatcacaacgcctgcaccgattcctgttcccacggtaaggtaaatacaactattttttccttgtgccgccccttgcttcagctccccgtatgcagccgcattgacatccgtcgtccaagcaacaggaacattgtagcgtttcctgattgtgccgagaaaatcaaattgtgcccatccttttttgggagttgccaaaacgtatccgtaattatcttttgtttggtcgataccaatcgggccgaatgagccaatcccgattccattcagttcataacgatcaaaaaattcaaatacttgatccaatgtttcttctggtgttgtggtaggaatacttgttttttccaaaatctctccatcttctgaaaccgcacacacaaattttgttccgcctgcttctattccgccatacatttagttttcctcctcgaatccgattgtccgaatttcataaggttggattatcgggacaaccgattgctgcgttggttcttcaagcagattcaatatgaccgtttttcgattgtctttagttatttctaatttttctaaatgactagacatattgaaacctctcactactactttatcactaaacttactccgtttcaaagctgtaattgcaaacgttttactttttatcgttaaatattgttgttttgatgccaatgttccttcatgatgtttgatttgttgagtggaaaaaggaatctgtgccgcgtatgcatgcaaataagtagagaatgtttcttctggtccatgtagttcaacgctgtaattgaactgatgcttacctaaacactgtgcttctggtgttggaaaatacccccaatctcctagttctcccacacagcgaagtagcgtcaccgcgatttgtccatctgctgttacttcgtattcattcaaaccaaagttaccaactgttacaccgttctgttcatcatgaatattgacaaatgcttgctgatgttgcggattcgtgggattttcccagctcctagatacatggtttgggcgctttactacttcaaaaatactatctgcttcgtgatgttccacatgtaactttgtaggaaacaagatacgcaatcgatgatctttcatttgattgtcaagagtcgtttcaaagtcgatttttttactatcttttctgactgtcatgatcgtttctatttgaaggatccgtttttctttagatcgttctgcttttcgataacgaaattctacaaccatccgttgttctttctctaaacgctcgtctgcagaaactgggatctccatttcctgtagaatacttatttttgctatttctggtgtatctactaatacttttacttcagagtcctcttgattactggataggattggttggtcatagacaggttgcttaaagatatactcgtttcctatatcaccgatatcttcaaaaatatgcaggttattccattttcgtttgtttttacgatcttccattgtaatggcaccgtttttttcaatcgtcaaacgtaggtgggcgttttcgacgattcgtccactctgacggatcattgtttccttttcttctgctttcgcttccccttctacaagcgcgaatgtttcccaagaaaacgctggcatgttttttattggtaaagttaccttgattgtctttgccatatatggcacacggaaacgatctttcggcaaatcataaccaaattgtacagtttcttcagataaaatagctggtatagtggccccgctttttgtttctacgtgatacttccgtctaggcaactgttctaactcttgatacagatgttccggtattccctcagcgaatctttttctttctaattcgatggttatttctgcttcgccagttttatccattcctgcagtatttacaacgacaaatggaaagctgtcttttggaaatccagttgtatcgattgctgtggccagttgttctaaagaatcttgtgcaagatactttccgacttcatctgctttttcaaaacgaggaatcatttcccgatggacagaatcgactgaacaaccgcaaatactgtcatgaggatgattttgcattaatgtcttccaagcataatctaattgatcgtggggataaatccctgtaacttcgtaagccatcgtcgcaagtggttctgtgatgttttctagctgccgttggaccttggtattccattgtttcaaataaacgcgagcagatgctgtattggctaaagtataccagccatccgtttcttgacttgtcaattctccttctactgaacctaagtcttctggcaactcttgtcgaactgcttccagatagtcagtaaaattagaatggatgaactcgtaatctggaaacagctcatttgcgagatgaattgcttttgatatatctttttgtactggttgatgatcaacaccattcatcattaatagatgatcagtagatgcatattgttctgcatctgctaatttctgcttccaaaagacacgagcagcttctttttctacgggaatctcgttcccattgctataccaattggcaaataacagaccaaaaatttctgtttgatcaggtcctttccaccacatctctgagtattgagaagaatagttttctgcttccagaacttgattgtcaaagccaattggttttaccccacggccaaacgccgctgctgaaataccagcttgtttcattaattgaggcgtctgtcccatatttccaaatgtatcaggaaaataacctaacatgacgggggttccccatttacggctttcttccatgccaatcagcatatttctcacgtttgattccgaactgatcagaaaatcatcttgcaagatataaaatggtccgattctcaattttccttcattgattgcttgttggagcgcctgtcttttttctggtcttacttgaagatagtcatctaaaataatcgtttgcccatccaaatgaaaactgttgaaggacggatcaacttcaaatagctctaataaatcgtctatcaattcaatcaaccgcatgtgatgctgttcgtaagccatataccattcacgatcccagtgactatgagaaatgatatatactttctttttcatttacagtacctcctatttttctactcgaatatcaaagtaatccatgactaattcgcaaaacatcatgtttgcccaagaaaaccattctcttgtataattttcaggattgttcacatcaaatccttcgtgcataagatgtgttcctgcatcagttgctacaagcaaattcaatagccgttctttttcagatttatctggtgttgtcattccttccatagctagtgcaattggccaaacatactcttttggcgtatgggaagaaccaattccttttgcgtactttccttcataaaaatatggattctctttactcaacaatgttcttcttgtttgaagataatcttcctctttttccgaacagtaacccaaataaggtgccgcgatcaaattgggcacattgctgtcatccatgaccgtcgcgtgccccattccatctacttcgtatgcataaatcctttgccctttttgattaaccgtccgtccgtgattttggataccttcttgaatctctttcttcaatatttgtgctttctgtacaatttctttatcatcgagtatcgtttggaaaatttcttccacataacctaacacgaccaccgcaaacatattggatggtaccagatatccgtaacggcaagcatcatcgctaggacggaacccagaccatgtcatacctgtaaaagttgttttggctcctcgtccgtcattgatcagcgtatcttcttttcttgtcgtatctcgtataaatgtataaggagagtgttcatgatcctgctctgtttcgaacacgcctaagatttttttgatcccttcaataaaagttgggttgaattggtccgtttttcctgtatttttataaagaagataggccaactgtatcgggtagcataaagaatcaatttcatattttctttcccagatccaatcgttcatttttgtgtgatctgtttggtgtcccgcaccgttcgcttcttcattgaaggcattcgcatatggatcgatgttgatataaaaaaattgctttttgaccaacccactaatcatgtcagctagttcctcatcttcttttgcaatcactaaataaggacgaacttgtgcagtagaatctcgcaaccacattgcaggaatgtctcctgtcaataaaaaagtagtaccgtcattttgctttttgactgttgtcaataatgtgttggcaaatgctgctgtaaaattcgttgcccagtccgcatggtttttcccgcatttttgtgtgatatcattcataaatttttgtactgactttggtatatctttataaaccatataaatttcctcttttcatttgatatatctttaaagattatacctcttgtgtcattttatgtctacgctttcaaaaaaataaatttttatttactttttcatctattatggtattatttaaatatgatatatcattaagaggtgtttatatgaatcaaccattgtaccagacaatatttaatgatttgcaaatggctattttaactggtgaattacctgtagatagccaactaccaactgaaaaggaactttcccatacttataaagtaagcagaatcacttcaaaacgtgcattgactgaattagagcaattagggctgatttatcgcgttcgtgggaaaggcagttttgttaaatcagcttctccggagcagatgcttccttcacctacaaaaacacggcggattctgtttcttcttccatatgtcgctgatttgtctgttggtgattttaccaagggattgaatcctgtgatgcaggataaacagatggatgtcatgatgacgacacatgattttttacaaaataaaacggcaaaagaactcatccatgaatttgatggattgatttattatgcctttgatacagaacagcatcttgacttgctttttgagctttcattaaaggaattccctgttatcatattggataaaaaaatctatgaattgccttttcctaccgtgctttccgacaacttccaaggtggtgtgctcgctacttctcatttgatcgaacagggacattcaaaaatcgcttatttatttggtgcacagactcatccacaatccgtacgtcagcgttaccttggttaccttgaagcattagacaaagctggtttggctttccacacttcgctggatgacaaaagcgcgacattcgatgaattgctttcttatatcactaagtatgaagtgaccgcttttgtttgcgaaaacgatgttgttgctatccagacgatgaatttcttgagacagcatgattatcatgttcctgaagatttttcaatcatcggatttgatgatatccaagcagccgctcttgttgatccaccgctgacaaccattgcacaagattttgaacagttaggcaagcttgctggagaggctttgatcacttggttagagacaaacgaacgtccttccgacagcaaatttccagtttcatttatcaaaagacaatcaacaaaggagaaataaaatgaatatcggtcaaatagatactagacatggcacagctaatcagccaaatttctctaacgggaactgccagccttacactggcgttccttttgggatgaattattttgcaccgcaaacgaccgatcaaaacggcagctggtggtttcatcctgaggatcgtgtttttcaaggttatcgacttacccaccaaccaagtccttggatgggcgattttagtcatatgctgctcacgccaatcaatggtaaattacaggaaaataccctttttcatgctcaaagttcttaccgcccagaagaaagtatattttgcccgactcatctgtcgatccgtcaattgcgttatggcatccgctctacattgatacccagtatgtatggcggaatcttatctattgattacagcagaaatgatagcggtttacttttatcctttccgggacgtcatcagctctttgttatagatccttacacagtggaaggaaaaatcacacattttgctggttcagaagatcctgatttttctttttattttatattgagatttgaatatcctttaacaattgatgagttagctgtttccaacaaaaatagcgattcgaccccgttgtattttgaacagacaaaaaaacaaatcatccgattcgggacatcttttatcagctcggaacaagcagcttataacctagaactagaacaaaaccaaagcaaagagacttaccttgctaacagccagaaacaatggcaatcctattttgatcgtatacagctcacacaccatgatcaacaacaattgcggacgttttatcataacttctatcgagtgtttttatttccgcagacattttatgaaatggatcctagtgggcaaaaaatccactatgatacgactagtcgatctgtgaaacctggtgttctctatacaaataatgggttttgggatacgtataaaacggtttatcctctttattctttgattgctgtagaaaagtacgaagaaatgctggaaggttttttgaatagctatagagaaagtggctatttgccaaaatggctgtctcctgacgaacgtggactaatgcctgggacattaattgatgcagtcattgcagatgctgctgtaaaagatattcggccagacttgatgcaggaatttctaacagcaatgaagaaaggcgctacagttcaaagtaatcatccaaattatggacgacaagggacagaggattacttgacatacggctatgttcctaatcactaccatgaatcggtcaatcatacgctagactatgcttacagcgacttttgtattagtcaagttgccaaagtactagcagaggacgaaacggtgaaaaaatatcagcaacgatcattgaactatcaaaatatttttgactatgagacaggatggatgcgttccaaagataaaaatggcaaattcagagaaccattttctgctcatcgttggggacaagattatgcagaaggcagtgcttggcaaagcagctttgctgtttatcatgattttgcagggttgatcgaaaaatatggcggcagtgagagattcaaagaaaaactcattgatttgtgcaatcaatctccgacatttgaaacaggaggatatggttttgagattcatgaaatgagcgagatggctgcgatagaatttgggcagttagctatctccaatcagccaagttttcattacccatacttgttcagctatattggacaacccgaaatggcacagccattgcttaaacaattgatgactcaaactttcaacgattcttcaacgggttaccctggagatgaggacaacggaagtatggctgcttggtatatcttcaatagtctgggattctatcctgtcacaccaggaaccggtgaatatgttatcggtatgcctttaatggacaaggctgttgtgcttttgtcaaatggaaaggaattgacgattgaagccactcctaatcggccgcaacagcaatttatccataaaatcaatcggatggacaaagaatatacgaaattatattttacccatcaagatttgctgaaaggcggcaagatttcttaccaattaggtatcgtccctcatcctaagaagtatcgatcaaaagatttgcctttttctttatcaaacgataactaacaaaaggttgtgaaaaagctgtcctgcatcaagtaataagaacagccaaacaaaaatagctcctcctattttcgtttggttgggcttattaccgcagatgcaaacttttgaacattgattcattccatacgcttctttttttaggattctcctcttttttcccgatactccttaggggatctgccgacaatcttcttgaataatttagagaaatacgtggtattgttgtagccaatctcacttgctatttcattgacgttttgattactgtgcaaaagcagctgctttgctttttccatacgcaaatggttcaaataagctgaaaaactttttttcgtttcttttttgaacaactgccctaaatacatgacatttaaatgcaaactttctgacacttctttgagtgtaagtggttcttgataatgctgatgcaggatttcgattactttttctacattgccactgtattttttctgtctctggtgcttttggacgaacgacagaagaagctgatggagttcttgcaccgtttttgcctgatgaattttttcgattccttgtaaatattcctcatcttctagatcaatcaattcccgttgaatctccataaacagtaaaaagctggagtaccggatgtcttccggcatcatggctgctaactgaaattgctcgaaaaaatcagtgatcattttttgggcatcatctaatcgtttattttgcaacacacgtctgaaacttgaaaaatcgatggtttgctcttttattgttgcttgtattgcgtaaaaaacatgctcgtctttatctccataaaattgatgtaattgtagattgtctttcgcttgttgaaatgtttcagggatcttgtccaatgaatctgtctcttccccgatactgatcagccattcctgatcagggatgttttcttggacaaaacagcaaaatccatcaacttcatctgcctccaacaacagcgtaatcaatatacggtctccataatttctttgataataaaagatttgctggtgttctttcaaccatgtattgataagaggatcaatactattctatgctgtttctcactgatttgtcctattatttcttcttcacttgcttcatctaactcttcattcaaccattgactgaataatagttcctgatagatttcttgctgatttttttgttcattttgctggtctaaccgtgttttgattttcttgaggctttcaatcaattcgaacttattcacgggtttcatcaaataattcactgcgcctaattgcatgccttctttcaaataatcaaattcttggtacccggacaaaatcataaattcaaaattatgatgttctttttgagccgcttcaataaattccagtccgtttatttctggcatcgtcacatccgttaccactagatcaatccgctgttgctcaaggacagatagtccttctttggcattctccgctgttgctactatttggaaccctaaacttttccaatcaattatcttttttaacccattcaaaatcatgtattcatcatctaccaataacacctggtacatgttcacccctccttgaatgtaatagaaacagtcagtccacctgtctcattattctcaagcgacatgtaataactgctgccgaagttggcacgtaaacgttcattcacgttttgcagaccgattgattcgtgaagttccactttgggatgagacagtttttcttccacctgttttagccgtttttcagtcatccctcttccattatctttgacgatgattcttacccgcttgtcttcctgtaagactttgacacttagggcattatcaaatcgagtaaaatcaataccatgtttaaaataattttcaactaatggttgaatcacaaatttaggtacttcgatcttttccaaatcaggatcgatcataaaatgataggccactcgattaggataacgcatttgatataaatagacatatttttcgcaaaagtccagttcttctttcaaagtgatcgtcttctcttgatttgtgttgtttcggagcaaggcagaaaaagcatatacaacatctgctaattcttcgcttccttcgctgattgcatacattcggatatattctaatgtattgtataaaaaatgcggattgatctgtgcttgaagcgcccgcatatgtgcatcttgctgtttgatttctagtttgtagatgtcttcgacaaattgattgatgctatccaacatttcgttgataccgattgaaagttcctttagttcatattccgtttttgttgtatcaatccgggtttctaaattccctgctgctgtttgctccattgcctgcatgacgatggatatttgctgtgaatatcgtttgaatgttttataaagaaagataagcaatatactgtctaaaacaatgatacctacaatcagcggggcaaggtttttccccgtttcgatttttacgctttttttatctaatacagctaatattcggtaatcatccgacagttcttgatgttggataaaattattttttctcagattagcaattggcaattgtgaatttttctgaagactctctgagataatcgtttcttgtcttccaaacgtttctttagctattttattatcatggaacgtatacaagcgatttgtcgtgccagaaatcatgtataaagagagtccattgaatgacgttagattctctaaaatcgtatctagctctttcttttggaaaccgataaaaatactgcctgactcagctcctccttgtgtgataggcaacttgatataaaaggcgtctagtaattttggcgttcctgcttttacttctccgcctttgttttctctagaggattcataatactccggtagctgattcagtacgatatataccgcacttagttcttcataatttatataaagatctttgatttgatttgggaaagaaactaattcgtcggtactgttttgctgctcatatacatacatcaaatactgatctatgggttttgttaagtaggtagtgacattttcgattttttcggaatcaccgacgagttggtttttaatgatcctactcaaagttgttttgtcattcagcattctgcttgtactttgaacggcatcacttgtcatgttttctgcctgcttttggttttgattccacgtatggacactaaaaataatagtagcagtcatcgttacaccaatcatgataaccgcatatttccgcaacagccgattcagtaacgttccttttgaaaatagaatccggatcctattcataactttccaactgtttatctaactcttcacgccactgtttcgtcgtcgtaccattccaaaccgtcaaaagaccaatgacaccaaataagatcaatcctttgaattgccaagtcacagctataattataccgctaccaataattgtttttagaaaagacgaaaagctggaaaaaaccgaaataaaactcagctttagtagattaggaacagagatcgtatattcactgtctaaaatcatactgtattgataagtagcaaatagacaaaataaggcaaaaagcaaaataaaatcaatagctaaaaaaatgagtcctttgatttgaacagatagatatagattgtagctcaataaagcagtactagataaaaataaaccaaatagcagatttcctcttaaaaaatttcttttatatatattccagcctctttttaacgtgatttctttatactcgaatccatataaataaaataactcattgactgttttccatgccgtacctaatccaaagatgattccgccgacaaacgtgtatatccagaaatataaggttagttttataacgacccagattcggataaacaactcttccaaaaccttccctaacatatcttctcctccaaacattaagtttatactttctcattatacaaaaaggttgggcaatcagcaccatggcctgagtattaaaggttgtaaaagagctgccctgcatcaagtaataagaatagccgaacaaaaatagctctctacgtttttcgttcggttgggctgattgccgcagatgcaaggttttgaacaccgtttattcggaacaagaggttgcgacacgtttttgtcacaacctctttgtctttattcattattgttcttgtcgaaactcgtcatattgtttttgcatttctttcaataccttgtcataaccagctttatctaaagcttcttttaatttcggcaatgtttcatctggatcaacagttcctgtattcaatccatccaaatactggttcatgacatttgaaatattacttaattctgttttcacactgtccgtgttgaagctgaatcctaaaatcggtgaagtttctgcttcagcaatcgattggtcgcgtttggcaatcatgtcatccgtaatggactcttgtgtatatagaatcttgttgtttcctgtattccaagcagacatatgtgtgtttggctgataaccatctagcaatttgattttatcctctgaaccatcgactttttcccatgcttctccttcgattccccaaacaagtccattcaataattctggatcactgttaagcagccctagaagttctactgatttttctttattttttgaagtattggatacgacaaaatttgccatttgtgcttgagctgtagatttcaatggaacagtaattgcttttgaaactagttcttgttttgctgcatttgtcaaaatcgtatcgccataatcatagggtccttgtgtttctccacgcatcagccaagtatttccttctagtggatagtccttattgctcgttgcagcgtcacttggaatgagtccttgtttgtaccagctatgcatcgtacgcaacaggccgatatacgtttcattgtcgtattgattgatgatttttgaatcatctccatccagatcaatagcaaatggtaaagtgttccctaaaggatagtcaaagtttccttggactttgaatccttgtccaatggcaaaagcggccgtgtttggttctttttcatggaattccttcaaaactttttctgcatcagcgtaagattggattccatcaattgaaagatcatatttatctagtaaagctttgttaaaagtaagtacttgttgagcaaagacatttccatttactggaaaggcatataatttcccattcaccaaatttcccttgatataagcttcatctaaatcattatacgctttttcagcgtacttaggcgctaattcagtcaaatcagcaaaggctcctttttgagcattggaaacatagttgttcgcaaaggcgatatcgtaattttctccggaagaaatgatgacgttcattttcttttcgtaatcgccccaaccaatgtaattgatattgacttttgcaccgatctctttttcgattcgtttgtttgccacttccatcaattgatcgaaattatccggtttatcaccgatttgatacatctgcaaagtgtccgaatcactagcttctgcttgctctttagaaccagaacctccgcatgccgctaatgtacctaccaataatgctgaaacacctgtaaaggctagtttcttccataacttcatttttcttcctcctaattttatgatttatatttttttattcttttactccaccgatcgttagacctttgacaaaatgtttctggaaaaatggatagctgatcgcaataggcaacgtagagataactacgatcgccattctggcggattctcctggaactgaagctagcccacctgtcaattggcttcctgctcctgaattttgcgtcagatattgaatattactttggattttcatcaaaagatactgtagtggaactagcttatcatcttgaatgtatagtaaagcattgaaccagtcattccagtaacccaatgcggcaaataagctgattgttgcgataccaggaacagctaacggtaaaacgatttgaacgaatattcgaagttcgctagctccgtcgatccgcgccgattcaataatcgaatcagagaccgaacgtttaaagaatgtgcgcatcacaataatattgaaggggctgacagccattggcaagatcaatgcccaaatcgtatcttttaactggagaagatttgtcataacaagataattagctaccataccgggtgagaacaacatcgtaatcaaacaaaaaacggtaaaaaaacgacggaatggaaaatttgaccgcgaaatcgcataagcatataaagaagtagccgtgctattgatcagtgtacctaaaacagtgacaagcatagtaacataaagcgcttggaaaattttatcctgcatctggtcgaacaaatacgtataaccaaatagactgaatttttctggccaaaaactgtacccgtgcgtcgacaatacggactcatcggtaacagagatggcaataacaaatataaatggcaaaatacaggaaatagcaaagagtgcaatcattatattagagaaaaaattggtcgtcttattgaaagaacggacttggactctctccactttcttttttttcatttttttcctccttagaataatgcagaatcgctatcaaaacgacgggcgaccgtatttgtgatcatcaataagacaaaaccaacaactgattgataaagtcctgcagcagccgtcataccaaaatctcctgtggatgtcagcccattgtagatatacgtatccaaaacttgagtcacatcgtacaatgcaccggaattcctaggaatgttataaaacaggccaaaatcagctcgaaaaatgtttcctacggctaaaatcgttaaaatcgtcatcaatggaatcagttgtggtatcgtcacatgtttgatttgctgccatttgctagctccatcaaccatagcagcttcataataagtcggatcgattcccataacagatgcaaagtaaatgatgctgttataaccaatccctttccatgtaccgatgaacactaagataaatggccaatatttcggttcattataccaattgacagcttctcctccgtgtccagtaatccactggttgaatattcctttgtcgggacttaaaaaggcgtaaacgaagtaactgataatgacccaagatagaaaataagggagcaaggacatcgtttgataaactttaacaagtcgtttatttctcaactcgctcataatgattgcaaatacgactgaaatgagcagatttaaaaggataaatgtcacattatataaaattgtatttttagtgatgagaaatgcttggtccgaagaaaataaaaatttgaaattttcccaacccacccaaggactttccctcaggctagccaggaacccatctgctgaaatatgaaaatttttgaatgctacgacattcgccattacaggtatgtaaaagaaaaaaatcatccaaagcatacccggtacagccatcaggacaagtgctttataacgccatagattcataaaaaaatgattgaacccctttcgttttttcatctaaaaacccctttcgattcattcgcaacgtcattatagcgctttcaataatgagaataaataaacaaagtatagggaaaatgaaacaaagtataggagaggttgtgaaatcagcgttttgtcctgaatattagggagatcgtgaccttactatctaactccgagtcacaaggagcaatggggactgtgacaaaagtcttgtcacagtcccttattctgaacaaacaatgttccagaagtagcttctacggaaataagtcgaaatttcacaaaaaggccatccaaaagtcagacggataagtctgcttttcagatggcgctacaactacgctacttattcttttaactgtccattcacttatttttctctcacttgttctagctcttctttggtcatggggcgatactgccctttattcaaatctttaggcagccaaaaattccccatacggattctttttaaatataagacttcttttcctactgctttgaccattcgcttgacttggtgaaacttcccttcatgcaaaatcagtcggataattgaagtttctgactcttgatctacttgatcaatttggagttttgccggcaatgtctgctcatcgccatcaataattaatccttctgcaaataaacggatatcttcttctgtcattataccgctaacctcagctagatattctttctccacgtgtttttttggtgataataactgatgagcaaatatcccatcattcgttaaaatcaggaggccttccgtgtctttatccaatcggccaactggaaaaagatcttcccgataatcttgatctttcaacaaatcgattacggtttggtcatgattatcctgagtagcagaaatgactcctgcaggtttatgcaaaatataataaaaatctttttgatacgcaatgatttctcctaaataagtaaccgtatcttcaaactcgtttacttgcgttttatcgcttttgaccacttgcccattgacttcaatcgttccttttttgatcaatcctttgacttctttgcggctaccaagtcccatatctgctaaaaatttatctaaacgcatgcgtttcccccatttcaaaagagcattgattctgctcttcccattcacttattttatttttaatttgtgtcgtaaacgcgctattcctggtcctagtagtctttctgccaaacggattttcaaagctaaataaccgtacaccaatgcccctatacctgctactgcaagaatcaataatagagactggaatttgctatcttcatttaagaaagtcccaaaaatcatctttgtgatccacgaagcaaaaagcataatcaaggtaagaataaagatcagtaatgtcctacgccagacaaaacttggtttaaagcgggctacttcatggatcctctttaagattaaggtacaagacacagcaaacccgagcattgtcgctaataaagggccatacacttcaaataaacggatggctggatattgaagaagtagtttcaccagaaacccaacaaccaaataactgattgctgccctgttttcaaacattccttgcagcatgttggaaactagcatatataaccctaagaagagtcctacaaaacttgcttggatcagtacattgcttcctagagaatctggtgtataaaataatgtgtttagcggataggcgagtaacatgacaccgaatgtcgctggaaacataaaaaatgaaaacagttgtaaatttccgctcgtcaattttgccagccctactcgatctttcaacgtaacagcttctgtaatcaacggtaacccggtagacgcaatcgatgttgccaatgcgataactaccatcgtcaacttatctggattggcactgaaaatcgaaaaaagatctaacaactgtgcgttggaatattcagtggatgcggacatgatcctcataaaagtgaattgatcgactaatttgaagattgttacccctgaaccaacgataataaacggtattgcttctttaatggtatctaacaacaattccttcgttgcaatatttactttgttttcgctgtagtggataaatgcagatgtatacgcttgatgtttcttcaaaaaatacaaaaggacaaggatacttgctagcataccgataaatgccgcgaaagttgattgcgtgaccgctgtcacataatcgccattcatgactttcatgatgatgaatgtagccaatagcatataaaaaatacgtgccacttgttcaacgatctgcgacagcgcataaggcatcatctcttgattcccttgaaaataccctcgtatcacactcatacaaggaaaaaccaatacagcgatactcaaagagcgcatcgttggaatcagttcttctccgccaccagaagcatgagctagccaaggagaggcgatgtacatgaacaaagcgaacaacagacctaacccgcccatcatctgtaatgcccggatgaataatcgtcgtgaagtgccatattcattcaacgaattatatcgcgcggtttgttttgcgatcgccgcgggtattcctgctgtagagatcagtagaaacaatgcatatatattgtaccccatattgaataatccattggcagccttagcattttcgcccatccaagcataccaaggaatgatatagacagctcctagcaaccttgaaatgatattactggcggtcatccaggcagagcctcgtgccattttttcttgcggtgataattgatctaatgctggttttctttgattatccatcggtcagattccaactttctacaaaacattactatcattttaattggtaaaacagaaactggcaatcgattttatataacttttataagaacgattgtttttttgaattcggtttcgtttttttggtaaagtaaagaaatatacagccttttatggctaacatttataggagatatcaatgacacaagaaataaaaaaactacccgttatatttttagatcttttctttatcacagttggattgaattggttcttgctccctcatgatatagcttccgccggagtgggcgcaatcggacatttagttgaaacggccttttctatccagcgctcagttactgtttggatcatcaaccttatgatgctgcttctagccgctgttctattaggaaaatcagtattttttaaaactgtagcgggaagtctgctttttcctgttgttttagagattgttccaaaagtggaaatgctctcctcacatttcttttcactgatttcaggaagtcttttgttcagtcttggggtttacacattgtacaccgttggagcctcaaatggcgggataacgataccgccgattattttccacaaattttttcggcttccaatgccgcaaggactgttacttacgaatagccttatcgtctttttgaattattatgtatttggatggttagagacactgttcgttctcctatctattacagtcagttcattgtttatgaaaatactcatccgcttgtcccctgtgtcaagaaaatttgaataaagctggattttgtcatagcggaatcaaacgatatattgaaaagagtgtgctataataaatcaagaaattgaatgaagcgagggatcaatcaatgagcttctctttagaagacatccgtcatttactattaaaagaacatctattaaaagaatttgtttcaacaaaaggctggcatcttgatgtaccagaaaaagctgaatttcttcagttaagttatgattcaagaaaagctgatgcttctactctgtttttctgtaaaggaatgaatttcaaagaagaatatttggattcagcgatcgaacaaggtatccaatattacgtatcagagcagccatacgaaaattcagcagtaggaatcattgtgacggatatccgtaaagcaatggcacttcttgctatggccttttacgactatccacaaaataaattgaaagtgattggattcactggaacaaaaggtaaaacaactgctgcgtactttactaaagcaatcttggatcacacaacgaataaaaaaactgcattgctttctacgatgaatacaacgctagatggcaaaacgtatttcaaatcccatttaacaacgcctgagtcattagatttatatcgtatgatggaagaagcagttgaaaatggtatgactcatctagtgatggaagtttcttcccaagcttacaaaacacaacgtgtgtacgggttgactttagatgtaggaatcttcttgaatatctcgcctgaccatatcagtccgatcgaacatccgacatttgatgactatttctattgcaagcgtcaattgatcttaaactcaaaaacagttgttttgaatcacgaaagtgactattttgatttgcttaaagaaaccgccgatctattccagatcccaacgatcacttatggccgttcggaagaaagcaattatcaagtgatccattcagacaaaggtacccacgggtttactttatcttctcgtcaagatcacttagctatctgcgatactgcttatgatattttgctggccggaggattcaatcaagaaaatgcagccagtgcgatcattgccgcagcactaaccggtgcttccagtcaagatgcacaagccggattaaaagaagctcgtgtaccaggtcgaatggatcaattgatccaaacaaatggggcgcatgtctatgtggactacgcacataattatctaagtttgaaaacattgctagaatttgccaaaaatgaacatccagatggtcgtgtaattgttgtattaggcagcccaggaaacaaagcaatctcccgtcgacatgattttggaaaagtgctatcagaaacagctgacgttgcctttttgacggcagatgacccagcatttgaagatccgcaaaaaatcgcggaagaaatcaatgaagcaattactaatccagaattgatcgttcattatgaaatggaccgtcctgaagcgattcgacgtgctttagcagaaagtactccgcaggattcagtcgtcattgcgggaaaaggggttgatccctatcaaaaaatcaatggtgtagatgaaccttatgaaggggattatgcaatcgtgaagcggttgattgaagagtaatgttatttatgttctagtggacgggacgctatgaaaagaaaacttttcatagcgtcccgtctatgtcttttgttttaaacatttactagcctgttaccactgactctacaattatcaagaaaagttgccggataattatatgaaaaatctcctatgccatatcgcaacgttcctctcatatatatgtccaataaagttcctcctcctcgagtttcagcccaagaacgattatgtgaccatgttcctattaagaatccgctagaataacttgaccccaaaaaattagtacttatcacacgtccgcctgaaatagttactctaaagtcctgatttatgtaaccatgccctattgctggaactccagaccatactcgagcagtataataactcccattatttatgattttcttttctgcatctgtcttttctgtgtttaaagtcatttcatataaattttctttaaattgctctatatcttcactaattttatcttttattatttcttcattataccctttatagataacgttttcatttatttctacggtcggattttctatcgttacttttagtttattctcactaataaatttgtttaaatcaagcgcaattttttcattcatttctaattctaaattagacagcatttctgaagacatactttgctgagtatcaaattgaacctcttgggcttttactacaggtcccatccctaaattaattgaaacaaacgttgttaatactatagctttaaaaaaactatttttcataataaaacctccaaaatttatagtatttatactaattaattagtatactttaattatattttattattcctattttttctatatatttattattttttcaataatataaaggtggttattatgaaaaaatttttcaacttagcaaacggtatcttttttctttctcttttttctgtcatttttctaactttgaatttgcaaagtggcaaaatgggggtcgttatttttagaaatctccatttgccagttgatgcatcgattgttggatggttactgctacttttttcttacttgatgagtcggaagcatcagactaagtttttcgcgcgcttaggcggaagggttgctctattttttctagtcgtttatctgatattcacatgtctaggtttgcttcagtcgctcggtattctgccttgatacttcgttcgaatcatattgactataataaatagaggctgggacagaagcgtttaactccaagaaataagaaggaattcacgaaaattgcttttcaaatttttgtgaatttcagcttatttccgaaggagttgcttctgcttccgccgtttacacatgtttagagcgtgagacaaaagtttttctttacttttgtcccacactctcttagaaatcagttagctgacttttcgccagctaattctgctgccttttctctttcttcattcaataatttattatcatagaatttaataaatgggaaccagataatgaatgcgatgattgcacaaaagacagctagcacagccgctttccaatcacccccactgccgacaaatgcgccaattccaactggtgaaggccacggcatctgtgcaagcatcggtttaacgatttccagccgaatggcaaaataagcgagtgtagcagaagccatcggtgctaagaaaaacggaaccgctaaatagggattgtaaacgattggcatcccgaaaataattggttcgttgatattgaatagtcctggtacaagagaggcttttcctaacactttcagctgatcagatttcgcgaggaatgcaataaagatgatcaatcctaaggtcgcacctgatccaccaacggttacataagaattgttgaattctcctgccaacggataatttgcgccttgtgcgttagctgccatattagctaatacgattggggtcaagaaagaagtgatgatattcgctccatggattcctacgatccacaatgcatggatcaagaaataaattaccatgacaccaagccacgtatttgtcagctgcgtaacaaacccaaatgggatagcaatcattttgaagatatccgttcctagcgcaactaataatccattgatgatcatcaccacaaacgcaatgacaaatgttgggatcagagcagtgaaagaacgagaaactcctggcggaacaacatctggcatttttatgacccaatttcttttgacacacatacaatacaattcgaccgcaataatcgacataataatagctgtaaaaattcctgaagttcctaaacgttcgacaaaagagcccatccgtatcccatttactacagtttctgtctcattgatagaagcaatcaagctgattttaccatcagtcatgatcaattcagggatacacataaagaatgcaaaaacagatagtaatgcccccgtgagcggattaacgttcaacttttgttcatctcgttcaattgacgttaattcataagcaaacacaatggcaaagtaaatagataaaatccccatcgtcattgtattgacgatcatgtacaagtcactaactttgaaaaaagttgcattaaaaaatccttctaaaaatgggaacggtaatggcaaaatattcaaaaccaaaaacatcgaacctacaatcgtgaaaggaatagaagccatccccgctgccatgacagcccgaacgattttaagttgcgcaattttccccataggtcccatcaggtatttctgcaaaaaatcaaacattaattattctcctttcctaaatacaacgctttttcatattgttttatacggatatactgctgatcttgattgagcgaaattttctttaaacgatactggataaatacactgacaaaaataccgcttacaataagaatgaaaacaaatagctgtcctctattgttatttgccataaaaggatacaagagagtaaatcctgaggtgaacaacactggaatcaataatatattgcagacaccctgaaacaaaaaataccgctttgtccatggaacattcgtttggtgctttcgataaagctttacttgttctcctactgcaggcaaaatagctaaaagtagaaccattggtaaactgcttcctaaacttttagctgatagaagcagaatcatccattgcatgttcatgaaaaagaaaaaggcagtcagatagcgtacgaacagataacgattgaaatacatgtttttcaaactaagttgctttttttctaattcgtttttcttttttactgtatcctgcacaataaatcttcctttctatttatttttttgatacaaataattcatttcctgtgcaacttccaataatgtcatcgtcgtcatcagatgatcttgtgcatggaccatgataatttccatttctatttttgtcccactagcatattctttcagaagttgagtttgtgattgatgcgcatgaagaatctcttcatttgcttgtcgcaacttctcttctacttcttcaaacatctccttacgcatcgagcgaaatgcttcatgtatcagtgttcgtgcatttccgctatgaaaaatgatatcaaaagacgtcacttgtagcgtttcactgtttattttttcagccacctgttttcctccttattcgatcagtttgataaatttactgctgaaattctcaaaaataggttcagctaagatttcctgttgcacgtttagctggtcaactaacctaacgattgctttggtcacgaccgtaattccttcattttcgatataagaaggcgaaactagaaaaacaaaatggattccttgatactgataccattgcatccctgaaggaatcaatgcaacggctacctttgtttcgattccaactggaacagcgggatgtgggactgccactgtatcactgaatatgatttgtcccatactttcacgttgctggatctgctttcgcatttctcttatatatccttcttcttcatttatgctcagcttttgcaacaaatcatgaagaacttcttctttttttggttcgtacgtataagtcttgaaaaatttttcagacagctgctcggtgtaaatctgctttttttgctgtagagaaaatactggtatcggtcgatctgaggaatgataaggtatggattcaccaattacctttcgtattttatgaacatcatcttcattcaaaaaaatactgacatgtaaaactggaattttaaaaaacattgtcgaaagatcaatagaagaaataatcaggtcgattccttttaaagttgtttcattgatctcataatagccttttacatttaccactgtaatattttttccaaattcgctgatcacacgattctttaataattgagcactgccataacctgttgcgcagatgatcaacgcatgtaacttatgcgtagctctttctttttccaatgccgccatgagatgcaaagccaaataggcccattcatcttcattgatggtatagtttttcaaagccggcatgttgctgaaatgtgtttttactgcttcaaaaactttgggattttctttctttatctcttcagtcagagggttctcaatgcgaatgcctcggctcaatcgaatcatcattggtgacaaatgatcaagcagtccattgaaaagctggtgatcctctattaatgaaaaacgaaattcctgagacaatcgcttcaaaactttcactacttcctttgatagttcctgatcatttttattttctctatgatttgacttagccataaggtgtaaagtcaaataagcaatttcttcttggggaaacgatacatccgcgattacctcaatacgttgaacaatgcgttgcgccacttggtactctactcgatcagaaacttcttgttcgatacctagttccttgatttcaaacccttctcgtagacgtttgattcccaaagccaagtgtaaggacaaattctgtatgataaaatcagaaacttttaacttagcttctcttgtttcatcgagaatgatgatcactagctcttcaaaactgatgtctgtgaaaaagcgactttgtcctaaatattctttcaatgaatttccacaatggttcccgaaaaaagtatccatgataaaatgccgtcgatttctttcttccccttcgatccatatcccttgaccatgcttagaaacaatttttagtgaataaggaatcaaccgctctttgattgcttgcatgtcctttgtcaaactagaacgactgatataaagctcttctgccaaatcatccataaaaagaatggcatcttccaaaagcagttgattcaatatatacttttgtcggtcttccgactcataaaatccttgaggttctctagcatatcccggtactatttcttgccgactcaaaaacagatcaaatgtcaatctctgcaagatgtgcagttggtagccataacctggtttagcaaggatcttacctccgttttcttctactaactctttgatccgctgcaagtaattacggattgtccgatcagataataacaattcagaagctaaacgttgactggtgacatactccttcctgtgatcaatcaaatatctcaacagcaatttttccttctgtttcattatcatccactcctattccatcatatgttctcttcgatcacctctgctaacttctggatgcctgtagggattgggacatacgcttggaaagggatactaacaacaggctttccaacagattctcctaattttttgaatttatccaaaaacatcgtcgtttgcgggctgatcagaaataaatcaaaatcactattcttaatcatattatcgccttctgtagctgaaactgcatctacgagtacctcttctcctttttgcttaaacaaatccgttgtctttgaggccatcatcgatgatgacattcctgcggcacaaataatcaatgcttttttcataaatcaatcactccttttatttttataaatcaagcataacttgtaagcgttttctattcaaaatatatatttccgtagcattacggaaaaaatgtgtatcatatcttgaataataatttctggcaccgtgatatactagtgatagaattttttcaggaggggatttagtgagtatcacagtgaatattttgtatacaagtacaaatggacaagccagaaaatttgcagaagaaatggtcgaaagaaacattgtcaaagcgattcgcgcagaagaaggaaacgagaaatatgactattactttccactagaagatccagaatctcttttactgatcgaccgttggaaagatgaagaagcaatcgaaaagcatcacaaatccgaaatgatggcccaaataaacgaactccgtaaaaagtataaattaaaaatgaaagtcgaacgtttcactgatctaccttaaaacaatgaagttgtgacagacatggtcagtttcaagaaacaagaaggaatttacgaaaattgctactcaaatttttgtaaaatttgggctcatttttcgaagaagatacttctggaacaccgtttattcgtaaaaagaggctgtgacaaaagtcttgtcacagccccttcttcatttttttcattattttttagtggaacttaccaaaggattcacttcatgtttttctcttatttttcgtataagtatttcagtcaacccaatatacatgacccctagacataccccaagaacattctcaaagatacggattgacactgctcctggaaccccgaataaactggcagtgattgccaaagcaccaaaacaattaaaaactgttttatatctataggtagaacaaacacctaaagctagaccacctaatataccgacccagttaaaaggaataaattggctgataccaataaataaagcacatccaatcaatgacccaatgattcggtctactgctcgttctttgaaaccaatcgacatcaatccatagctagatacaatagaagaaaatgcaaaccctgcccacatcaatcgctgaaaagggacatactctcctgcaacaatcaaaaagctaatgccaaatgcatagatgagcatccaaattttttcctgcgaatacatgcctttcaaaaaaatctctttaaacaagcttttgtctttgttcttttctcgatgttttctgtaaaggagaactgaaaaccaacaaaaaaacaaaaacaataagctacttgtttgtgtaaagaaattcttgttcaacgaatctttaggtaacgaataaacaataaagagatatgaaaagccgtacaaagaagcattccccattttgggatcactagcggttgccattaatatgctgcttagtaaaacaaaatgaatcaacatgcccataactgtccatttaatcagatggacataaggcgctgttaatagtgagagcataacgatggctaaactaatgatcgaatgagaaatcttataaccaaaatcaacaaaacgaatactcatcaacatacagaataaaaccaccgcgtatggtttatgcgtcgattcaaacaatgttgtaatgaaaataataaaacaaatggcaaacaatacgatgaataatgatcgtaaaaacaatgaacaaatatacatgcacttttcttttttagaagctgcttctcgtattttttgttttaaaataaacggatctagttgtagagactgataaaaattcacctgttgtcgtcctttcttttacttttatttcaatattttttacagtcaactatgacaggttgtaaatactatggaacatcatatggcgttgttattttcttgtcaactattttctctattcatgtttttttacaaaaaaacagctgacagagattctgccaactgcttttatcaggttatttaattagcaacgatattgactaacttatttggtaccgcaataacttttctgactgttttgccttcgatatattcttgcactgtttcattggctaatgctactttttctagctcatctttccctaagtctcggggaacattgcttttcgcacgaactttaccgtttacttggaaaacaacttctacttcgtcttccacaagtgctgcttcgtcatatgttggccatggtgcgtaagaaataccaccatcatttccaaggatagaccatagttcttcacccatgtgaggagcaatcggtgcgagtagttgaacaaatccttcgatatattcataaggcagagcgtccactttataggcttcattgataaagaccatcaattgggagattgctgtattgaaatgaagattttcatagtcttctgtcactttttttactgtttgatggtatactttatcaagtttgccgtcgttcaatgtagtgatacggtcacgcattttattgttttcatcaacgatcaaacgccatacacgatctaagaatttacggcttccttctaagccattttcgctccaagcaatcgaagcgtctaatggtcccatgaacatttcgtacatgcgcagtgtatctgcaccgtaagtttcaaccacatcatcaggattgactacattaccgcgagattttgacattttttcgttgttttcgcctaagatcattccttgattgtatagtttttggaatggttcttttgtaggaacaacaccgatatcgtataagaacttatgccagaatcgtgcatatagtaaatgaagcaccgcatgttctgctccaccaatgtagatgtcaactggtagccaacgcttcaacttttcataatctgctagttcttttttgttatgagggtcgatataacgcaggtaataccatgagcttcctgcccattgtggcattgtattcgtttcgcgacggccttttttacctgttacaggatcaacgacattgacccactcctcaatatttgctaatggagattctccagtaccgcttggcttgatattttttgtcttaggcaaacgtaatggtaactcttcttctgggacagctgtgactgttccgtcttcccagtggatgattgggattggttcgccccagtaacgttgacgggagaatagccagtcacgtaagcgatagctgacttcttttttccctacgccattttcttctagccattcattcattttgtcgattgcttcttgtttgttcataccgtctagaaattcagagttgatgtgcgtaccatcttctgtgtaagcagctttttgaacatctccaccttcgataactggaagaatctctagtccgaaagtttgagcgaattcaaagtcacgttcatcatgtgctggaacagccatgatagctcctgtgccgtaagaagctaatacataatcagcgatccagattgggatttctttgccattgactggattgattgcgtaagcaccagtaaatactcctgttttttcttttgcaagatctgttctcttcagatctgattttttcgctgtctcttcgatataagcttctacagcagctttttgttcaggggtcgtaatttctctaacaagatctagttcaggtgcaagaaccgagtaagttgcaccgaataaagtatctggtcgtgtcgtaaacacggtataggatttatccgtaccagccactttaaattcaatatttgctcccactgaacgaccgatccaatttctttgcatttccttgatgctttctggccagtcaactagttctagatcatccaataagcgatcggcataagcagtgattttcaacatccattggcgcattggttttctgactacgtcatagccaccacgttcactttttccatcgatcacttcttcatttgaaataactgttcctaattcaggtacccagtttaccgctacttctgcttcataagccaggcctttttcataaagctttgtaaagatccattgtgtccatttgtaatactctggatcagttgtattcacttcgcgattccagtcataactaaatcctaaagaattgatttggcgtcggaatgtttcgatatttttttgggtaaattcagccggatcgtttcctgtatctaacgcatattgctctgcaggtaggccgaatgcatcccaccccattggatgcagtacgttgtatccttgacttcttttcacacgggaaaggatatccgttgccgtataaccttcaggatgccctacatggagcccttgtccggatggatagggaaacatatccagtgcataaaattttggtttttcaggatcatcatgggtgttgaaggtattcgtttttgcccagtatttttgccattttttctcaatttctttatgattgtaactcattttctgtcctcctgttctattaaaaacgcttgtttctattatagcgaaaaaaccggcagaatctgtttctttttgttttcttttactttgttttctcaaacttcacaaaagaaataaaaaaatcctataaaaagattgctctttttataggacgtaatctacgcggtaccacctatttttaccttaatgaaaaggcctcgaacgttgtaacggccgtcaccgccacctgcttactcgaatattcagcaagggcaactcaaaggcgagttcaaaagcatccgtgcacattctcaccaaccatgtgctctctgaaacttcagtctttttactacttccttttcaagtgttgtcatatttaagtagccttatagtaacaaatatttttgtggaattcaatcgttatttctgtgaacagctattttatttagctacaatcaatgtttgacctggataaataaagttgtttttgatattgttccattcgattagttgagccattgtaataccatggctgtcagcaacgccccaaacagattctccagatttcacagtataggttttcgaaccagcaggtgattgttggtttgttgtttgagacgagcctttcttcacgatcacttgttgtcctggatagatgaaattatttttgatattattccattcgatcaactgatccatcgtgatatgatgtttgttcgctacgctccaaactgactcgcctgctttcacggtatacatcgtattgccagaggatgatgtacttgttgtagctgacgtattcggtgtatttggtttcgctgccgaagtagttgaacctgtattggtatttgttgaattgccgcctttaacgatcaattgctgtcctgggtaaataaagttgtttttgatattattccattcgatcagctgattcatcgtgatgccgtttttatttgctacgctccaaacagattcacccgccttgactgtataagtgccttgagacgaactgctgccagtattagctgaactgctgttatttgtattggctgacgaacctgtattacttgatgcgctgtttgttgacccactgtttgaaacagtcagttgttgtcctggataaataaagttattttggatgttgttccattggatcagttgagccatcgtaattccatatttgttggagacactccaaacagagtctccggctttcactgtgtatttcgttcctgaagccgtattagaagaacttgagttagacgaatttgaaccacttgtgttgccagtatttgctccagtattagaagaaccgccatttgatacgatcagctgttgtcctggataaacaaaattattcttgatattgttccattcaatcaattgagtcatcgtaattccgtgatcatttgagatcttccaaacagaatcgccagattgaacagtatatttcgccccagttgtttgtcctccatttgatgtaccagcatttcctgaagaattggtattgttaccagaattattcgtcgaagagccattttcttggctacccttgatcgttagtttttgtcctggataaatgaaattgttttggatattgttccattgaatcaattggtccattgtaataccgaatttattggagattccccaaacagaatcgccagattgaacagtataagtggtcgaagttgctgaacctgagtttgtattaccagaattacttgaaccgctagtactacctgtacttccagtattattaccacctgtagtggctccaccgcccgcgtttccgctagctggtgtatcatattgggtcaatccgtaagtcgtgatgatattatttaatttgcttgcataaccagggtctgttgcataacgacctgtcaaacaagctgtcgcatctgtataggatctcgtgttgctcttccaagtaccggcatagtaataaccgttgccaaatgaagtatttctaagtacataggcattgtcattgaacgattcagcaaaagaaggatattgtcggaaaggctcctttttatttacccattgattatttaaaaattcaagcgtatccatgtagacggtttgtccttgatagctgccttttatcccaaaaagattataataaggtgcttgcgataacgcactactgccccaaccactttctacaactgcttgtgcgatcatcactgatgcatacaaatcgttggcttgagcaattggctgcgcataagtagcaatttctgtgataaatgccgctgtattgattcttgcgccgaactgaacaggtgtttcatccgcttgaacaggaaccggctgtactaatggagcagcgacagaacagcctaccatcgcagttcccacgattgctgcccctcgttttgcttttcgaaaacgtttagtctgttctaaacgtctccgttcttttcttgcaatgttttccatcttctatcctccaacttcaatttatctattattaataattataacttctcttaatatttattaaaagttatttaagagctttgttgttttttgtaatcatattgtaatttaccgtaatgaacaacttctgttcattttcaagttcttcctacatctatgttcttatttacaaggatttcgaaaaacactgattttattttcctaacatttcatttgtattaccaaaaaatgtctttccgattacagttattttttttataagaatattggttattcaaagagggatcatacactggttttatctctttaccgtttttttcactggaccaaaaatgctataataagtcattgcttcaaaggaggaattgtatgaaatataaaacatcatttcaggtgactggcagcttctttcttgtcctgttttttattttgggctggatcgtaaagttccatctgtcgtggctttctggtttcgatcagtggtttacagacattgtcagagcttcttatcctaatctgaacagctaccaactctttatgactaaattcggtaatcctcttaccgtcatcattttatttgcttgtacggctttatggatgtggtataagaaaaaaagggcaggaacagtttggttcgtttctggatttattgtagttgctggaatcatcaacccgttgatcaaactatttttcatgcgagagcgcccttcattgacacacttagtggttgaaacaagttacagtttccctagtggacatgcagcaggcagtatgattctttacggctctttcctatttctgctaccagcttttgttcaaaaaagaaccttacgtacattgcttcaattgctgatggtgtttattatagtaagtgttgggataagccgcatttatctgggtgttcattttcctactgatatcatcggcggctacttactcagtctttcttggctgtgcctgacttatccagtgtatagagaaaaaagaaaacaaatagataactcttacagaaagaaggacttttaatgacttttccttattcagaaggaaataaaagatatcattcttggaattatgctttacgaaatgagtttggcgggaaaattttcaaggtgccgattgatggagggttcgactgcccgaatcgagatgggactgttgcccatggcggttgtactttttgcagtgtatctggttcgggtgatatgattgttgcacctgaagatccacttccaatccaattccagaaagaaatcgacatgatgcatcaaaaatggcctcatgtccaacaatacatcgtttatttccaaaattttacaaacacccatgcgccagttgagataatcaaagaacgatttgagcaagtagtcaatttaccaggtgtcgtaggattatcagtcggtacacgaccggattgtctgccagatgaagtagttgattaccttgctgaactgaacgagcgaatgtatttatgggtagaacttggattgcaaacaacttttgaagaaacttcaaagctgatcaaccgtgcacatgattatcaaacttatttagatggcgtggctaaattacgcaaacatcatatccgtgtttgtacgcatttgatcaacggattaccaggcgaaagtttagaaatgatgaaagaaaatgtcagacgcactattttagattccgatatccaaggaatcaagctccatttgatgcatctgatgcgcaaaacgagaatgttgcgagactatcatgaaggtcgacttcaattaatgagtcgtcctgactatgtcaatgtcatttgcgaccagctggaaatgataccaaaagagatcatcatccatcgtttgacaggggatgcgccgtgggattccttgattggaccaatgtggagcttaaaaaaatgggaagtcttgaatgcaattgatgaagaacttcttcgcagagatagcttccaaggaaaatatgatgtacggaaaaaggtgagtgtctgatgttgcaaactgctttgcatttcagccatacattactgcaagaaatcttgcaaccaggagatcacgtcgtagatgcaacgatgggcaatggccacgatacggtttttctagcagaacacatcggaaaaactggtcatgtctatagtttcgatatccagcaacaagcaatcgatgctactcgtgaaaagctagaacagcatcagttagaagaacgtgtctcattgtttctacaaggccacgaaacgttaggagaagtgatagctgaacaacaagatctcaaagcagggatcttcaatctagggtatctcccaaaaagtgataaagcaatcatcactatgccagagactacacgcacagctatggaagaaatattgaaacgacttgtgcctcgcggacgattgatccttgttgtctactatggtcatgaaggcggagaaaaagaactggatatggttgattctttttgttccaaactgccacaggaaacatataatgtgctgaattatcggtttatcaaccaaaagaaccagccgcctattttatattgtattgagaaaaaaagataaataaaaaacgcaaaacataaatgatatgttttgcgtttttttctctaatactcaggttagagcgttgatttcacaacctctttattcacggtgctcaaaagcttgcatctgcggtaataaatccaaccaaatcaaaaacatgagaagctgtttttgattggctgttcttattacttgatgcaggacagctttttcacaacctctttattcaaatacaaattgattatgataaagttccgcataaaatccattttctgctaataattcgtgatgactgccttcttcaatgacttccccatcacgcaagacaacgattctatctgcattcaagatcgttttcagccggtgagcaatcacaaagctggttcttcctttgatggcttcatccattgctttttggattcttgcttctgttaccgtgtctacattacttgttgcttcatccaaaatcaataaagatggatttgtaatgatcgttcgagcaatactgatcaactgcttttgacctgtactgaacaaattgttttcttcggatatctctgtatcataccctttttctaacgtcatgataaagtcgtgaatgttcgcttgttttgctgcattgatgatttcttcatctgaagcatctggtttaccgaatgtgatattgtctttgatggtgccagagaacaagacggattcttgcaaaacgattcctacatgtctacgtaatgcatctagatcatactctcggatatctattccatcgattactactgacccatcattgacatcgtaaaaacgattcagcagattcatgatcgtcgttttcccagatccggttggtccaacaagagcaaccatttctcctttgtccacattgattgagacatccttcaagactagtttttctggagaataaccaaaatctacgtgttgcaaggcaagtccttgttccactccatcaaatgctttaccgttttctggtttgacttcatctttttcatcaaacatttcatttaatcgtcttgcccctgtgattgctaattggatcatgctgtacccagaagaaatctgcatcaatggttggtagtattgttgtgaatattggacgaatgtcacaactaagcctaacgccaccgaacgttccaaatcgccattcaatgctaaccagccgccgaaaaagataacgattgctgtattgactagtgacattccttgcatcatcggaaatagtaagccagaataagcttgtcctttgaacgttgcttcgcgaacactttgattatgttctaagaatccttcaatcgtttcttcttgtaagccatttgtgatgatgacacgttgtccgctgattttttcatccatatagccattcagttttcctacttcatcttgctgaagatccacatattttcgcgcttttcgaataatcaagacagctatcaaaatagctactggagtagaagcaatcgtcgcccaagctaattctacattttgacgaaacatcataatcaagattccgacaagtaaaacagcattcgtgatgacttgaagcaatgcttggttcaaactattttgaatattatctaagtcactggtaaaacgacttaaaatttcaccgtcttgatgagaatcaaagaagcgaatcgtcaatttttccaatttgttgaataaaccgatacgcatccggttcgttgacttccctactacttgagtgaataaaatactatagataaagttggctgcactagctaatacataaaacaacaagagtttccatattacagaaacaaatttgcttttatcgtctacgccttgcatcaagccacctacgtaatttgctaattcttgaaaagcttccccgatatactgaggtgcttttacttgtagataggtagcaataattactgtgataaagataaagaaaaaggagagtttgtaccgcttcaaatagtgatagaaaaatttacttgcttttattaaatcagtcatacttactcctccgttcctttttgagtttcaaagatttcctgatagacacggtttccagctaccaattcctcatgggttccttcaccgactaatctaccttcatccaatactaagatgcggtctgctttgacaacagaagcaattttttgtgcgatgacgatcgtcgttgttcccttcaaatctcgattaagtgcttctcggaccagtttttcagagcgagcatccaatgcactcgtactatcatctaaaatcaagatctttggatcaccgataacaccacgagtaatggatagtcgctgcttttgtccaccagaaaaattgctgcttcgttcttctactggtgcttcgtaacgatcagatagcttttcgatgaattcttttgcttgagcaatagaagaagcatgttccatctctttttctgttgcattcttttttccttggcgcaagttttgagcaatcgttcctgagaacaaaattgctttttgcaaaacaaaggacaccgtttgtcttaaactcttttcatttacttggcgaaggtctacaccacctacttctacttttccttctgttggatcaaatagacgaggaatcagctgtgctagtgtggatttcccggcaccagtcgccccgacaatcccgaccatttctccaggtttgatagaaaagctgatatctttaagcgtatctgtatcctcaccaggataacgaaaagaaacatggtcaaaagtgacagaacccgtcaactcttgttctggaacgtctaaataagtaagatctggttcagcatctaaaatttccgcaatccgcttcagcgatacggctgctcttgaagtcatcatcatcatcattccaccgataatgattgccatcatgatctgcatcaagtaattcatgaatgaagcaattccaccaattaatgtaggatcatctttaacaaggtcgctcacaaagaagattgctccaaccacagccaaattggcagccaacatgaaggacgggatcatcacagaaaataatgtaccgactatgatgttgtgttttgttaagtcttcacttactttgctgaatgtcttcaattggttttcttcctgtacaaaagatttcactacacgaatccctagtaagttttcttttgcaatgctatttacacgatcaatcagtttttgaatgatcatgaagtgcttacccatccgtgtaaatgaaagtgccgtgataagaaataccgtaacgataagcgctacgatgatccaccacaattgtggcatcgtgatcatagctaaaatgaaggcaccaataaataagaatggaattcgaaaaagtgattgcaaagaaatcatcactaaattttggatttgcgtgatatcatttgttagacgaacaacaagattcccagcagagaactgttcgatattcccaaatgaaaatgtctggatctttcgaaaagcttcttctcggatatctgcacttacgccctgagcaactttcgcagagaaaatcgtgttcgttacacctgcagctaatcctagcaaagccagactgatcagataaataccgattgttttcatttcatcattatcttctgtaataatagcttccaatacttgctgtagtaatttaggttgccataatgctgctgcaaccatgactgctacggacagcaaggaaataaaaacagctactttatattttttcgcatgtcgtaagattaatttcattcgttgattacacccctttgtttaaattgacaggactaatttaacactgtaaaattagaccgactaacaatttaccatgtttaaaaagataatgcaatacacgaggttgataaaatggaaataaagctttctcaagccatcatcattcaggccgcttttgatatcctggctgaaacacaagctctttcgcagctttccatgcgaaacatcgcaaacagaattcacgttcaagcgcctgctttatattggtatttcaaaaataaacaacagctcttgcagaaaatggctgaaacaatggaagaagaattagcgcttccagatccaactttgccctggaatgaacagttgctacagtatatggaaaattactatgacctttacacacgttttccttgtggggcagaattagaaatcaatactgtgcccgcttttccgagtcgattagaacatttggaacaaatgatccaactacttgttcgtgaaggattttcagtcactcaaagtcatcaggccattgcctctctccacaatttattgattggacagctaatggatcagcagcatgaacaacagcttcggcaaaagattatggacggaaatgaatttttgaaagaaacagttctatttatgcgtaattatgtagtcgaaaatcaattagagggttttaaagaaagtatgcagtcccatgcagaattgaatgaaaaagcactctttctaacgagtgcacaaacctatattgaaggtttatgccaacaaaataaaagaagagaaaacaatcgataaaaaaagctcctataaaggtcaccaacaaagtgatctctataggagctatctttttaagtctcttttttacttttcttccatcagccacaccaatgcacgttggatccattgatcccagaagacccaattatgatcgccaggtccttgttcaaaggtgaccgctaagccttgttcctgcatagcagataccatttcctgatttgcttgataaagaaaatcagattccccacaagccatataaaaccttgggactgtttttccgctttttactaattctttcaataaatattgtggatcattctttgaaccttcgatttgatccaatggtccaaagattccttcccaaaaggctgctttacgaaccatcaaaagatcatccattcggtttcctacagaaacagcgcctgaaagagagattactgctgcgaaattttctgattttgcaaggcctagttttaatgcgccatatccgcccatcgataatccagcggcatatgttttttccctttttcttgttaattgtgggaatagttcatgacaaatctcaggtagctcttctgcaatgaacgtccaatatttcatatcataagccgtatctgtgtaccatccaagatcagtagatggcattatgacagctaatccgtagtctgctacgtaacgttcaatcgacgtacgtctttcccatacactatgattgccacccatcccatgaagtaaatataaaacaggtatgtccgttgtcgcttgctctgaactggtgccaatcacctttttagttgtttgtgggagtatcacatttagattgacttccatttctaatacattcgaataaatatttgcttgaataaatgccatattttcgccttccttagtaagaagttatttttgaataactttaaatttgaatgattcggcagagtacatgtctcgaccgaaactactgttttattttaccacgtttttcatgaacgaaaagcgttaagaccaaagcaatgatcacgagtaacaagccaactagataaacggaatgtaacccatcataaagaatttttcttaatggcaacagaatatccgcatcgatatatttagccgtttgtggattcaccagtttgttcatgatatctgcatcatttgttaaatttgctgctgcaagttctcgtttagttaccccatttatcaataaaccaaaaatagaaaccataactgtttgaccaattgttcgaactaacgtattaaaagaagttgctacaccaagctgatcacgagatacactattttgtgcactgacagtcgaggtagtcatggtcacacctaagcctataccgatgaccgttgatatagcaaaaaaccataaatagttacttctgaaaggcataagatacaaccaagcgcccccaatagctgcgattagtaatccaattctcaagacccaatgagtttccatttgagtcatccacttgcttgcaaggaaagaaccgaccatccagactagtgataatggtgctaataccaacccaccaattgctgcattcagtcctaatacaccttgcatccacataggaatataaacatcgattcccatcaaaaaaccactagccaatgctgcagccaagtttaccacaacaaatagtggatttttgaataaatgcatcatgataacaggatctttagctcttttttcggcaaaaataaaaatacctaacagtacgatacttcctagcaacaaagcagaaacaagcggactcattccttcgtctcctaataattggaaccctaacagcaatgtgacaagcatggccatcaaactaaaactaccaaaaatatccattggtttagactcatgtatgatttttggttcatttaaatatagccaaataaaaataattaatagaattccgatcggcacattgataaaaaagatccagtgccagctgatcgtttcaacgatgaatcctcccgcaagcggtccaaaaacactggcaatcccccaagctgaactattcaaacctaaaacttttgctcgcttttcaatagaataaagatcgccgatgatcgtcaaagctactggcatcattgctccagcacccatcccttgaatcgcacgagcagcaatcaacccaatcatgctttgagataaaccgcaaaataacgaaccgataataaacaataatgtcccaaaaataaaaattggttttcgtcccactttatccgcaagttttccgtaaatcggagtaagcatagcgtttgtcagcaaataaatcgaaaatacccagttcatgatttccattccatgtaatgagccgacaatcgttggcatagcggttgttacgattgtcccttcaatagccgtcatgaacgttgcaatgaaaacactcactgtgactaaagtaacgtttgtttcttttttcatcttatgcctcctttttcatcatgacaggatctaaaaatagataaatactcactatctttttcaagaggtgcactgccataaaaaaagctggaacaaccaccattcggcgatcgttccagctgaatatagcttattttgctaaacttgctttcaatgcatctactttgtccgtatgttcccaaggcaaatccacatctgtacggccaaaatgaccgtaagcagctgtttgtttgtaaatcggacgacgcaaatcaagcatctcgatgattcctgctggccgaagatcgaagttttctctcactgcagcaatcaattcttcttccggaaccgttccagtaccgaaagtattgattgagatcgagacaggttgagcaacaccaatcgcataagctagctgtacttctgctttgcgagcaagccctgctgcaacgatgtttttagcaatataacgtgcagcatagctggcagaacggtcaacttttgtcgcatctttaccagaaaaagcaccgccaccatgacgagcataaccgccatacgtatcaacaatgatttttcttcctgttaatcctgcatccccttgaggaccaccaatgacaaatcggccagtcggattgatataatattttgtttgatcatctaataattcagctggaataacttccttcactactttttcgatgacatcatgacgaattgtttcattatctactgcatcatcatgctgtgttgaaataacgattgtatctacacgttcaggttgtccttgatcatcatattcaactgtgacttgagattttgcatctggacgtaaatacgttaattcatttgatttacgcaaatctgccaagcggcgtaccagacgatgactcaaagcgattggtaaaggcattaattccggtgtttcatctacagcaaaaccaaacattaacccttggtcgccagcaccaatttcatctaatacgtcttttttatcttcatcccggatctcaagtgcttcgtcaactccttgagcaatatcaggagattgttcatcaatcgcaaccaatacagctgctgtatctccatcaaatccgaattttgcacgtgtataaccaatttcttttattgtttcccgtacgactttttgaatatctacatatgccgtcgtagatatttctccaaatactaaaacaagcccagttgttacagatgtttcacacgctactcgtgctgttgggtcttgttctaaaattgcatccaagatcgcatcactgatttggtcagcgattttatctggatgtccttcagaaacagattctgatgtaaataagtgtctttctaccattataatgattccccctagttaaattcggttacaaggcatctccgtcctgcggatcctttcgggaacttgcaacgaaccaagtatagcagataaaacagttttctgctcgtattttttcatttttttgcttaaaaaatataaatattttacattagatttatccaaaaaagcttagcacaatcatctataaagataactctgctaagccttttaaaatcattctttcagataaaaagaaaaagatactcatcaagtatcttccatgacccgtacgggattcgaacccgtgttaccgccgtgaaagggcggtgtcttaaccgcttgaccaacgggccaataaaataatttgaacgtttaaacacattcaaaataggaagaggccatgcgaaagaatacatcgcatggcctctttttgagttgttttgtcacattagagcgagttttttgctcatctattacttctatgactttcttaccgaaatctattttatatcagattttataaaaaaataccgatgggatctctccctcgacatcttttctcagtatatataaaaattatgcggctaagaagattcgaacttccacgaggtcgccctcactagcgcctgaagctagcgcgtctgccaattccgccatagccgcatcatatgttctagtttaggattacatttgttttttgtcaagaacatattttttgttcttttttatctctacgcgttttccctcttgcaaccaatacaaatagttcatccgaataactccatcatctattgaagggcgataaaaaaattctgttttttccataagctcaatttcacttttcagaaaattggtcacatgatgcgggacgctgtcgatgcaaacatagacatagtcaacagcacggattctttcaaatagtgctttctccccgtactcatatgcatcgattctttcgacagtttctacatatttctgcaatccttttacgaatccttttatttgtttgttcccgatcacagcaattttgagtgatgatgcccacttttcagcgtctatgctcaattgctttttacttgactgtttagatttttgtcttgttctctttagatatttgtcgcttcttctttttgacttattctgttcaacgataggatagcaataccttagatatactggaccgtctactattttttgatgtactcgtactgctatgccatctgttaaaagatctttgcgtttaaagctctcttctactatcagtggtcttctttgctccgtattgacctcatagaaataaatgttgtcctcttctatttctacaaaaccataaaaaatatttgtttcttgatactgcaaattattcgcttgttgttcaaagatccattgatacctattgaacagcttgttcagctgattgaacttataaaatgattgggtatctaactgttggatcaatgcatggatcagatcttgaggagctgcttgtacgaagttttgttttttctttgctaattgttctgtttgtcgctggttgactttatacaactgttgcagttcttgttttttcttctccatgattttcagatacgtagcatttctatttgaaagcttttctaatttcttgttcagtcgatcatttcttttctttaataaacctgacgctttatgtatgctctctagataatgttgcatttggctatttttttgcagcaaataaatgatgatctggttacgtttttggagttcctgaagtgcgtgattatctgtatcccagcccacttcttctaatttttgatacaatagttctgttttcctctgctgttcgatggctttttgtctcatctcttctttttctacttttgcttgttggtgctgtcgttcgagttgctgtgacagctctctgatgtgtttcttgtcctctcttcttttcttgctcacagtagctacttgtttttttgctttactcaattcttgcttcaattgattcatttcattgtttaaacgaacgattctgggatcggtagctattttattttgctgctttttcttcgtttctttgttcttctttttctctcgattcagctgtttttgctgcattttctccaacaactgtcttcttctttcgttttgatactgatcattttttgcttctgtttgccgccatccttctggaattcttttataaccgctaaagtagttcacgagatctcctttctagtgatcataagcaacggacgaaaaaactttaaaaataacacatttattaaaaattcaatttatcttgaactttcaatatcaatcaataagatcatttttaaaagataacgaggattcatctattataaaaacaatacaataaataacaaaaatctgcaatcatttattttgttaaattattcttaatacgatacatcacaaaaaaataagaatggctattcgccaaaatagtgctatagtagaaaaaatatgtttacttaggaagaggcggattcgatgaaattgatcaaactatgggaagcagatttggagaaagcttatcggctgcaaactagcttcggaccaaacgagaatggatttatcaacagtgcttatggctatacacttgctgaatttttagattatgtaaaaaaatgcgaaaacacttctttaggtattgatcttcctgagaattacgttcccgcaaccgtctttattttggaaaatgatggacatgagtatgtaggaatttttaatctgcgccataaactgaacgaatcattaagaaacggcgctggccatatcggttacggcatctcccctgactatcgtaaaaaaggatatgcaacacaaggtttagcattagtactacaagaggcaaaaaaaatcggcatcgatgaggcacttttgtctgtaaataaaaaaaatcttggcagtcttaaggcgcagcaaaaaaatggggccacgatttatcgtgaagatgagaaagaatactatacgaaaatcaaattgatgtaaaaaatatggatggcaaaagaaaagagatttgaatgtcctttatcaatagaacacatttatttgattaacttctaatatagcagacaaaattttataaacaaaaaaacctcttatctcttttcttctagaaaggataaaaggttttttgtttttactatttgcttctcatagctagtcagtcaagatccctatcgaatccccaacgcaatccgtgcataacggctcatcttatcggtcgtccatgcgggataccagacaagttttacttctgctttcgttacttctggtacttctttcaatgcgtcatggatagattctgttaaaatatcggctagtggacagcccatagttgttagcgtcattttgatgactgtttctccgttttcaggattgaattctatatcataaatcaagcctaagttgacaatatcgattcctaattcaggatcgatcaccatttccaaggcagcaagaatacgttctttgatcagttctatttcttgcgcagaccgttcttggtttgcttcgctcatcgtacgacactccttaacacgatttttatttatcatactctttttttaactacttgtaaatgagaatttagaaggaagattctcgtttaaatttataaaatgtccttattagacggaatacattaaattcattctaaataaaactgattcctcattttttttgtgaacgattttttatttctggcaacacacctgttgttcgatacattttttgttcgttttcatttgcaaatcggccaaatactgaatgagttggtaaaatattgataaatgcatcgtcgtcgatttcatgaacgatctgatcaagatcatacatttcatagcgggtgatgaccatcatgatcatatttccttgtttttttgaatagccaccgacagacggaagcaatgtcattccacgtaccatccgtttcgctagttcttctgttacctcttccggtttgacggtcacgatcatcgctgttactttttgatgactcgtatggatggcatcaatcacttgagtcattgcataaatggaaataatcgtatacaaggcactttcccagttaaagaagaagcctgcgatgactacaatgatcccatttagaatcagcatgtaatttccgactgtttttccagttgtttgtgaaagcacaagagagatgatgtccattcccccagttgtaaagcccatttttaaagataaccctacgccaagacctaataaaacaccgcctactaaggcattcatcaaaatattatcagtgatctgtccgactggaagtagcatcgtcatcactgatacgcatacaacgttcacaaaactaaggatcgttgctcgttttcctactttgaggaaccctaatacaaacacagggatattcaaaataaaaataaatgttcctgtgtctaccttgatatgaaaccattcatataaaagcgaggaaatgatttgagcgatcccattcatccctgcagaaaagacattggctggaatcaaaaaataatttaaagcgaccgcagcggtcaatccggttatcaaaataaccactattttttttaatctttcatttttatgatacgcagtcataattttgctcacaagcacctctcctctactttgttattccaaatgtaagaataacagtttatctattaaaataaaatacttcgaactcaaatgagaagaattttagcaaacaagtaagaatctgccccattcctatgataagatagatgtatagtaaacttatacgtatatcaggagggttcttatggcaaaagatgctagcttcgacattgtatcagaagttaatacagaagaagtaaaaaatgcgattcagcaaacaacaaaagaattgactaatcgatttgacttcaaggattctacggtagaaatcaaattagagaacagcaatctagttgtcttgagcgatgatgatttcaaaatcgaacagatcaaagatgtattatttggtaagttgatcaaaagaaatgtgccaatcaaaaatatccatttttccgaatcggaacacgcgctaggtggcaaagctcgtcaaattgccgatcttgtcaacggaatcgatcgtgaaaacgcgaaaaaaatcactacagctatcaaaaatgaaaaactgaaagtaaaagcacaaatccaagaagatcagattagagtgacaggtaaaaaccgtgatgatcttcaagctgtgattgctttattacgtaaacttgacttaccaatcgagttgcaattcactaactatcgttaatgaaaaaaacgaggctgacatctgtcatccctcgtttttttgatttactgcttctttggatgaccaaaaacgctgtattccttcttccaattctccaacacttcgtacttctcttgctgtttgccaatgttgtgggaataaatgtcgataagaaaaacgagcaaatcgttgatctgccaataccacgattccttgatccgccatgccacgaatcactcgaccaccagcttgcaagactttgttcattccaggaagctgataagcgtaagcaaatccaaggtgttccttctcatcataatatgatttgatcagttcctgctcatgattcatctgcggcaaacctacacctacaatcatactgccgatcaatcggttccctctcaaatcgattccttctgaaaaaatcccaccaagtacacaaaatcctatcaatgtttcatcgggatctgattggaattttgctaaaaatcgttcgcgttcttcttcattcatgtccgtttcttgaatcagcacatcgctgtcaggatattgctgtttgaatgcttccgccgcaaggtctaaatattgataagaaggaaagaaaacgaaataatttccgacctttccatcagcaaaagcatggattgtctcaactaattgtgccagactttgttccctttttcgataagtcgtctctaagtaatttgcgatgaaaacttgctggtttccttctggaaaaggactcggcagtttgtaagcgagacttttttgtccgcccagtgtttcctgataataagataggggtgaaaaactcgcagaaaaaaggatactgcttcttcctttatccaacgactgctcaagaaacaagcttggatcaatacaaaactcttttactatcagatcgcgatacgttttttcgaccgttgtttcatagtgatcatcataaaattcactgaccttcaaaaaatgaagcaaatcaaaataataaggaagcaattgttcttgtgatggatgctcaggaaattctgctagccattctttgattttttcgcttaattgataacctgcctttactaaagattcagccggtgctttttgatgatgataatcccaatgatcttcttttgctatttctcggatcgaatcaaattctttcaatagtttgttgaaacgacgatggagttttttgaattcctttggtatagcttccttacttcgtttcgttttttcataagatagttctgccgaatacatctctcgggaacgattcaccaaattatgtgcctcatcaatcaaaaacagataatcctcgtttttttcatcttcaaaaaaacgtcttaaataaacagcgggatcaaacaaataattgtaatccccaatgatcacgtcgcaccagatactgacatctaatgatagttcgaaaggacaaagtgtatgcttccttgcataagtttcgatgacttctcgagtgatctgattctcatgattcaaaagatcccataatccttcgttgatacgattgtaataaccattggcatacgggcactgatctggattacaggtcgtctcatctaaaaagcagatcttatctttagccgtcaaagtgacactttttacttcagctccagtatcttttaatgctgtcatggcatcttcagctacttgtctagttattgttttggccgttagataaaaaatcttttctccctcttcttcccctacagctttcaaagcggggaataacgtagagattgtttttccagttccggtaggtgcttctacaaacaatttctgtttcgtacggattgttttataagcagctactgctagttcacgctggcctttcctatactcatcatgggggaatttcaaagccatcaaagaggcattgcgtatagtacgccagttttcttgaaaaacaagccattctttataatcttcagtcagttttttaaaaaaaatttctaactgctctcttgtctgatgttcgacctttctcgtaatcacttcttctgccgtctgaaagtaagtcaactgcagatttatttcttgtaaatcatgctcttgactatagatataggcgtatacccttgcttgatgaaagaaaagttccacttgttctggttctaaatcttcaaatcgtggttcggaggttttgatttcatctatataataaataccgtctcttttgaaaataccgtctgcacggccttcaacgatcaggtgatattcatctaatggaactgttgtttttaaaaaaacttctttttcatagtcttctcccgcatctttttggagcttgcggtggattcttgctccttctaatgcagtatggctactttttttacgattgtcgatacttccacgtcgcaaaataaattctactaagtgccgcacagatatttttgactgtttgatcatttccaccacctctttctctctaagattacctgaaaaagcctagtttagcaaaaagagctctcttttcaagcataaaaaaaaacaccctgctgattaggcagggatataggatatagaatttggatttttggatgggtctaatgtaacaaggacatattaaaatgctatgaaaacttactttccttctctttagaatatccaaatacttttcatatagtctgataattcagataagtaaagagaaataagtacctgtttttgtttcctagcaatgaatgcgttatactaatggatgaaagaagttttggctatcaaggaggaatgcacatgcatatcgaaagattaaaaacaggaatgattgaagaaaactgttatttggtctacaacgaagaagcacttttgatcattgaccctggagaagatgcggaacaaatcaaacaagaaatcaaaaaaacaaaccaacaaccggtagcgattttacttacccatacccactatgatcatattggtgcagtagaacccttacgcgcatattatcaaatcccggtgtatgtcagcccactagaacaaaaatggctaggtgatccgattttgaacctttctggactcggacgacatgatgatattgctgatattattgtctcgcctgcagaatatgaatttgaaatgaaaacttatactttaggaaacatgtcttttcgtgtggtccctactccagggcactccatcggaagcgttagctttatttttgatgattttgtcgtttctggcgacgccctatttagaggaagtatcggtagaaccgatctgtatacaggaaatttagaacaattacttcacagtattcggacccagctgtttgttttacctgatgaatttgcagtctatccaggacatggtgatgcaacaacgattgaacaggaaaaaaggacaaatccttttttcaatcgttaaaaatgatttaggaggagaataaaatgacagaaactacactttatatcgtacggcatggaaaaacgatgttcaatacaatcgaacgcgtacaaggctggtgtgatacgccactcacaaaacaaggacaagaaggcatccattatttagggcgcgggttaaaagatgtcgacttttcttttgcttattctagtgacagtggtcgggcgatcgaaactgcccgtattattctaggagaacattctaagggaaaagaaattccttattttatcgagaaacggatcagagaatggtgcttcgggtctcttgaaggcggctatgacatggaaatgtggggtgtgatccctcgcgtattgaattttaaaacatatgatgaaatgttcaccacagaagtttcttttgaacaaattgccaatgctgtatacaatttggatacggctggatgggcagaaacttatgaaacattacgagatcgtgtgtggacaggatttgaagatatcgcccatcactgcgaaaaaaacggcggcggaaatgttttagtcgtatcacatggtttgacgattgccttcttgcttaatctgatcgatcctaaacagcctgttcgtgctggtcttttaaatggcagtgtaacaaaggttacttatgcaaacggtcgattttctatccttggtatcaacgatacgtcttatatcgaaaacgggaaagcacatagtcgaaactcgtttttatgatgggatattttaatttttaacagagaatcataaaaggcaaagtctgaacgagggctttgtcttctttttttctcttcgtattcttatctgcttcatttctcaagtttttcttaatattaaaaaacagattgggtttatcaaaaaataacggtatactataagatgtatcttaattgggaaggaaggaatttatgttttttgcaaatattatcaaagcagtgattctcggtattattgaaggaataacggaatggctgcccatcagtagtactggtcatctgatcctagcagatgaattcatcaaactggatgccagttcacagtttatgtcgatgttcaatgtcgttatccaattaggggcgatcttagctgtcgtcgttctttattttcacaaattaaaccccttttctccaagtaaatcaacgatagaaaaaaaagatacttggacactttggtttaaagtgatcgttgcttgtataccagccatcatcattggtttgcctttggatgattggttagaagcaaatttccacaagttcttacccgttgccattgttttgatcgtttacggtattgcctttattattgtcgaaaaacgtaacaaaaacaaaacacctcgttggacttcgctgaatgactttacgtaccaagcagctcttcttgttgggttattccaagtcttggcacttgttcccggaacatcccgttctggtgcaacgatcctaggagctatcttgattggcgcttcgcgttttgtcgctacagaattctcatttttcttagggattcctgtcatgtttggcgcaagcggcttgaagatcgtcaaatatttagctgaagggaactcattcaaaatggaagaaactgttgttcttcttgtaggaacattcgtatcttttgtggtttctgtcttagctattaaattcttattaagttatttgaagaaaaacgactttaccgcttttggctggtatcgtattatccttggtatcattttaattggttattggtttatcgcaatgtaagaaaaaccagaacacttctcttgtatgagaaatgttctggttttttattttctttaatgaaaattattataaacaataaaaactatataaagcttcatagccatctgataaccattatcgttctcatttagctgtttttattatcaattacattgttattatgctatccttgttttgacaaggaggactgataacgatgactaatcagaaaaaagcttttgcagcaacaattggctgtcttttatttatgattgccggttttattttcgaccgattctctcttaccatcaccccacttttttatatcagcgctattatcatcggtggatacaaacaaacatcggaaggcttgaaagaattgtggaatgaccgaacactgaatgtggacttattgatggctttagctgctatcggtgcctgtttgattggtaattactttgagggagcaatgttgacattcatcttttgtttaagcggtgcattagaggaatacacgaccaataaaagtcaaaaagaaattaccgctttgatgaatcttcaaccacaaaaagctcagttactaaaagaaaacggacaaatgcaagaagtagatgtttcgcaattaaaggtggatgacttggtgttcgtcgctaaaggagcggctgttccgatcgatggtggtttagaaagcacacaggcaacgatcgatgagtctgcattaagcggtgaatctgtacctgtagaaaaatatttaggagatgagatgtttgcaggaacgctgaatcaaggaaatcccattacgattcgagtaacaaaaacgagtgccgaaaccgtctttgctaagattatccaattagtggaagaagcacagaatacgccaactcaaacagcttcatttatcgaacggatcgaaaacaattatgtaaaattgattttgcttgctgtgcctctaatgatccttctcccccactttttcttaggttggagttgggatgaaagcttttatcgaggaatggtattactagtcgtggcttctccttgtgcgcttgtcgcatctgctactcctgcttctctagctgctctttcaaattctgcaaaaaatgggattctaatcaaaggcgggattcatttagagaagctttctgaattaaaagcgattgcctttgataaaacaggaacactcactaaaggaaaaccagttgtgactgacagctttttctttgatgagaaggatttggcacaacaacttcttgttgctatggaacaaaaaacgacacaccctcttgctcatgcgattttacaatatttcgattgcacaatacccgaagcaatccaatccctatcaatagaagaaattactggttttggattacaaactacctatttaggtgcgcaatggaaagttggcaaacacgcttatgatcctgagacgatgagaatcagcaaagagattgaggaaatgatcgaacgtttagaaaatcaaggaaaaactgtaatctatctgtctaaagatcaacagttaatcgctgttttaggtctgttggatattccaaaagcaaatgcccaacaggtgatttcttactttaaatcccaaaacatccatacaagtatgataactggcgaccattctggcacagcaaaggctattgctgaacaagtagggatcgaacattactatgcaagctgtactccggaagaaaaaacacaactagtcaaaaaagaaaatgaactttaccaagtaaatgcgatggttggtgatggagtcaatgatgcgcctgctttagcagctgcttcattaggtatcgctatgggacaaggaacagacgccgctatggatatcgcagacatcgtcttaatgaaaaatgacttagataaatttgtctacagtcatcggctgtctttaaaaatgcggcggatcatcaaacaaaatattattttttcgattcttgttattctcttgttgattgcttctaacttcctgcaatttttaaatctacctcttggagttgtaggacacgaaggaagcacaatattggttattctgaatggcttgcgtttactaagacctttacctgctctttctgattcttcaaaaaaatgtaagtcttgtccactatacaaagcgcggctgtcttctgtcaaataaacgaagtgttttttataattttatttattttatgaaaaaaacagcttatgaataggtcttgaaggatgaattcctacttttgcaactttccaaaaagatgttatgattgtttcgaagaaagtgaggaatatattttatggaaagttggctttttttaggaattattttacttgtagcaattttagctaagaatcaaagtctgatgttagcggcagcttttgtgttgattatgaagctcataccaacctcccgttcctttttcccttggcttcaaggcaaaggaatcaatattggtgtgacgatcatcactgcagctattctgatccctatcgcaacaggagaaatcggtctacgtgatttattagaagcctttaaatcccctatcggctgggtagctgttttttgcggtgggctagtggctgtcttatcttccaagggcgtaggattgattgcttctgatccgcaaatcactgttgcgcttgtttttggcacgattttaggtgttgtcttcttaagaggaatcgccgccggaccagtcattgcttctggcattacttattgtatcttacaagtatttgctttaggaaaatagatcaaattttgcctatttttaggagattcttaatacccccaatttactgatccgtgatatactgacaacgaggtgatacaatgttcgaaaaattgaagtatttcataggaacaattggctggtttcttttagcggtacttttgattctgggcttagcttatcttttatttcctgatttgatacaaaatgtgttagatactgctttttgattgacctattagaatgatatagggatgctcctgcgatgcaggagctttttttaaacaaggaccgagcgaatgagatttcctattgaaatcgatgcacttttttctttttggctcttctcctcttttttgttatactagattacagtggacaaaagaaggaatgattgcatccgctttaacgaatatcaaaatggaagaaacagtacctgttttcaggttactttggaaagaaaggaagacgcttgtggaaacttttgaaggtcttttaattgatacgtatgttttacaagaacagccaatgatgctgactggaatcaacttgcagcttgaggaccgtgtgatcaatggactgcttaaagatcgctatttggcaaagtacatcttacgtttgccactaaataaatatgtactggaagtaagtggcaaatggaaccgtcgaaatcagttagtcattaaaaaaatgttgataaaaaatattgatgaatatattaaaataatcggtacaccagaataacctttaccgatcaaaggtgactggttataaaataactgcagtttcttaatagaaaaacaaagaacaatagggaatcgtatcccttttcaaaaaaaactttgcaaacggttctctttgttatataatgacttagtaccaaacattcccattcaatctttgtttaaatagataaataaaaatctagtttggtttgacgctattgcctcccacaatagcgtctttttgattttttcagcttgatttatctgttcttactgataaaaaagtttaaataaaagactgttaaggaaaaaaacttgtcatgttcatattgcaaagcgcgctgcctttaggtataataatgaatgttgaattatgcggtcacacgcgtaagaacttaagttatcggaggtgaaactaatgccaaacattgaatctgcaatcaaacgtgttcgtacaagcgaaaacgctaatgtgaaaaattcatctcaaacaagcgctatgcgtactgcaatcaaaaaatttgaagatgctgtagcttcaggtgctgacaacgtagatgcgttatataaagaagctgttaaagctattgatatggctgaatcaaaaggtctaatccacaaaaacaaagctaaccgcgacaaatctcgtttaagcaaaaaaatcgctaagtaaaagaatcggcttcggccggtttttttatttgtcaaaaaaaccaaaagcaaccggtattcttgcatgcttttggcttcttctttcttcctatcgatttctcaacaactgccctgtgcgcaaaacgaaaagttgaaaacttaattctttttcgatttgccccgttttgatttgataatccatttcgactaattgatcaaataattgtactagcaactgttcatcgaatttccttacttctttcatggcaagttttacacggtaaggatggatttttaatgtttctgcaatattggcctgctgatagccaatctttacaagaaattttgtctgtaaaaacaaacgtaattgagaaagtaaaatcgcattgattttgattgtttcctccccttgcatgactaaatcttcatataaacgcaaggcttgttctgtcttcccttttaaaatatattgggtcatgtcaaaaatattatgttccaatgttttaggaactaattgttctacttctcgaacagtgatctgctgttgattttgtccataaagaattaatttctgtaactctctcatcattttggataaatctaagtcagtcaaccgcaagaataaatcaatggcgttgcgttccattttgatggaggagttctctaaggtattcatcagatattgacgtacttctttttcattcaactgttggacgttgatgatggttgctgtttttttcaattgtttcgttacttttttccgttcatccaacttttcatatggtgcaaaaaatactaatacagtcgattctagtggttctttcaaataagctgtcagtaaatcagtattttgttcgatcccattgtttactttctcacctgttaaaaaatatgggttctccacaaatactaatcgttgatctccgaaaaacggcaatgtctctgcttcagccactacctcctctaaacttgcattttccatgtcaaaacttaaaaaatttaaatcatcttcgccctctaatttgatttttttaactatttctgcccgaacttgatcttggagaaacttttctgttcctaagatcaagtaacaagatgcaagtttttctttacgtattttttgtaactctgcttgtatactcaaattactcaccactttcaaaattatcctaccatgagaagatgagaattactagtctatcattgtttccactagaccatgaggatgaaaaactggatgccagcgataggtgatcattccttgctgatcggttcgccatgttcttatctgattttcttctagtgcctccaatacttcgctgtgagggtgaccataacgattatttactccgcaggatataattccatgtttcgcttcaatacgggaaagaaaatccgtattacttgatgtgcggctaccgtggtgacctaatttgactacgtgggctttcaaattaggataaatagaaagcaactgttcttccatcgcttgattcaaatcacctaaaaacaaaaaacggctattgttatattccgtccataaaccaattgaatcttcatttcttccttctcccttttcaaaaggggtcaatacataaagatcataatagcctttgatcctgtcgccatgtttgacttcaatgattttagtgccatttttttgagcttctgttaaatgccttcgcaacggttcatttcgtccagcgccccagccaatataaatttttttgatggtgaaatgctgagataatgtggacaattctcccacatgatccgtatcgtcgtgtgtcaagatgagtttatcgatcacacttattccctgtccttttaggtatggaacgatattcctttcagcaggaggtcgtgcaataccttgcgcccacttttccctttcaaagtgtaacttcccccccgtatcaatcaaaatcgtttcttttcgaaaaggactttgcaaaaagatactatctccttgaccaacatcgataaaagcgatcgttgaagaaaaacgtaaaaatggcaaagtcaatagcatcaaagaaaacagaccaacataaaacaagagtttcatcggctgctcgttcaatctatccatacaaatcagtaatccgaaaatatatacccctgatagcacaagaggtagacgccctataacaagagtcgatcctgaaaacgaatcgatcattcgttcaaacaagatcagtccctcttctatcagcaaaagtaaggttctcggcaaccagcgattgaaaagcgtcagaaagaacacactaggaagaaaaagaaacttgaatactggtgcaaccagtaatgtaaaaagactgcctaaaagaggccactcataaaaatgccatacaatcaacggcatcgtgatcatggtaaataggacatgagaagccgtttttttcatccaatctccatcaaaagaaatcaggataaacaaaaaactcatgaaaaaactaagctgcccgcccgcatgaaaaagaaatcgaggatcaaatagcaaaagaagccaaaagacaactgcaaataagtccatagaggagtaacgtttattcaataatttgactagcaaccgcaataaaaacaacagactagcacgcaagacagaaatagaactgcctgcaagagaaacataacagatagttagcaggctcaacggaatgatgctgacgtgcagtggccatccgatacgtcgaaacaaataatacagccaccctaaataaaattggatgtgtaatcccgataggctgaatagatgcagcaaaccactctccctaaaaatttcttctgattctctgaaacctgaatctttatagccccataataaagaattgatatatacacttgttttttgcggaaattcagattggacaaaagaaataaaagcgcctctttttctctggagccaatttcgccaatgattttgtatggtgattttttcgaccctttgaatttggaatcgaccagagattctatggttcctgaagtaagcttcttggtcaaaagtataaggatttcgctttttttcgggagaaataaactcgccttcagctgtcaattctatccccttccctcggaatccaagccaagttttcaattcctcttcggtgtttacttgataagaaagctgtaccttctgtttactctctgacaatcttccttccattgtcaaaaaactgccattcgcacgaatcgtatctgtagataaagtcacttgcgcagctgtttctttttcctctaaaaatgaatattcttgtagcttataagaaacggataccattatgctacccacaatacagaagtacgcgataaaacgtccttcttttagcgaaaaccacaaaaaaattccggcaagaaacaaacgataaatccaattgtccgtatcatacaacaaacaaataatcatcgacgtaattgccggaaaaatcaaccgatttcgaacatgcctttctaaaacgctagacatgttttcctgttaattcattttgaagttttgaaaaatgctgcgagtctaaagcaacttggtgtacagatatgcctaattgttcaatcaacgcttgagcatacggatcatttcgatagtcatggagataattgattcctttaacaccagcttgcagcaaagcttttgtacaagctaaacatggaaaatgcgtgacatagatttccgaaccttccgtcgggataccgagtttcgcgcactgtagcagcgcgttcatctctgcatggatcgttcgcaaacagtgtccatctacaatatagcagccttcatctatgcagtggacatctccactgactgctccattatagccgccagcaatgatccgtttttccctaacaagtgtcgctcctacttctaaacgtgtacacgtgctgcgtaaagataacaataccgcctgagccataaaatactggtcccagggaatgcgtttgttttgagtcttatcagtaattttttctttgttcgtatcgcatggttttgaagatttttctaacatggttacattcctccgtattttcaagttggtcaaaaaagcactccattgcttaaacaaaatattctttaaatataccgaatcatcatgtctgacaaaagagcatatgcttcactgccgaaatgaagtccgtcatccattagcctccatttattgctcttttcagttggttctgaatcattctatttaattgtaacgaagttttttagtttttcaactgtcttttcaccgataccagatatctcctgcaagtcttccactttctggaatgatccgttttcttctctaaatcgaatgatttcttgcgccttgactgaaccgatcccaggaatctgctggagttctgagggactggctgtattgatatttatttttgaaggctcggtatctgctgtagactgttttccttcgggggatgctgactgattaagatgttccggcggctcttcacctacagcagggatatataggacttgctgatcttctatcttcgcagaaaagttgtttcgatcgctatccgcttcttctaataatcctcctgcgcgctttagtacatcatagacccgttcttctgaagaaaatgaatagataccaggctccttcacacttcctttgatatcggtatacataacctttggacgagcatcctcttctacagtatttccttcaggcaattgattttcttcactggaactaaatggagaaagtatttcttttgcagcgatttcttctggttctctatgaaataacagatttgacaataaaaaaccactgactatacaaaaaataagaactaccgtagacataaaaacgattaacttaggggaggtgagtattttcttgttgattttttctatcattatttctttttacaaagaatgatcagtaaaaaccattcatttctcctttcatttgaaatcgaagaaacagtgtgctctgacaaaatcgtcccttcaacatctaattacgtcaattttttctttttttttagcagaaagatattttgacgaaaaaaaaggattgtgacagaaaatatgtcacaatcccttattcaaaataaatagtagtcaattagctcaaaagcttgcatctgcggtaaataaatccaaacaaaagaggagaagctgtttttgcgtagctattcttattacttgatacagagtagctttttcacaatttttttagttggttcatttcattttctctagatagtcaagcgcatcttgtactgtttttactggtacgattttcatagaggaattcaattttttggcagcggcttttgcttcttcatagttggtttttatttcaggatattctttcttaacatcgtctgagatcgtatcatctggtgcaaagaaaatctctacaccggctttatccgcgcttgctacttttttatcgattcctccgattcggccgacttctccttcgctgttgatcgttccagttccggcaatttgcttaccatgtcgcaaatttttaccagtgacctgttcatagatttctaaagtgaacatcaatcctgctgacggcccaccaatagagccagaattaatgcgaacatctgtatctgattcgatctctgtatgatcagtaagtgtgatgcctattcctgcctttttatctgttggcaactcaatcagatcaccagaagctgttttttcttcaccattatgcaaataactgatttcgattgtttgtccaactttttggctttttacataatccataaatgcttctgtactttgaaagcttttgccgtctacttttgttactgtatctcctactgaaagcttgccaaaaaagttcgatgtcttctctacgctcatgacatatacgcctttgaattccattttataaggcttgcctgcaagcttcaacgcttgttcgattgctgcgttttgggaagaatccatataatactgttgcatttgattatattcttcatttgttgccccaccagtcaattcttctttactaatcaattcttcaaagggggctagtttagcctttagagccaaaaatccggtagcttgcctgataccgacggatgtaagagagaaagagccagaacctttgtcttctttgtcattgactgtaattaattctttcagatcaatcgttgctcctggtgattccacataatatggcagaggaactactacaaatccgatgatcaacattccaaatatgataatcagtactgttttgaaccattgtttagctttcatttgattcacgctttccagctagagcttcgttgataactggcggtaaataactgcttacgtctccaccaaagtgcagtacttcttttaaaatactggaactgacatggctatattctggttttgccaataagaacaccgtttccaattcctcgtttagatgatggttcatctgagcgatttctcgttcatattcgaagtctttgatactccgtattcctctgaccaaggcatccgcgccgatttcttttgccgtttccactgtcaattgattttcctgatgtatgacttttacattaggaagatgtgccacagcttttgcaatcaatgtcattctttcttctggaggaaacaaactgttctttgaagtattgataaaaacaccaattaccacctcatcgaataatttagccgcacgctccactgtatctaagtgtccttttgtaaaaggatcaaaacttcctgggaataatgcacgtttcatcgttttccctcttttctatagatagtcacagctgttatgccataaatctgttttcttatttgatgaaatccagccacagattctggcaattcgactgttttatccgtttcgcatacgataactgcggttttagaaaaaagtcccagttcttccattttatggatttgatcaatgattttttgttttgcatacggcggatcaagaaacaagtaatcaaattgttgtttctctgttgctagccgttcgattgctttgtccgcatcaagttttattgtggtaaacttctctggttctttcgtaatctcgatgttttctttaatgatttttagcgcttggtaatttttgtctacgcatactgcatgactacagcctctggatacggcttcgatagctaaacctccgcttcctgcaaacagatccaatactgtctctccatcaaaatagggtccaatcatattgaatatggattcttttactttatctgtagttggtctggtattcgcccctgctaaactttttaagcggcgtccgccataatttcctgatattatccgcatctactcactccttagaaatggtactggtactagtataccaaaaaaaagacaaaaaaatacttggacaatgatcaatttttgatagttgtccaagttatttttctattaaaaaactgctcataagagatttttaaagatgttcagctaatcggatttctgtattcagctcttcgatttcgaaaccttcttcttttaataccgttttattacctattttatcagcaaaattcatttcgatatctggtcggtaagaacgttctacgtttcgaacaaaatgtaatttacggattcgttcttctgtctcttcaaatgtctcttcattcaagtaaagaacgacatatttcatttttcttgagacataatgcaacaagccgaacttttttagattctttaattgttttaagctgtagacccatacgatcagcccgcgtcgttttattatttcaaattcactattgtcaacttgcatgacaattccctccgcatccaaagtgttttttcgtttcaaagaacggactacctgcatctatcttgatttcattagaaacttcttcagcaagtgcttggacaatttgatccaacagactttgtaactgtgtttcactatacctaaaagctgcgacatgctcattcagatcaagctgtctttttgcttttcgaagagcacgttttttttcacggtaatcaggtgcatattcaccgtatgccgctacattttcaaacacctttttctgcgacaggaacgcttcttttaattggcagacttctgcagattctttcattgattgtttatgtttgaaataagaagccatcgttttactcttttttatcatttcagcgactcggaggcattgatcctccagttgaaacagctcttcattaacgatcactgctatcactactttctccgttttcttcttgcaataagactaacatattttctttagaaaaagcaatgcctaatgaatccgttcccggatccataaagcggtcatgattatatggatcgctgtaccaatataaaaacgaaaaagtagcgtcgattgctggatgaataaacagtccactagtattttctaatttctgtttactgattaacttctccaattcatcattcgtcaaggaaaatttcgttatcgtttgtccactacctagcgatttttgccaatcagccatacgttcgtctgacaagatttcttcaggctttgtcaagaaatcatgtagcagcagccgactgtggttttgaaaggcaagtggttggttgtatataggaagttcgtcttctcttctaagcatgtttagtaaagtcgtactttttcgttctttaccgcgattgatcgattcccagtcagccgatttatctgcttcataatgtgggagaccttcaccaaacacttgatacggtaaaagtttcaaaagactatctttatctaaatatacaactgaaaacagaccgttagttgtttgatcaaaaaacaaaatagcaaaagtgtcgttatcaaaagcaatcagtggacgataattcatatcctcttccatcagttcgattccaacttctgtgtcatgatactcaaaagtgaaattagtatagatagtcgtgagctttgttaggtcctgcatcgtcatccctaaataaaacggcgtgatatcagcaggtcctgtttgcagtactttaacagttgtgaccatgctatcttggacattcacttcaaaagtgagatgactggctttgttttcataatatcttgtttcaaaaccaaacccactagttaatcgatcataggatggtccaaaatctttttctagctgttcgatcggttttccaatataagtagaaaaaccagttgctttaagctcctggtatttccacgttgtcatttgatttgagagttgttgatcagagttttccttcacttcaagttttggcgggaacaagactggttccatatagaatgccgcaataactaatagcagaatcagccaaaacaaacccagtcttttcatatttccccacctttcacttattatttttcagtcacttcaatcaaaaggtcgccagatgaaatcgtgtctcctgaagatacatatacatgtgcgacttctccgtcaaaacgtgcttcgatggctgtttccattttcattgcttcagtaatcatcaacgtgtcgccttttttgacgttatccccttttttcactaatacatcaagcacagaaccagacatcgttgctccgatttgttcacgatttgttggttcagctttcaatcgagtttggaccgcactgatgattgaattatctttgatagtgatttcacgtctttgcccattcaaattgaagaacagtacgcgatttccttcgatatcgggttctccgatttcatctaaacgaatgataagcgtttttccacgttcgatttgtacattgattgtttcacctaaacgtatcccttggaagaatgttggtgtatccagtaatgtaacatcgccaaattgattgtacgctttttgatagtccaaaaagacttgcggatacatcaaataacttaatacttcgtcttgttttggttcatagccgattttttctgccaattcttttttcacttcgttgaaatcgactgatttcgccaatagacctggacgttcactcaacgcgggtctgcccttaagaatgatcttttgcagtttttcaggaaatccgccgactggttgccctagttttccttggaagaaagttactacagattcagggaaacttagtgtttcgcctttttcatagatgtcttcttctgtgagatcattttggaccatgaatagtgccatatctcctacgactttagatgatggagttactttaacgatatcgccaaacatcaaattgacagtatggtacatttgtttgatttcatcccagcgatgacctagtccgacagcttttgcctgttgctgcagattcgaatactgtcctcctggcatctcatgcatatatacttctgtttcaggagcattcaagccattttcaaatggtttgtaatacatacgcacatcttcccaataatggttcaatttctgtgcattttcaattgtgatttctggcagccgtggcccattgaccagcgcataatacaagctgctcatgctaggctgactcgtgttcccactcattgcactcattgctacgtcaacgatatctactcctgcttttgaagcagcggaataagtgataatcccgtttccactagtatcatgagtatgcagatggattggcagatccgtcgtttctttcaattcactaatcaagcgataagctgcttgcggtttaagcaatccagccatatctttgattgcaatgatatgcgcacccaattgttctagttcttttgccatgtctttataatactgaacattgtattttgctcggcttggatcgttgatatcgccagtatagcagatggctgcctctgcgattttaccagtatcccgtacagcttggatacttttttccatttgaggagtccagttcagactatcaaagattcggaaaacatcaatcccttgtgctgctgcttctttgacaaattccaccagtacattgtcaggataattagaatacccaacggcatttgatcccctgaaaagcatttgcagcaatgtattaggcattaaagaacggatttttctcaatcgttgccaaggatcttcattcaaaaagcggtaagccacatcaaatgttgctcccccccacatctcacttgaaaagagttcaggaagaccttctcccgttaagcgtgcaatctgcttgaaatcctttgtccgaacacgagttgctagcagactttgatgggcgtctctaaatgtcgtatccgtcaacaataaattttcctgtcctttgatccattcgaccaaagcatcggcaccatttgcatctaatacgttcttagccgttacgtaattagttcttgtgattagatctttaggcatacgtggttcttcataaaatggtttttcgccactttcgatacctggaaaaccattgacagtaatttcaccgatatatttcatcgttttatttccgcggtctcgtagtcgaggaaattcaaataatgttgctgtactatcgataaaagttgtttttgcatttcctgattggaattcaggatgtgtgatgacatttagcataaatggaatatttgtttttactccacggatcctgaattctttcaagcaacgttccattttctgaatggctgtttcaaaagtagcgccatgcgtacatacttttactaacaatgaatcaaaatacggcgtcaccacatagccagcgtaagcattccctacatccagacgtacgccaaatccgccaggtgaacgatacgtatcgatttttcctgtgtctggtaaaaagttattcaacgggtcttccgtagtgattcggcattgaatagctgacccattcaatttgatttcttcttgctgaggcaatccgatttctttatgcaaatctagcccttgggcaatcaatagttgcgttgtcacgatatcaatatctgtaatcatttctgtgatcgtatgttccacttggacgcgaggattgacttcgataaagtaaaaatcatctccttcaacaagaaattctaccgtacccgcattgacatacccaacatgtttcatcaattggacagctgcctgacaaattttttgacgttgctgttcgttcatagagacacaaggcgctacttctactactttttggtggcgacgctgaacagaacagtctctttcgaaaagatggatgacgtttccatgtgtgtcaccaagaatctgtacttcgatatgcttaggattggcgatgtatttttcaacatacacttcatcgctaccaaaggcagcttttgcttcgctttttgcacgttcgtaaccttctcttgcactcttttcatcatgagccacacgcattccgcgacctccgccgcctagagctgccttgatcataatcggataaccgaatcgttcagcaaattccaatgcatcgtctacagaagcgattggaccatctgtacctggaattgaggcaattcctgcttcgatggctgcagcttttgctttgattttatctccaaaaatatccaaatgatgcagtttgggtccaacaaaagtgatgccctcttcctcgcaccgttgcgcaaaattcaagttttccgataaaagaccataaccaggatgaatggcatcagccccgcattctttcgcgatcgagatgattccttcaatatctaggtacgcatcaatcggtttttttccttgtcctactaaatatgcttcgtccgctttaaaacggtgtacggaatattcatcttcttctgcatagattccaacagttttaattcctaattctgtacaagcacgaaatacacgtacagcgatttcacccctgttagcaactaaaacttttttcatcgaaccactcctacatctttttttattataaacctaagctcttgcgtttttcatccgcactaatgttaaggacaaagccgacacagatcgaaagcatcagcaaactggatcctccttgacttaagaatgggaatgtaatccctgtcagaggaatgacaccagtgattcctcccagattgacaaacacttggatcaaaaacattgcgccgatcccaatgcacaaaagcgaattgaacggatctcttgaacgaatccctacaagaataatgcgcacgatcataaagaatagcaacgctaatatcaaaatccccataatcactccgagctcttccactacgattgcatagataaaatcggtttgtgcttcttgtaaaaatccctttttctggatactgttacctaaccctctgccaaataacccgccattgaacatggcatagtagccgttaactaattgatggcctttatttaattcatccgagaaaggattttggtaaatagcaaagcgattatagatatactgtaaacgcccaggcaagatttttccgtttgtaatattgattagccagatcgtaaaagtacttaaacaaaaaccgcctactcctacaatcaaagtatacacataattgactccgctggctaaaagcagaaccaaaataatcaaaaagataactgccgcattcccaaaatcgggaaggatagcgaccaaagcagtcagtccgataaccattgcaagtggacgttttacagtccctaggaaatctttttgtacactgttttgcctttttgataaagtcagagacagataccagatagaaataatctttaggtattcggcaggttggatcgaaaatcctgcaatttgaagccaaccttttgcaccattgatttctttaccgaaaaacacaacgattagcagcaaaatcgtcaaaactgcgatggctgccatgattaaacgctggtttttcaaaacatctgttttcattttgtagagtagtgcgatagcaatcaagctgagcacccaaaaaatactttggttaatgactgatgcggacggattttgtccgttttctaataatagatacgacgtagaactatataccatgatcaaacccaaaacacataaaatcaaatagggaatcaagatactatagtctaatagatgccttttttttactttcttaggcaagtctattcctccttgccaacttcttttttatcataattttcttggtaaacctcactgtataactgattcaattctcgttccagctcacttaacatcagctgcccctcgtttttttcgattactcctatacgaacagcaaacccgacttgctgggagaaaccgtacatctgtgtatctaccacttcttcgaaggctttgcattgcgagatacagagactgttattttggtttcggattaatcgtttgatccgttctgcttcatcatttaatacttggatcgcaagttttttcgacaaagaatccatctgtgcttacctcccgttctaattcctcaattataacatatttcattttcatagggagcaaaaaaacagatttaaccagttgtttttattcatttttacgtaatggtccttcttgcttatccagaacattaggatccatattttttatccgagataaaaaggcttctccgtatttatcaagcttgctttgaccaactccctttatctgaagcatctctagtctgcttgatggacgtattcggctcatttctttcaaggtggaatctgaaaatacgacatacgggggaacgcctgcttctgatgctagatccgttcgaagttcccgcaacacttcaaatagtgtatcggtctcttcatccgacagctgctggactttcttgggttcctttcgataaacagcttcttgtccttttaatacttggatccctctttctgttactttcaagataggatattctccatcaacggtcagaagatagccattcgatatcaaatattcaatcaactgcatcgtttctttttgcgattgatttttcatcagtccataggtagataaacgttcaaaccctaaggctcgcagcttttgttctttcgatcctgctaagactttcattagcatctgcttgccataattctcccccatacgtttcaaacaagaaaggaccatctgtgcttgtgtcgttacttctactatttctctatcatctaaacagttaccacaacgattgcacggactgcttgtctctccaaaatagtttaggatgtattgctgaagacaggattctatatacgcgtattctgtcatcgcttttaatttttcatattctttttgcttttgctcctcttctctttgggactgctggataaaaaacttttggacctgagtatcttgaggagcgaaaagcaggatggcttcactggaaagaccatctcttcccgcacgaccagcttcctgatagtatgcttctagagagccagggatttgataatggataacaaaacggacattgcttttatttatgcccatgccgaatgcattggtcgctacgattagctgtaagcgatcgtataaaaaggcctcttgcattgccgttcgttcattctcatttaggccaccatgatatctgcctatagaaaatccaaattttttaagcaaatgatagattcggtctacttcttttctcgtcgctgcataaataataccagattgatttttgttgattttcaaatactcgactagatactgttcttttttttggtctttcactacttgaaagcggagattttcccgttcaaaaccagtctggatgtgattgccgtcagggatttttaaaagtcgttttatgtcagcggctacttgtatagttgctgtagctgtcagtgcaacaataacaggtcgatttggcagttgatttagctgtttcgccatttgtaaataacttggacggaaatcatgcccccactgagagatacaatgcgcctcgtcaatggcaatcatacagacgttccatcgattcatcgcttgaatgaaatccggcatgataaaacgttctggagcaatataaagtaaacgatactgctgcctatcgatttcttggaagcgcctagctgtttcgtaaccatctaacgagctattgataaaagtggcgggtatacctaattgatttgctgcatccacctgatccttcatcagagagatcaaaggggatacaaccacagtaagcccatctaatagtaaagatggaagctggtaacagattgatttcccacttccggtaggcatgatccctaatacattttcctgatcaatgactttctggataatttctttttgaccaggtctaaacttatcataaccaaagtattgttttaataagtcgttcatcttcccgctcctttcccttgccattttacttcggttttcaccgaaggacaagtcggccctctcgtgaaacataagtgcgatatgaaacaaaaacacgtcggagttaagttctttaaaagtctttaaaatgtcttttggcgtattttctgaatttatgtccattgacaacgatgacttctccacagaaatgagttggacaaaaaaagaaaccagctattttttataacaagctggtttctctcttcatccttttacagattattttttctttttagatgctttttcacgagcatttttctctaaaatttgttttctcaagcgaatgctttctggtgttacttcgcaatattcatcatcattcaagaattccaaagattcttccaacgtcaattgttttggttttttgataacagatgtttggtctttagtagcagaccgtacgtttgtcatttgttttgctttcgtgatgttgacagtcaaatcattatcacggctgttttctccgataatcattccttcatatacttctgtacctggttctacgaagactgtaccgcgttcttcgatactcatgatagaataggtcgttgcttttccggtatcgattgaaacaagcgcaccttggtgacgtccaccgatttgaccaggaagcattggcaaatattgatcaaaagtatggttcatgattccgtaaccgcgtgtcattgaaaggaattcagttgaataaccgatcaaaccacgggcaggggtcaagaatgtcaaacggatttgtccgtttcctgtatggaccatatcttgcatttcacctttacgtaaactcaaggattcgatgacactacccatgtattcttctggtgtgtcgatttgtacgcgttcaaacggttcgcattttacaccgtcgatttctttttcaataacttctggacgagatacttgcaattcgtatccttcacgacgcatgttttcaatcaagatagacaaatgcaattctccacgaccagaaacagtccaagcatctggagagtttgttggttcaactcgtaaagatacatctgtttgaagttctgccatcaaacgttcttcaattttacgagcagttacatatttaccttctcgaccggcaaatggtgaattattaactaagaaagtcatttgcaatgttggttcgtcaatgtgaaggataggtaacgcatcttgatgatccacaggagtaactgtttcaccgacaaagatgtcttccatacctgagacagcaatcaagtctccagcttttgcttcttgaatctctagacgttttagtccaaagaaaccaaataatttcgttacacggaatttcttaactgttccgtctaatttaattaatgctacttggtcgcctactttgattgttcctctaaatacacgtccgattccgatacgacctacataatcgttgtagtcaagtaatgaaacttggaattgtaatggttcgtcgctattatcgacaggagcaggaattttttcaatgatcgtgtcaaaaataggtgccattgttggttcttgatctgcagggtcgtctgataagcttgacgtaccattcagtgcagacgcataaatcacaggaaagtctaactgatcatcatctgctcccaattcgatgaatagttcaagtacttcatcaacgacatgctcaggacgagcagaaggtttgtcaatcttgtttacgacaacgattggtgtgatatgttgttccaatgcttttttcaatacaaaacgtgtttgaggcattgttccttcatatgcatctacgaccaacacgacgccgtcaaccattttcatgatccgttctacttcgccaccgaagtccgcgtgtcctggagtatccatgatatttacgcgaattcctttatagtctacagctgtgtttttggctaaaatcgtgataccacgttctttttctagcgcatttgagtccatcgcacgttcttgcaattgtgtatgtgcgtctaatgtatctgattgttttaacagttcatcaactaatgttgtttttccgtggtcaacgtgggcaataattgcgacgttacggatatcgtttctataattcaatgtaactaactccttttttattggttctttatgacagggcaaattttactcgactgctaattatagcagacttttttcatgaaatatagtaaaatgttttcattttttcgagaaaattaatcttttgcccgtttttatcatctttgtgaatgttttctaccttttttcagccttcttttttcaaaaggtctgcgatttctgcatatgcacaaggagtccctgctaaatagtattcccttttatcaaaggtcaatggagtgccaaaaagaccgcttgttaccataccaaactcttccaataagacatttcccgctgcataatcccaaggactgaggttcgaaatgtaagcaatatggtttcctttcaagattgcggctagttcaagacctgcacacccgtacatacgtgttcccatgctgctttccgcaatctctcggattccatatttattatgaccgaaaagatagctattcacaccaagtaagccttctgataaagatttatttgctggtttaggcattggtctatcatttttgtaaacacctattccttttccaccccaaaaaagctcatttctcatgacgtcataaatgaaaccaagttttccaacgccggattcataaacagcgagcatgatacaaaaattttccccttcaatcacgaaattcaatgtgccatcaataggatcaatgataaagactcttccatcaagatctgctagttgattatacccttcttcttctgccaatattttcgcctctgaatcataggaatggattttttcgattagaaaattctggatgttacggtcaacatttgtcactaaatccgttcgatttgatttttgcgagatcgttaatgtttgttgagaagattggattttctcaccagcttcttcaagccatgatttgatatgatcaatcatctgttccatttatctcacccgttcattctcaaagttttgtttggatttttttttgcttgctgcactgtacgatataaggagtacccggaagctttctcaaattcccgacccaatcgtttttcttctccgatggatttgacaactgttttgaactgctgataggtcttcaaaaaagcttcattgtttatccctttttcgttcgcacgttccagatcttcccacatcttcattacaatgaccatttcatctgttgtccagtctaaatcaagtggatactgatattcttgcatcttcaactctcctatttcatattcttctttagtgtagcataggagacggtaataaaccaagaagtagtcgtatcacaagtttacataattaaattattgataataaaaaagaaataaaaaaggagactgaaaacttactcctttttatcattcttatctattattaagtttcttcgtattaattccaaaaaaacttgatttatcttagatgatcacgtgtaagattgcttgtttttctactcttggcgagtaattgagagttaatcactcggattgtctggccgtttttgtttttttcttccatttgacgttctgctttccttcttagcctttcttgtactccattatttataaaaattttttcttcattgataagtttatcaaagctagggttcatgatttcacgaagggtatgatcttgatttttagcgtatgtttcccataatgtattacttgcttctatatcagattgttctctaagcgctataatcgtattttttttataccaaatcaattcagaatcatctgcaaatactacttggcttcgttcaattcctttacctttacgctcaagtacctcgagcaaagaaggtccatcgatattagcatttcggagcatgatagtttcaatctttgcgtatttctcggaatctgcgtcaaacaaatcagacaaatgatcaaagaagcgctcttcagttctacgaatcaattgtctaatctgttctatttgtggttgttgatcaagtgataacgatgggtcaatttggatgcttgcgcctacctcagttcctggaattttcatttctaacttccttctttcccatttgatggattacattactcaaatatttctgtttattttttatgatatcagtttatgtaataaaaatacgtaccattattttccagaaaaagaaaaaaacgcaactgatttctcagttgcgtttcgcctatattattcaaatcaaatatgaattggcaagcctaatgctaattccgaagcatccatgacgatttcgccaagagatggatgcggatgaatcgtcaaagcgatatcttcagcattcattcctgattcgattgctaaagctaattcagaaaccatatcgcttgcaccgactcccccgatttgtgcaccaatcagcacgttatcttcaatcgtcgtaactagacggatgaatccttctgttttaccaagcgataatgctcgaccgttccctgaaaatgggaatttatatgcttttgcttcgataccagcatcttttgcttctttgatcgtcatacctacagaagccaattcaggatcagtaaaggctactgccggcattgctttataatctacagctacttttttgccagagattgcttcagcagcgatttttgcttcataactggctttgtgtgctaatgccgcccctggaacgatatcaccgatggcatagatattgggtacgttcgtacgtccttgtttatctaccgtgatcaatcctcgttctcctacttcgacacctgcttgttctaagcccatatcatccgtattcggacgacgacctacagtgaccatcacataatcagcagtaacggattcttctttcccatccactgcatatttcactgtcacgctgtcgccgttatcgactgcttctttcgccattgcattcgttacgactgttacgccttttttcttgaaatcatcttctactaattttactaaatctttttcgtaagttggtaaaatttgtggtgagccttcaaggatcgttacttctgctcctaagtttgcgtacgctccgcccaattcggcaccaatcacaccgccaccgatgatcacaaatttcttaggtacttctttcaatgctaatccgccagtagaatctaacacacgtcctccgaacttaaatcctggaatctcgattggacgggaacctgttgcgatgattgcgttattgaacgaataagtttgagctgaatctggatgaatgacgcgtagtgtgtgatcatctacgaagaacgcttctccttcgattgtttcaaccttatgtttttttaataggaaaccaacaccagaagtcaacgtatgaacaactttgttttctttccattcttgtgttttcgcaaaatctagtttgacattttcactagttactccaaacatttcagaatctagtgactcttgataatggtgtcctgcagctatcagtgcttttgaaggaatacagccgacgttcaaacaaacaccgccaatatactctctttcaatgattgctactttttgtcccatttcagcagcgcggatggcagctacatagccaccaggtcccgcaccgattacaactgtatctaattctacagcaaaatctccaactaccatttgtttatcatccttccatcattaatagctctggatcagctaaaagacgtttgatattgttcattgcttgttgcgcagttgctccatctacgatacggtgatcgaaacttaatgacagtttcatcacacgaccgacaacgatttcgccttcagcatttacgattggttgttgtgcaatcgttcctacacctaaaatagctacttctggatagttgatgactggtgtaaaccaaccgccacctacagatccgatattgctgatcgtaatcgttccattgcgcatatcttctgcagatagtttgccgtcatgagctaattttgctttctcattgatttcgtctgcaatagcaaacattcctttgcgatctgcatctttcacatttggtacatatagtccgtgatccgtatcagttgcaataccgatattgtagtaatgtttataaacgatttcttggtttgcatcgtcgatagatgcattcaatactgggtatttcttcacagtcgctgttaaagctttcacgacatatggcaagaaagtaagtttcgtaccatttgcagcagcaacttctttaaatcgtttccggttatcccatagtttagacacttctacttcatcatgcaatgtcacgtgtggagctgtatgcttactgttgaccattgctttagcaatagctttacgtgttggtgtcattgctacacgttcttccaaatctcctaagttggacttgaatggttttgctgttgcagctggtttgctttctgctgcagcagctgcttctttcggcgctgccgcttctggcgcttctgatttcgctggtgcactgcttggaccacctgtcaagaagttttcgatgtcctcttttgttactctgccaccttttcctgttgcagttacttgtgagatatctacatctttttcgcgggcaaattgacgaacagatggcatagccaatacacgtttatttggatcggcagcttcaacgacacttgctgaacctgatgtttccactttttcttttggtgcttcagctgatggcgcactagttgatggtgcaccattgtgtccaggagcatcgatttctactaacacgtccccaacatttgctactgtgccttctgggacaatcacgtttttaactgtcccggttacgggtgacgggatttcttctactgatttgtcgttttgaacttctaataatgtatcatcttcattgattgtatctcctggtttgacgaaccatttgacgatttcaccttctgcaattccttcaccgatatccggtaacttgaattggaagactccttcgcttgacgatccagctgatcctgtatcaacagttggttcagcagccgggttagctggagtttgggattctgcggctacaccactgtccccttcattgtcttcgtgtcctggtgcatcgatttctaccaatacatccccaacatttgctactgtaccttctggaacaatgacatttttaaccgttcctgttacaggtgaggggatttcttctactgatttgtcgttttgaacttctaataatgtatcatcttcattaatcgtatctcctggtttgacgaaccatttgacgatttcaccttctgcaattccttcaccgatatccggcaatttaaattgataagccatgactttgtttcgtcccttcttttcttaaaattccgcgatttcttttactttgtcttcgatatcttttgcatttggtaaccaaacattttctgcttgtccaaacgggaagactgtatcaggtgcagaaactcgtccgattggggcttctaatgaaaggatagcgcgttctgagatctcagaaactacttgcgcagcaacacccgcttgtcgttgtgcttcttggacaacgactacgcgacccgttttttccacggattgaatgatcgtttctacatctaatggcgcaactgtacgaagatcaatgatttcaacagagatattttcttttgcaagattatctgctgctttgattgcttcacgcaccattgccccgtatgtgataacagatacatctgttccttcacgagtaactgctgctttgtccaaaggaacttcgtaagcttcatccggcacttcttctcggaacgagcgatatagtttcatgtgttctaggaaaacaactggatcgttacttctaatagaagaaatcaatagtccttttgcatcgtaaggatttgatgggatcactactcgaataccaggagactgggcaatcaaaccttctaaattatctgaatgcagttctggtgtatgaacaccgccaccaaatggtgaacggatcgtgattggtagatttctagtaccgctcattcgatatcttgtacgagccatttgagctactacttcatccattgcttcgaaaataaaaccaaagaattggatttcaggaactggacgaaatccttccaacgcaagcccaaaactcaaccctgcgattccagattcagctaaaggagtatcgaatactcggtcttctccgaatttttcctgcaatccttcagttgcccggaaaactcctccgtttttcccaacatcttcaccaaaaacaacgacattctcgtcattttctagttcaagtgctaaggcatcggtgattgcttggatcattgttttttgtgccatgattatttcgactccttcgcttcataaattgcaatttgttctttgattgattgtggagatacttcgaacatgtttttcaagaaatctgaaaccttttgttttggaactttgtcggcttctgcgatagctgctttgatttcttctttagttgcttcaatcacttgttcttctttttcttcagaccaaagtcctttttccgtcagatatttacggaagcggatcaatggatcttttttctgccattcgtcatctgtgtcttttgtacggtagcgtgttggatcgtccccagatagtgtatggggtccgtaacgataagtcagtgtttcgattaggactggtccatttccgctgatcgcccattcccgtgccattttagatacagtatacactgcaagcggatccattccatcgacttgaatacctggaatcccagctgcgacagctttttgtgcaagtgtttttgctgcggtttgtttttcacgaggtgtagagatcgcatacccgttgttttggatataaaacacagcatttgcatggtaagcgccagcgaaattgattgcttcgtaaaaatcaccttgtgatgaaccgccatcaccagtataagtgaagacaacatttttcttgttgcgtttcttcaaacctaatgcaacaccggctgcttgtacatattgtgcaccgatgatgatttgtggtggtagagctttcaattcttctggataagaattacctgcagcatgtcctctagaccataaaaatgcttgtgataaaggtaaaccatgttttactagttgagggacatctcgataacctggaagaagaacatcttctttatcaaatgcatacgcgctggccagctgacttgcctcttgtcctgcagttggtgcaaaaaagcctaggcgtccttggcggttcagcgctgtggaacgttggtctaatacacgagaccataccatgtgagtcattaattcaacgagttcatcatcggataaatcaggtactaaatctttgttaactacgtttccatcttgatcaagtgcttgatatactgggaaatctgcattgacttcatctagcagtgcttggaagtcgatcggtgcttttttgtttgccatttgtcacacattcctctctcatctataagaaaatctcttcattctgcgattgaaacagcgaataaaactgtatcactatttaaccgtcttcattaataaattatcatggatttatgagaaatacaagctaaaagcacaaattttcacgatgaaaggaaattatgtcaatccgcatattaacagctttagtgaatataatcacaatgaggaaagcgttttatatttaggctgtgttttttctattttctaatcaaacttgcaatgatctgtttctatttagaaacgctggtgttatacagttttgctgcaactatttattttcttaagacatcgtgaatggctatacaaagagtgtatttttctctaatactttgcctcgtcttctttttacgaaaaaaaagaaacagccggaaatttaaatcccagctgttatattctttaatctttttactttgtgaaattattctgttaaccactgttctaaaattttcatctttgaataaaacaacgatatgttggcttcatctagacgactgtaattgattctgattccatttatatcttgcccaaaaagtagacttggtgcgattcctagacccaaatctactactttttctgctagttgggggtccagcttttttccatcccaagtgatccaagcataataaccacctaaaatcgaatgaagcttgaaaaacgattgagactccgcccaaatgcttatcagttggcttttttctttcaatttttttcttacatccaacattttcaaatcaattgcttcatcaaatacattagcggccgtgatttgtgtaaggatgttcatcgaaaactccatcatttcttgcgctttagctagttgcgagataaaggcctctggtccgatcaaccaaccgattttcgttgtttttcctaaaattctagataacgaaccgacatataatacattatccggatcaatcgttcgtataggaagaacttcatcttggtttagaaatgaaaggtccgtaaatacatcgtcttcaataattggaagccgatactgccgacacaattctactagcttttctcgtcgcttttgactcatcacttttcctgtagggttttgaaaattggggttgatcagcactgctttcaatttatttttatggatcgattctttcagtttttctaagtcgatcccttcttcatccatcggtatcccaaataaacgcgttcctgaagctttgaaaagaggtaatcggtaaaaaaaagaaggtgactctacagctatcccctctccagcagaaagaatcgtttgtaagatcaaaaagattgcttgctgaccaccaccagtcaccagaagctggtttagggaaaaggtcagttcaaatttactttccaaatactgtttgattttgttacgtaacggagtatagcctaaaagatccatttctttttcttccactaagatttcttcaagagaataagaaggaaactcaaaattcggcaaaagctcatctggcatctcactcgcatataagtcaaggaacaatgttctttggctctgctttgcttcttttattttttgttcataccaatccgtctgttcatagcgaggtgagatcatttttcgccaatcgattcttggaacggcgaatttcccccattcagtctgattgacgaaccaaccgctaccacgtttacttgttaatacgccaagctctctaagttcttccaatgcatgaacaacggtggaacgatttacaccaaaaaattgccctagttttcgttccgattcaagttgatctccaggattgattcttccactttcgatttctctcatgatctgttccatgatttgacgataaatcggtccttgttttttctctacttttccccacatagtcctctcttttctgttgtccattctttctattgattttaccgaatttacgagaaaaaagaaaagctttttttgcaaaacataaaaaacggaaggttctgttatgaaccttccgctgatattttactcattatttagatcgtatctccattaaaaatcgaatttttcacgatgacataatcaactttccgaatggattccagatctcttcctccagcatacgaaatagatgactgaaggtcttgttgcatttccactagtgtatctttcaaagatcctttatgttggatccagattttctttccttcaacatttcgtttttcacctttttggaattctgaagcagaaccaaagtattctttatatacaattccgttttcgacttttgtttcgccaggagattcctcgtgaccggcaaacaatgagccaatcataaccattgtcgctccaaaacggacagattttgcaatatcgccatgtgttctgatcccaccgtcagcgatgatcggcttacgagctgctttcgcacaccatctaagagcggccagttgccagcctccagttccaaagcctgtcttgatttttgtaatacatacttttcctggaccaatcccgacttttgttgcatctgcacccgcattttccaattcacggacggcttccggtgtaccaacattaccggcaatcacaaaagtttcaggcaaatattttttaatatgctggatcatatcaataactgagttagcatgtccatgtgcgatgtcgatagtgatataatcaggatttagcgattcttctgccaacttctctataaaggaatattcctctttcttgacgccaacactgattgaggtaatcaatccgcgctttttcatttttttgataaacggaattcgggctacttcatcaaaccgatgcatgatatagaaataaccattttccgctaagaattctgcaatcgtttcatcaataatcgtctgcatgttggcaggcactactggcattttgaatgtatgtttacctaatgtgaccgttgtatcacattcagaacggctatttacgatacatttattaggaattaattgaatatcttcgtaatcaaatactttcattacattatcctcctgatgttcacatccagtaaaacacgaacattattaatttaatcagggctttttttagcgccctatgtaatttaactcaattaagcgaaaaaatcaagagcaaaaagagaatttatacgaatggttaaaaaacatacattatttttagtctatacaaacgaagcaatgaatgttcgcttttagcgaaaaaaaggctgtgacaaatgtcttgtcacagtcttttttctgaataaacggtgttctcctacgttgtccgttttttcttgttatacaagtctaatacaacggctaaaagcaagatcaaccctttgatcgcctgttgccaatctaccccaacgcctaaaatcgacatgccattgttcaatacacccatgaccaagccaccgacaatcgcccccataatcgttccgatgccgccagatgtcgaagcaccaccaaaatatactgccgccatcgcatctagttccatcgaagtacccgcttgaggtgtcgccgcatttaaccgagctgctaaaactaatccagctaaagctgccatgactcccatgttgacgaaaacccagaacgtgatccgctttgttttgattcctgatagtttagccgcttttcgatttccgcccgtcgcataaatctggcgacctgctactgttttatttgtcaaaaacccatatgccgcgacgatcaaaccgagaatgatcaaaatgatcggatatccttgataagaggcaaagatataagttatccctagtacaacgactgctgtaaataccgcctttaccaagaaagctgttggagattccacttcaaataaatgatttttccgacgatttcttgttcgccattgtccaacaactaacacgatggtgatgatcattcctaaaatcaatgtcaagaagtgaaggctacttccttcgcttaagtctggtaaataacccgtagacattttttggaaaacagctggaaaaggtgccagagattggcctcctagaacaacttgtgtcagtccacgaaacatcagcaatcctgctaaagtcacgataaatgccggtatcccagcataagctacccaaaaaccttgccatgcgccgatcagcccgcctactgcaagacatgtgatgactgtcacccacgggttcatttggcgattgaccatcatcatgcccgcaattgcaccaacaaacgccatcactgaccctaccgacaaatccacatgacctaagagcacaactaataacatccctgcagctagtactaatatatgactattttgcaaaacaaggttagttatattcaatggacgccagaaaataccatctgtcatcaattgaaacgcaataagtagtcccgctaaaatgatcaccatgctgtagtgaccaaaaagatcagctgctctacttttcaaatttagttttttctcttttttatccgtaagattttttgcttgttccaacttaccccacctcttctttcgtcattaatttcatcaagacttcctgatctgcctcttctcgcgagacttctcctgtaatacgtccttcgttcatcgtatagatccgatcacacattcctaagatttcaggaagttcagaagagataagacagacagctttgccatttgctgccatttcttcgataatcgtgtagatctcgtattttgccccaacgtctatcccacgggttggctcatctaaaaaaagaatatcgggttgtgtcatcagccacttggataaaacgactttttgttgattcccaccactaagactactgacaatttgatggatggagtttgtttttatacgcatctttttccggaaattttctgcctcagttacttctttttctttatctaatactcctttttgacttattttatccaaactgctcagcgtcacgttttcccgaatatccatcagcagattcagtcctaaagattttcggtcctccgagacataagcgagtccgtttgcaatggctgaaggaacggtcttaactgatatctctgccccttcctttaatatacgtccggatatcttgcttccataagaatgtccaaatagactcatagcgaattcagttctgcccgctcccatcagcccagctattcctacaatctctccttttttcaaatgcaagttgatatggtcgtttatgattcgctcctgatcaagagggtgatagaccgtccagtcttctactttaaaataaacttctccaatatccggttttctttcaggataacgatcaactaaatctctgcccaccatcccgcgaataatacgctcttcgctgatcatttcattttctagcgtctcaatcgtctgtccatcccgtaaaatagtgattcgatctgcgatatccacgatttcattcagcttatgtgaaataatgatggaggttacaccctgctctttcagctctcggatcaatctcagcaaattcgcgctttcttcttcattcaatgcagcggtaggctcatccaaaatcaatagacggacggattttgataatgctttagctatttcaactagttgctgttgccctacgccaatctgggatactagaagattcgggtcgatagacaaaccgactttgttcagcaattcatacgttttcttttctgtcagttcccaatcaatcacgcctctttctgcttgttcatttccgagaaaaatattctcttttactgaaagataaggacttagtgctaattcttgatgaatgatgacgatgcctttttcttcactatctttcaaatctttgaattgacacagctttccatcataaaagatttccccgtcataggagccatatggatataagccgctcaagacattcatcaatgttgattttcccgctccgttttctccgcacaatgcatggatttccccacgttcaatcatcagattcacgcaatctaacgctcggattccagaaaattttttggtgatatctgccatttttaaaatacaatccgccataattcttatcctctctctgacttagatctctttagttccttgtttggttcctctcaatttttcagatcggattctttataataatctgtgtcgatcagctctgcttgataattatctttatcgacagatactgtatttgctaaatacgtaggaacagttttcaccccattatcataagtttcagtatcattgaccggaacctcttctccatcactgattgctttgatcatttcaatcgtattttttgctaagatacgtgtgtctttaaagatcgtttgtgtttgttccccggcaatgatcgatttgacgccagcaactgtcgcatcttgtccagtaatcacaggtaaaggtttactttcactcccataccccacgccttttaatgacgaaatgattcctaaacttattggatcatatggcgacaaaacagcatccaatgtttggtcagtataatttgcgcttaacagattatccatccttgcttgcgccgtagaaccatcccagcgaagcgtagcgatttgactgaaactcgtctgtccagatggcacgatcaactgaccgttgtccatatatggttgtaaaacagacatcactccgttgtaattaattagtgcattgttgtcgtcaggcgagccaccaaataattcaatcgtgaatggcccttttccttctttcaatcctaagtgctcttcaatataagctgcttgcgatacacctactccaaaattatcaaaagtcgcgtagtaatcgacattttctgaattcatcagtaaacgatcataggcgattaccttgatatctgcttcttttgctttagctaacacatcagttaaagctgaaccatcgatagaagcaatcacaagtgtatctaccccttttgtaatcatattttcgatttgcgctacttgattttctactttatcttctccgtattgaagatctgttttataacccagtttttctaattctgagaccatgttgttcccatcagcgatccatctttctgctgatttggtcggcatagcgattcctacataccccgtactatcatctgcagatcctgaattgccacacgcacttaatagaatgcttgcggtcaaaatagcgatactcccaagaatctttctaaatttgtttttcattttttatcccccatttcaattgatacaccgagtatagctaataaagaaagcgttaacattgatttttttatgggatttactttaaattttttaggtgttctttttttgtcttggatttttttaagtttcttggatttttttcgattaattccttttgactttgattttctcctttatctgataagatagtactaacaaatccagatggagtgatctaaagtgaaacgtgttttattttttttagcccttattgtaatcgcttaccaaatgatggggtgtacacctaatacaaaggaagcacctgacccactagtcgttggtttttcgcaatcaggaacggagagtagctggcggaaaaagcatactgaatcaattatcactgcgcttgaaaaagaagattatcaagttctctaccgaaatggctacatgaatcaggaacggcaaatccaagatatacggacatttattgcctataaagtggatatgatcatttttactccattgcaagaatccgggtgggactctgtattaaaagaagcaaagcgagcagagatccctgtcatacttgtcgacagacatattcaaacgaatgatcccgagcttttcgtcacccacatcggccccagtttcaaagcagaaggaaatcgggcgggtttatttgtcagcaatcacttcacaaattcaaagaaacaggaaatcagaatcctagaacttgctggttcagagaactccacaccgaccaagctacgctccgaaggatttttggaatcaatcaatcgtaaaccaaccctaaaaaaagatggaactattgaccataaacctccaatgactattgttcaccgaattgtcggtgattttattcggatgaaaggaaaagaccagatgaaacgatatttagaaacaaatgatttatccaaaatcgatgtattatacagccatagtgatgaaatgactcacggtgctttagctgcgataaaagaaacatcaatcaaacctggagaagatttgatcattgtaacgattgatggacaagaagatatgatcgagaatctacgctcaggaatcgtcaattgcgtagtcgagtgtaaacctgatgtcggctggtatgtagccaataccgttactcgttattttggaaatcttcaaacaggaaaaacactacctaaagatatttttatttccgagactgtcttttcccaacagaatatagctaatatcccaaccagaaattattgactggagaagtatcatgacaaaaaatttaagcataaaacagatttttgcccaagcaaacaaagccatgcttctatttgctgttatccctttgctactgagcatactgttatattcgcaacagcttttgatttatcaacagacgatcgcaaatatccaaaaagcagatgcaattgctttgaaggttgatcaaaaagttttggaaagtatgtgggacttgatttctggccaagtaaccgtagatgagttcaataaggaaaatatcctagaagaacttaggaatgacattcgagagatcaaaaataataccaatacacttaaagaaattagtacgttagatgtatcgttacgtacgatcgatacattggaagattatcaaactgagctcattcatcatatcttggcagaagattttatggataccaatgaacagatcatcaatcaggtagattctgtcactcaactactgtcagatattttacaggattttgttcgtgtggaaatcgacttagcaagtcaaaaaaatacgacgcttgtccgctcactcattttattaacaatagtagaattgggggttcttagtactatttttttctatgcgaaaaagaatcgtcgctttttagaacaaaaggtccaagagccgatcaatcagctgatcacaatgtccgaacagctttcttcaggaaatcttggatttcgtttagacatgccagaaacacaagaactacagacacttaccgctagtatgaacaaaatggcggaagaactaaaccagtctttacgggaaaacgctttgaaacaataccatttagcacaaagtgaagttcgtgtattgcaagctcagattactccccattttatttataacagtttggatgccatcatttctttgatcgaacaagactgctttgaagaagctctgactatgacccatgcactttccggcttttttcgtacgtctttaagcaaaggacaagactggattcctcttgaaaaggaaatcagccatatcaatgattatttggtcattttaaaaataagatatagacatatgcttgactataagatcgatataccagaaacactttttcctgtttctattttaaagatgattttgcaaccattgatcgaaaatgctgtgtaccatggaacaaagtatgttcgtcacaaaggatttattcgtattactgcatgcaaaatcgacgaaatgatccaattcaaagtcatagacaacggtattggcattcctgcagaaaaactagcagaaatacgtaaagagttagccaaagggatcgattcagatttcagtatcggctacgggctttacaacgtaaacaagcgtctccttctctattacggaaataatcaaaaacctatcacgattgacagcaaataccgagaagggacaactgtcacactgacgattcctatatctcccaaaacaattggaggaaacaaatatgtataaagtttttatcatcgaagacgaatacctcattcgcaataacttacgggaacaaataactgcccttggttcatattatccaatcacatatgtcggggaagctggagatggtgagatggcactgtcttcgattatcgacttacagcccgatatcattctgactgatatccaaatgccattcatggacggtttgactttttcaaaagaagcaaggaaactgcttccttggactcgcctcatatttattagcggattcgacgatttcgattatatgaaaggggcaatccaagtacaggcagatgattatctacttaaaccaattaaaagcaacgaattgaaacaagcaatagaaaaagcagtgactgctttagacttgcagcaaaaagaaacgctcccttcttctgaccttgttttcgaattgaaaaaaaatcatttcttgaacggtttgttcaaaggctcacttacaatcagtgaaacattgaaacttgctgaatctttcaatcgctctttagcagggaaaaaaatgaccgtattattagcagcaaaccaagtcagtacagactttgaagattacgctcatctcagtgattatttgaagtttttatttagggagaatcaacaagtgattttttctgctgtttcctctcgattcattaaatttttaatagttgatcctcttgaagaaaatgtaatcgagaccagttatcaggtagcccaaacgttggtccatgaattagagaagggacaaaaaaataatttttctgtcgccatcggtcctgtcgcagaaagaatcagcgaattacctgcatctttcgagatcacgcagatgatacttgaaactgccagttcccttaaagatcaaattatcagctatgaggatttgattaaagaagcgaaacttccagttgattctgtcttttactttgatctctcacttgatttgtcttcattatcgaaaaacgaagtatctaagtacatcgaacacttgacggaaccacaaggcacaccaactcgaacacgattatatcgtttatttgtcttgactaagctactccagcatgtctgcctgaaagaaaaggaaatcccgcaagaaatggttcattgcacatccaccagtcaacgcttagcaatcagcgccgacgattcgctttaccgttcgactgtttatatgttcatttctttcttaactgctctgccctcacagccttcaaggaacaaatatcagccaattttgaaccatgcattggattttatcaaagaaaattttaccgatccagatatgtccttaacttgggtcgctcaacaagttgcattaagcccttctcatttcagtacgattttttctcaatcgtttaaccaaacattcatcgattatctgacagaacaaagaatcgaattagcaaaaaaattattacagcaatcagactatcgtatctcagatattgcttttgagattggttataatgaccctaactatttcagttatttatttaagaaaaaacaagggatttccccaaaagaatatcggacacagattttccttgaaaacaaaaataaataataaataaaatccgtacagtgatactctttcccgttgtaattaaaaaaagatggaatatctcgaagctgaaaatagctttcaagatattccgcctttttaattgatcgcaccgttcacctgcatgacaacttttaaggtaaaatgtttccagcagcacggtacaattcgtaccaatcttcccgagacatattaatttctgatgcttgagcgatttccttgattcgccctacgttcatcgtaccggcgattacttgcatattggctggatggcgcaaaatccaagcagaagccaagccagttggtgtcgtttgatatttagctgctagttcttctaatgtttggtttaattcagggaatttttcgttcccgataaatacaccttcaaaaaatccatactggtatggcgaccacgcttggatcgtcatatcatgcaaacgggaataatcaagtacactaccatcatggtcgatacttgcttcatctgtcatattgacatgaatcccttgatcgatcattccagtatgtttcaagccaaattgcagctgattagctactaatggttgacgaacatattttttcagcaattcgatttgcattggtttttgattgctgacaccaaaataacggactttacctgatcgttccaattcatcaaatgcttcagctacctcttctggttctaccaatgtatctggacgatgaagaagtaaagcatccacataatccattttcagacgggtcaaacttttttccacagattcaatgatatgttttttagaaaaatcaaacatcacacctggaacgattccacattttgtttgaataaaaagatcttctcgtttgattgatgtttttgctagagcatctgcaaagatttcttcacattcaccgttcccataaatatctgcatggtcaaaaaaatcaatgccgttttcataagctgtctcaatcacttttactggatcttccgcattgttgatacgcatacagcctaagatcactgcagctactttctggtcagaagtacctaattgaatttttttcatctgaactcctccttatttatatacacaacaaaagtgtaccacactctttatgaaaaggcttcactaaaatcgacacttccgactatatttgttgtatttttttataaatggaagcagctgatttacttcacgaccagttcgctattggcagctttttctccaatatctgtacgataaaatgttccatctgtcgttttatccattaacgcggtgtagattttttcctgtgcttctttgatcgtctcaccatatgcttctactaaataaagacgacctcctgctccaactagtttgccgttatttgaggaaactccagcatagtaaacagaaagctcttcttccagaaaatctggtagaaccattcctgtctcatattcttcggggtaaccggcagctgccaccacaacacctacattatatccttcttgctgccactttaactctactgcacgattctctaataaatcatcgattacttgcgcaaagtcactcttcaaccgagaaagaacgacttgcgtttcaggatcaccgaaacgagcattaaattcgatcacttttggtccttccttcgtagcaatcaaacccgcatataaaacacccgtgaaagagcgtcctagttctttcattcctaaagccgctggtttcaaaacttcttccacagctttttcaatcatcttttttggaatttgcggtactggtgaataagctcccatcccccctgtatttggccctttatcgttatcaaatgcccgcttatgatcttgcgaaatgaccatcggatacaccttggtatcacggacaaacgccaaaagggagaattcttctcctgccaaaaactcttctacgacgatttttttgctgctgttcccaaatcgatgctggttcaacatttgttctgccgcatccagcgcttccttcactgttgtagccacgactacaccttttccagctgctaagccatccgctttcactacgattggcgcaccgttttctttgatatacgctgctgctttttcgtaacattcaaaacttctggatttagctgtcgggatttgatacgtctccatcaattgtttagcaaaacttttcgaaccttcgatcagagctgctgcttttgtcggaccgaagattttcaatccttccgccataaaatcatcgacgattccatttaataaaggaacttcaggaccaacgatactccaatcaatagcctctttcttaacaaaatgaattaatgctgaatgatcttgatcactgatagcgacacaattgatgccatcctttgccattccaggatttcctggcgcacaatacacagtatccaccttcggactgtctaaaagttttttacttattgcatgttcacgaccacctgcaccgatcaccaaaatgttcatttatccgactcctctctaatgtctaaaatgccgaacatcagtaaagaccattgctagatcgtatttattcgccatatcaatagaatcttgatctttgatacttccgcctggctgaatgattgcttttataccatgtttggctgcatattcaactgaatcatccattgggaaataagcatcgctagctaaaactgcaccttccattttctcttgcgcttgttcaatcgcaatttttactgaaccgactcgattcatctgaccggctccgattcctactgtctgacgttcgtttgccagcacgatcgcattagatttcacatgtttgacagctttccaagcaaacgccaatgcttttacttctgctggagttggcttacgttttgtcacgactttccacgcttcttcgttttccattgccagatcttgatcttgtacaagaagtccacctaagactgagaccgtttcttctcgattttgactttcttcttgcgcaaagtctattgtcagtaatcggatgtttttctttttttgcagtaattccaaagcttcttgtgtataagaaggggcaatgatgatttctagaaacagcttatgcatctgttctgctgttggcagatctacttctcgattcaaaacgatgatcccaccaaagattgaaacaggatctgcttcatatgctgcttcccacgcttctaaaatcgtagatgctgacccaataccgcaaggattcatgtgtttcaaggcgactaccgttggctcgtcatattccttcataatccgtaacgcagcatccgcatcacggatattattataagaaagttctttcccatggagttgttttgctgctgcgatcgaatatttttccagaagagcggactgataaaaggcagcggcttgatgactattttcaccgtaacgaagcgtttgttttcgttcatacgtaagtgtcaatttttccggttctttttcttccacccaatccgttaagtattgagcgatcagtgcatcatatgcagcagtatgacgaaagacttttgccgctagtttttgtctgaaagaaagtgaagtatgcccatactgacgtaattctgaaagtacctcttcatagtcagatggatcaacaacagcggtgacaaattcatggttttttgctgcactacggagcatactaggaccaccgatatcaatgttttcaatagcttctgctatttcgacatcttgtttcataatcgtttctttgaaaggatataaattgacacaaacaaagtcgattggttggatattttccgtctccattgcctccatgtggctagggagatcgcgtctccctaaaagaccaccatggattttaggatgaagtgttttgacacgaccatccatcatttcaggaaaccctgtcacttcttcgatcgaaagcgttttgatcccagcttgatccaatgcatgctttgttcctcctgttgaaatgatttctactccttgttcaatcaaaccttgggcaaatgctacaatcccagttttatctgatacactgatcaatgctcttgtcatttcagatagcctccattttcaataatttcactaatcacttctggatagattcgatgttctactctatggattttttcttctaaagaatcgaacgtgtcctcctgttcgatcctcactttttcctgtcggatgattggtccagtatctacaccttggtcgatataatgaattgtgacacccgtttcttttactccagcttcaaatgcatcacgaatgccatgcaaaccagggaatgaaggtaaaagagatggatggatattgatgattcttttatcataattttccagcaatactggtccaatgattcgcatgtatccagctagtacaatcaaatcgatctttttttctttcaatttatgcaaaatcgcttcttcatactcttttttggattcaaattctttaggtgaaaaacaatctgccggtacatccaatgcgactgcacgtttcaaaacatatgctgcaggctgatcacaaaacaaccagtcaatcgaagcttccaatcctttttttgataaataatcggctagcgcttgaaagttgcttccgtttccagaagcaaaaacagcgattctcatcgttcttctcctgtaaacaccacacgatgtttttctttggcgatcactttcccgatttcataaactttttcgccagcttgctcaatctcgtgtacgatttcttttacttttgcttcctcgactgctaagaccatcccaatgcccatattgaatatttcatacatctccatcataggaatctcaccatatttttgtaaacagccgaagatcggaagaatcggccatgtgccaagtttgatttcagcagccatagattctggtaacattcgtgggatattttctacaaaccctccaccggtgatatgtgcagctcctttgattttcttttctttgattaggggaagcaaggaagaaacatagattttcgttggttcaagtaatacttcgccaagtgtttttttcaattctggcagttttgatgataaagaaaactgctgctgctcaaagaaaattttgcgaacaagagagtacccatttgaatggattccgctagatgctattccaagcaacacgtctcctgggttgattgtttctcctgtcaataattgagatttttcagctatccctacagcaaatccggctagatcataatcatttccagagtacataccgggcatttcagctgtctctccgccaatcagtgccatatttccttgaacacacccatccgctacaccttttactacattttctaaacgtgtcggatcatttttccccgttgctaagtagtctaagaaatacaacggctctgcgccttgtgctaagatatcattgacacacatcgctacgcagtcaattccgatcgtgtcgtgtttgtccgcttcgattgctactgctaatttcgtccctacaccatcggtccccgaaacaaggactggctcttttaattgaaagaccgataaatcgaaacagccgccgaatcctcctatagcgcccatcacacctaatcgttccgtttttttgacatgcttcttgatccgttctactacttcatatccagcttcgacatctacgccagcttttgcgtatgcatttgccattggcttcatatgctcccttcttgatctgcttttaaaagaacgatactttttcttttagtgattcctgatatttttcttcatagtcatataacggtgtcggataatctccgttgaaataagccatacacaatcctgaatacggggcatctttttccagaccgatcgattcgattagaccctcttcacttaaaaaacctaaagaatcggcaccgatacattctttgatttcatcaatcgtatgattggccgcaatgagttctttacgcgtttgaatatcaatcccataaaaacatggatatttcaaaggaggagaagcaatcctcacatgtacttcttttgctcctgcttctttcaaaagatggacgatccgtctgcttgtcgtgccccgaacgatcgaatcatcaaccatgatcacctttttcccttccactaccccgcgtacagcagacaatttcattcggaccccttgctctcttagctctggcgtcggctggataaatgttcgggcaatgtattgattttttactaatccaatttcataagggataccgctagcttctgcataaccacttgcggctgacaaagaagaattaggtacaccaacaaccatgtctgcttttactggcgattctttcgctaaattccgtcccatatttttccgggcagtatgcacattgatccctgcgatatttgaatccggtctggcaaaatagatatattccatcgaacaaatagaaagctgcgtgtccttcgtaaagcaatcaatctggattccttcgtcattgatgatcactatctcaccaggctggacatctcttataaaacgtgccccaataacttctaatgcacaagtttccgaggcaatcacgtatgctccgtttttcatttgtccgattgctaatggacgaaaaccattcgggtccaaagcggcaatcattgccgtttctgtcattaataaataggcaaagccacctttgacttcatttaaagcacttttcaatttatttaaaaaatctgtttcttcacttcgtcggatcaaatgcatcaatatctccgtatcggagttggaatggaagattgccccattttcctctaactcttttctaagggagcgagcattgatcaagttaccattatgcgctaagccgatcgactgatcatgaaatttgaatagaaaaggctgaatattgtccacacttccattgcctgctgttgcataacgtacatgtccgattgcagcttctcctattaactgctgcaattttctttgatctttgaatacctcagaaagtagacccagatctcgatgccccatgagtttccctcgatcattggacacgatacccgcaccttcttgtcctcgatgctgaagactatggagcccgaagtatgccacactagcggcgtctggatgaccccaaacaccgaagatcccgcattcttcatttaaactcttcacttcataagacatacgattgcatcctcccagcactttcttgctactgctgtttctattttgatttgaccgtcagttgctgatatttcgattagcgcttcatccgtcaccttacctgctaaaacagcagcatctcccatcatttcttcgaatcgtgtctggttttccggtgcaactgtcaatacaaaccttgattgagtttctgcaaacaattgagcagagggcaagccaaactgcacagataaacctaactgatatttgaaagctgattctgccagtgcaattgccaaaccaccttctgaacagtcatgggcactttcaatcaatccattttggatggctgtcaatactaactcctggtttttcttttcaacggctagatcaaagtttcgaatcaccccttcgattcttccaagctgcatcttttgtaattcactgccatcaaaatctgcaaacgtcttgcctaatatatagattagatcccctgattttttgaattcttgagtagtgatatgttcatgttcctcgatcaatccgaccataccgatcatcggtgttggatagattgcttgaccgtccgtttcattatataaagagacatttcctgaaataacaggagttcctaacgtttcacacgcagcagcaatgccgtcagctgaagtcgataattcccaaaaaacttctggtttatcaggagaaccatagttcaggcagtcggtgatcgccaagggtctaccaccgctagcaatgatatttctagctgcttctgccactgctatttgtcctccgacttttggatccaaatagagatagcgagcgttgcagtctgtggtcatcgctaatgctttattcgtccctctgactctcatcacagccgcatcgcttcctggacagaccactgtattggtttgtacttgtgaatcataagtttcgtagattgaacgtttcgaagcaatcgtcggttgttgcaacagatcaagcaatacttgtccaggttcttcaataaccggctgataagaagccaactgctgaaaatctgcgattcgagctggttctttcatctctttatgatagactggcgcatcttcagccagcgcatcgactggcagattcgctacttctttcccttgatgatatagacgatattgcccgtcgtctgttactttaccgatagtgactgcatctagatcatacttctgaaatagttcttggattttttcctcctctcctgatttgacacaaatcaacatccgttcttgtgattcggatagcatcatttcataaggcgtcattccagtttctctttgtgggacttcgtctaatgtcaatataagtcctgaaccagcttttgaagccatttccgcactagatgaaacaagtcctgctgctcccatatcctgtatacctactagagaatccgaatgatgcaagattaattccaaacacgcttcaagcagtagcttttccataaaaggatcccctacttgtacagcagaacgttgctgttcttcttcttgactaaattcttctgaggcaaaagttgcgccgtggatgccgtcgcgacctgtttttgctcctacatacatgatcgaattgccgacaccagcagcttgccctttctggatatctttgtgttcaatcaaacctacacacattgcattgactaatggatttccttcataacaaggatcaaatgcaatttcgccacctacagtcggtatgccgatacaattgccgtatccgccgatacctgcaactacttcttctagtaaatattttgttcttggattatctaattcgccgaatctcaatgaatctagcaacgcaattggacgagcacccatgctgaaaatatctctgatgattccgccaactcctgtcgcagctccttcataaggctccacggctgagggatggttgtgactttctgctttgaagacaactgctagtccatcaccgatgtcgacgatgcctgcgccttctccaggcccttgcaagacatgaggtccactagtaggaaatttgcgtagaaccggtttagaatttttataggaacaatgttcgctccacataacagaaaacagtccagtttccgtataattaggcattcttcctaagatatcttcttcgatcattcgatattcttcatcagtcaatccccattcggcatagattctttttttcttgatctcttcagctgtcggctcattcaatgttttcatctatacggtcacctttccgaagttttttaaaatggaagcaaagaatcgtttcccatcttctgatcctagcaagtcttctactgcacgttctggatgaggcatcattcctaacacattccccgctttattcgtaatccctgcaatgttttccacgctgccgttgatgttgtcattataagtaaagacgatctgattattttcctttaggtcttcaagtgtttcttcgtcacagaaataatttccttccccatgagcaactggaagagagattatttcatctgcttcatattctgaagtaaaggccgtcttaggattgactttcaatggtacagttttacaaataaaatgcaaagactcatttcgtctcagtacacctggcaacagtccagcttctgtcaatatctggaatccattacatgtaccgaatacgggtttcccttcttcagcaaaacgaatcacttcttccatgattgtagaaaaccgagcaatcgcgccgcatctcaaatagtcaccataggagaatcctcccggcagtaaaaccccatcaaatccttctaaagaggactcatcatgccgtacaaattcggcatcagcgcccatgatctcgcgaactgcccataacatatctgcgtcacaatttgaacctggaaaaacgatgaccgcaaatttcatgttatacttcctccatttttttgatttcatatcggtatgtttccatatttacatttgcaagcaacttatcacaaatcgtttcaatcactgtatcgattggttcttctgtatcagcaagttgtatctcaaagtattttccgatacggatatcttcgattgtttcatatcccatacgatggactgctttttttactgcttctccttgaggatctaatactgaatctttataggttacataaacttttacgaaatacatcatactcgctccttttcttcagttagttccgatagacggttatatacttcttgatagactggaatcagattacctaagcctctgcggtaaacgtctttgtccatatgttcattcgtatgttcatcccataatcggcaagtatccggtgttacttcgtccgcaagtaatattttttcattcgaccgaccaaactctagcttgaaatctactaaaaccagaccaaccttagcgaataattcgatcaaaattttattgatagctaatgcttgggttttcagctcactgatttcttccggttttgccagttgcaagtaatagatatgctcttcattgacaaacggatcatccaactgatcatccttatagtagaattcaacgattggcttgattaattttttgccttcaggaacacctagacgttttgagaaacttcctgctgcaatatttcggatcaccacttccagagggatgatttgtactttttttactaattgttcggttttagataattgttcaataaaatgattttttattcctcgctgggtcagatagcggaaaatcgtacttgtgatttgattattcaattctcctttcccacttatctgatctttcctcgcgccattcaacgcagtcgcctgatctaagtattctacccaaatcaagttttcatcagaggtaagatataattttttggctttcccttcgtacagaagttcttttttctccatgtccgactctcctttttatttacattcaaagcaaatacaacgatttttgttcgtgttttcactttgaattttaacaatcatctttttagaaatcaatataaatatgtacattaaaggcattagattcttttaatgttcgtgttttgttgtaagtacaaaatccccctcatcaacaagcgtttacatttatatataatgatggtatattaaaattaactaaaaatttggataactggatcgaggaggcacttgccgatggaagatgcaataaaacaaggtcagctttttttatcagagttaacggctgaagaacgttcctgtctatataatgatttgttgtcgatcaaagacgtttatttatgcaataaagatactagtttttatacctttcggaaaatccgccgagcagctaagcgttgcgctgaatgccgtaaaaggacttttcgttatcgaacagaacacaaaggcgaacttttaatcagtcagatccacgagcagaaacttttcaaaaatcactatcgtatccagatcttatttaatggacaagagatggaatatacttttctcgaaaatttgctgcaacatctccataaccagcattttagttataatagccaagccatttacgcttaattcctctattttttgtatataaagaggtagtcgctttattcctatcattgataagaaaacataataaactaaaagaagcagaaccgctaacggatctgcttcttttttggttatttttgctattctattttaattaaattttgcaactcactcttctttattccaaacctactcgtttgaatatcacgtcaacgtttttcaaatgatgatgataatcaaaggcatcgtctatttcttctttagataagaccgatgtgatggtcggatcttcttctaacagcgggcggaactgaacttggttgtcccaagcatacgcagtttttggctgaacaagatcataagcttcttctcttgtcattcccttatcgatcaatttcagcataacgcgttggctataaatcaaaccaaatgttgcagacatattccgcttcatgttttcaggaaagaccgttagatttttaacgatattgccaaaacgatttaacatgtaattcaataaaatcgtggtatcaggcaagatgattcgctctgctgaagaatgagaaatatctctttcatgccataatgtgacattttcataggcagtgaccatgtgtccgcgcaccactctggctagaccagccatattttctgaaccgattggattccttttgtgtggcatagcagaagaacctttttgacctttcgcaaaaaactcttctacttcacgtgtttcagacttttgcaatccgcgtatctctgttgcaaagcgttcaatacttgtagcaataagcgccatcgctgagaaatattcagcatgtagatcccgagggagaacttgagtagagatttcttgcggacggattcccaattgtttacatacatactcttcaataaatggcgggatatttgcgaacgtccccactgctcctgagatttttcctgcttctactccttttgccgcatgttcgaatcgttcgatgttccgtttcatttctgaataccatgtggcaagtttcaatccaaaagtagttggttcagcatggacaccgtgtgttcgacccatcatcactgtatatttgtgttcttttgctttttcgccaatgatttctttaaaacgtttcaggtcttcccgtaatatatcatttgcttgcttgatgagatagccataagcagtatctacgacatccgtacttgttagaccataatggacccattttctttcttctcccaatgtttcagaaactgctcgtgtaaaagcaacgacatcatggcgtgttgatttttcgatttccaagatccgatcgatatcaaatgatgcatgttcacggatttttttcacatcttcttgtgggatttcaccaagttctgcccaagcttcatctgctaaaatctcgacttcgagccacgcacggtatttgttctcttccgtccagatattccccatttcagggcgtgtataacgttctaacatgttttttctcctctaatcccaaatattcgtttgtttgatttcttccagcgtttgctggatgtcttctgtcaagatagtgatatgtcccatcttgcgaccttttttcgcttgtttttttccatagaaatggaattgccagtctggcttattctcaatcaagcgatagctttccaacagttgttctcccaaaacattgaccatcactgcattgcttgtcagacgcactttttctcctaatggccagccgcaaatacctcgaatatgggcatcgaactgactcatagaacaagcttcgatagaataatgcccagaattgtgaggacgaggggctaattcattcacatataacccgcctgtttttgttaagaacatttctacccctagagcacctgaaagacttactgcttctgcaatcacacgggcaatacgctcagcctcctcgatcacatcctgatcaatcgcagctggagcaatcgtttcgtgcagaatgttgtttcgatggatattttccacgaccggaaaagttgtgaaatctccttgtccatttcctgctaccatgatcgaaatctctttttcaaatgggatccaagcttctaaaacacaggttccttctcttaaaagatccattgcaggggccaagtctgcacgacttttcaaaacatactgccccttgccatcataaccgcctcgagtggttttcaaaacgcagggataaccgatcccgtcaatcgcatcttggatatctgtcggactgacgatcgttgcataaggagcaatcacgatgttgttcgtttccaaaaaagatttttccaataggcggtcttgcgtaatcgcaagcaagtctgtcccttgaggaataaatgacatgggtaagatcgcatttagcgcctctacactgacattttcaaattcataggtaatgacatctgttcttctagcaagctctttcagcgcaaaggtgtcatcatagacactttcaatgtgccaatctgcaacttgtgcggctggacaatcacttacaggatccagcacacctactttaaagcccatttcttttgcactaatcgccatcatacgacctaattgaccgccgccgacgatcccgatcgttgaaccaggcaacaaaggtttaaccaagttgatcactactttctataacagttttagccaacattgaacgtctttcagccaatttagcctccaattctaaatcatacatggaaagcatctgtatcgcaagtagtccagcattaattgctccagcttttccgattgccgtagtagccacaggcacgcctccaggcatttgaacaatcgacagaagcgaatctaaaccatttaatgttcgtgattggaccggtacgccgataaccggcaaagttgtttttgccgcaaccatccccggtagatgggcggctccacctgctcctgcaataatgattttgattcctttttctcgagcgccttgtgcatattcaaacatcaaatctggtgtgcgatgagcagaaacgacttttttttcataagacacaccgaattcttccaatatttgacatgcttctttcattgtttcccaatctgaagtactccccatgatcacagagatttttgctgtcattgtttttcctcccagtttttctacatccatattttaacaatcgtattttttgatgtcaaagaaatttcgaatattgataaagaaaaccattttattgttcgtgtttatccaatacataaaaaaggacgtgacaaaagtgatgtcacatcctttttcctacgattagtcaagtaaaaggtgcaagaaaaatagctcgtaacgaaagcgacaaaatcaaggcacaccaaataaagccttattaatcgaacggtttacttttatacaaagaaagccaaaagaggtgcgacactagttgtgtcacacctctttttttatttacctaatctaatgaaacgttccaagttttgataagtatttttcttaacttcttcaactgatagctctttgatttcagcgattgtctttaactgttcttcaagcagtgagacataatctttttctgaaaaattatcccctaacgcccactctgctgcatgtagtccatccgtttcaataagtaagtggtcgattgggactgttttagctagttgccagactgctgggttctttttcaaatcaagaccaatgctgaaataacagcctaaatcaatatagtcttgttgatagtccaaagaagaataccaatgaatcaaatagtgattagggtaagcttggatatagcttaagatctctttttcgcatccttttgtatgcagtacaacaggtttcttatttatggctgcaaaagcaagctgttgctcaaacacccttttttgtgtagacagtggcacattcgtccagatattgtctaaccctatttcaccgatgatccttgctttcttcaaaaaaagctcaacatgtgcaaacgtatagctatccgctttccaagggtggataccgtaacttaagacttgattcttgcttgttgcaagccgtctgtttttctcccattcttctggcgaatcacaattaatgatcgtcaaaatcgtgtgttcctgctgaaggagtgctaaactctgactcccatctaaatgacaatgagcatcacttaacatctcattcacctgccaataactgataaatcgtttgcttcaactctgattgctgcagtagccattcacgtgaccgtcgtttttcaggcacttgaatctcagcaatcacatgtgccggacgggcggaaagcacaaggatcctgtctgataaataaattgcttcttcaatatcatgtgtcacgagcaaagtagttcgctttgcttttttaggcagtttcagcatccagtcttgcatctgccctctggtcatagcatctaacgctccaaatggttcatcaagaagcaagtaagaagaaggattcatgattgttcgtaacaaggccgttcgctgcttcatcccgccagataattgttccggcaaaaaatgttcatagccgtttaacccaaagatatccagataatcccttatttgttcttcattgattgctagatgattgattttttgatataacgtaacgttttgatagacgctcagccaaggaagtaacatatcttcttgcggcatataactaaatgctgtatggagaccagttactttttgatcgtctactttgatcgttccagaagtcataggctggactcctgttaaagttttcagcaatgttgacttaccggctccgcttggcgcgacaatcgatgtaaaagtatctttagggatagtgaaatggatgtcttctaatattttcaggttttcaatgactacattcaagtggctgatttggattgacacatctatcactcctattttataaactgattagtgaatagttctttcgaaggtacatcttgcttgatcaatccgttttcctgcataaaagctgtataattgcgccaaactttttcttccatcaatccccaattctcaggatcatccgtataattttttgacaagaatgcttgtgattcttctaaaaacgtccattcgtttccttttgcatatttttgcaacagtttagcactgtcgtttggatctttaatagcttcctgatagccttttttcgtggcatccataaaagactgtaccaatcctggatcatttttgatcagttgatcattcgtaataattaccggagtatagtaatctaaccgttcatctaattctttcaatgggatatagtttagttcaatacccgcttcttttgctttgatcatatcccaaccttcaaagtaccattggatatctgaggattttcctaagctttctggcccttctccattgcttcctaccattgtcagttttgaaaagtcaccgccgtctttttccatcacagcttttaagacagcttcttcacttggactttgccaacctgcatatgtttttccttcaaaatcttttggtgaatggatgttactgtctgatagggtggcgaatccagaagtattatgtttgatcactgtagcaattgctttgactggtatattctttccatctgcgtgcgcataagtgacatcttcttgataacttataccaaattgtgctttgtccgcacctactagaccaatacttgtcgaattatctcctggttcgacgatttggacatctaaaccagcctctttataatagcctttttcttttgctacgtagatgccagtatgattagtatttggtacataatccaaaacaagtgtcacttttttcaaatccttcgtttcttgtttgctacttgtttcttttgcagtgccacaagcggataaaagcaacagtagcggtaataaaagccataattttttcatttgatccccttctcttaaaaagtataaagcatacggtaatacccttttttcaataatgaacaagcgccattcagcaataaactcaataaaatgacacaaatgatcgcagcaaaaactttatcaatctggtagctgttttttacgcgtatcatataataccctaagcctgcttgagcgcttagccattctccaacgactgctccactgacacaataagtagcggctacttttaaaccggaaaagaatccggataaacccgctggtattttatatattcgataaatcttccctgtatctgcccccatcgttttcaaaaagatgatttgctccttcgatactttcctcaatgtatccgaaaaagaaactacgatcggaaaatagcttatcaagacaacaagaatcacttttggaagcataccgaaaccaaaccatagggtcaataatggccctaaaaccatgattggcaacatttgagaaatcactagtaatggataaaaagacatttctaagaacttccaataatccattgccaaagcagtaataaaagaaagaacgctagctattgccaaaccaatcactgcttcatttaatgttgtgacagaatgggaaagcaatacttgtgcatctgctgttaacgcagaaaatacagcagcaggtccgggtaaaataaaagcgggtattttccaaactaagacaacaatctgccaaataattaaaatgaatgccatactgactgctggataaagatttttcttcattttgacgcctcctttcttctaatatggataacaaaaaacgcttgaaatgggcacgacatagtaacccgcttcaagcgtctgctatgtttctcccttcaccagtattaactgacaggttcaatgggtctaagttcacaacttactctcatgtcgtctacgacatccccagaaacaggtattcattttttaaagtgtagcacaagaaggaaaaagcaacaagcgctttagttatcatgctgattatttcaataaataggagagatcacttgccaatgtcggataccccatgatatagctatccaactcttttttagtcaatttttgattgatgactagtgtcaaatcatcaatcaattcgtctgcttgctcgctaatcactgcagcaccaatcaaataattttgctggtcgaaagttaattcagccttagcaactggttcattgacgcgatgataggtgaaccaattggtaagatccatctctaccacttgatctgacgaagaggcgtgactttttgtaatccctacttcagcaagcttaggactagcgtagacgatcgtgggtataattggatatttgatagggccgcctattgcatccgttatccgcttagctacataattcccttcaaaagtggcgactggtgtcaatttgggtgttttccttgaaacaatgtctccacacgcaaaaatttttggattgctcgtttgcagataatcattgacctcaatcccgtgtttatcaaagacgacattcgcttgttcaagtgctaaagattctgtattcggctgtctcccagtcgcacaaaaaatcatatctgctactaattccgtatcttttccgactaaacgatatcgagttccttccgagatgatcttttgggtttcaacatcaaaagcaaactgaataccagatgcttccatttgatggacggcttcctctaccaaagacgcctcaaattcttttaatggtcgttgattatgatggacaatggttactttactccctgcagcattggcaatcgtagccagttcaaaagcaatatatccgccgccaataaaaataatttctttaggcagtacaggcaatgataaaaaatctgcactagtcttcaagtattcctttccttccaccggtaagatcgtgggtctttgtcctgttgccagaacaaagtaatctccatgaaaaacttcttcattgacttcaatagatgagttgtctaagaaacgagcggtccctgaaagatgatcgattccagcttctgccaattgtttttttcgattttctggaactggatctgtgaatgtgcgtttgaatttttggagttcttcccaattagcggttgggatctcgttaaatccttttccattcaattgttttatccgattacgggcttctactgcactcaacaagacttttttaggatcacatccacggttaggacaagtcccgccccatagatcttcttcgaccactagtactgttttacctgcttctttcaatccataagcagcacttaagccgctcacacctgaaccgatgacgattgcctcatatgttttcattttcttcctcctctcgacttaaaaaagtaaagacttctttacttgtcagtgaaccaatattttttcctttttctactatcacaatgtttgggtacactgaaagaagtgaatacacttctttcagaggcgtatcaaggcaaacttgttgatgactgttttttggtacttcttttaaaaaatatccattgacgactaaatcttcgactcgccattctttcgtctgtttcggttcatcaaagaaatgccgtacatattcatttttaggattcatcaataactgttctggtgtgtcgcattggataatttctccatctttcataaacgcaatacgatctcctagcttgattgcttcttccatattatgcgtaacgaaaacgatggtcgttcctagttcttcatgtaaagataaaactaattcttgtaatgaatttcttgaaataggatctaatgcgctaaatggctcgtccatcaaaatcacatctgggcttgcagcaatggctcggatgatcccgattcgttgctgttctcctccagacaactctctaggcatacgatctcgataaatatcaggagataagccaactttttgaagaagttcatctacacgatctgctcttttctgcttttcccaacctaacatttcaggtatgacttcaatgttttgcttgactgtcatggtcgggaacaaagcgatttgctgcagcacataccccatattccaccgcattttctgcagattatattcatttaacgattttcctttgaagtagatgtctcctgctgatggtttagataatccattgatcattttcaaagtagttgtttttccactaccagaaggcccaaccaaaacaaagatttctccttctttgattgcaagagttaggtcatcaatgacatattttccatcgtactttttttgcacatgtttgaattcgattaatttagtcactgatctccctcctttagtaatccttcgttttccaggaaggttcgtgctacttctgccggttttttcttttcgacattgacttgatagttcatatcgatcatttgattttctgttatttttccgcttaatttattcagcgcttcaacgatttcaggatggtccttggcgaaatctgttttcatcagtggcgcgccttgataagctgggaatagcccttgatcatcttctagagtgactagatcatactccttgagttggctatctgtggaataagcatccacaatattgacatctccattattgattgcttggtaacgcaaacttggttccatgctttgtacacttgaaaaattcaatccatatgcttcttgaattcctttatatccatcggaacgatcaataaattccagtgtgaatcccgctttgatctgattagaaactgctgctaaatcggaaatctttttaagttgatgctcgtctgcaaaagatttcttgaccgccaaggcatacgtattttgataagccattggtttcaataatgtcatatcgaattgtttgttcaataattcttctgcttcgtcatatgttttttcttttgtcaaatcagcacttttcattgcttcaggtaccttcaccaagctctctaggacagtccctgtgaattcaggatagatatcgatttgcccttgatccaaggcattgaacaaaaaactagtcttgccaaaattcggttttaattcaacttctgtttttgtgttgtcttcaatcaattctttgtacatttggatcaggatttcaggttccgctcctaattttccagcaatcgtgatggtttcatttttaaacaaggcagactgatataaagaaacgcccccaactaaacacaccacggctgctaaagtaatgatagaatatcgaggtttcttatgctgcaaccagcgaatcaatccgctgaatataatggcaagcaaggcagaactgattgcaccaatcaatgttaaaactggtgtgttgcggtcgatacctaataaaataaatgttcctaatccacctgctccgatcaatgccgccaaagtagccgtaccgatgatcaaaactaaggcagttcggatacctgagataatgacaggcaatgcgatgggaagttctactttcagcaagcgtctcatcctggacataccaaatgctaccgccgcttcttcaatagacgggtcaatctcagctagaccaatgtacgtattttggaaaatcggaagcaaagcgtaaataacaagtgcaatcaatgctggaacagttccgatccctacaaatgggataagtaaccctaataaggcaagtgaaggaatcgtttgaagcacacccgtgatctgcaataagacttctgccatttttttatgattagctgcccaaattgctagaggaatagcaatcagtgctgcaatcagcaaagaaatgagagaaatagacagatgttgaaatgcagcttccagcaactcgccttttctttcacttaatgtttgtataaaattattcatgcgaccttcctttctgttattctttaagtataaacatttctttacattttcccaactaacttgacttaccttaaccctactaggcgtcagtaattaataaaaatatcacctctaaatatgcggataaaaaaagaatccgagcaacaaaatcggatagatttattggttctcgtttcttcacaacgaacatccaatacatctatacgaaatgatcactcggaatcaaccgtatcgtttttcatatacaacttttcttttaattaaaaagaaacagccaataaagtagaaatctcgtgggggagaacacctttattgacctgttcaacaagtattatactgtatcatgacacttttttgccaaaaatgtaaaaaacggttgttttggcatcataaacgtcttgttttcttatttttacttatatcaccactttattttctatctctttcactccataaagcggaatgagttcttcttttgactgataataaacagctttttcacggttcttcatcaaaaatagaaagatttctttcatagcaagtggtgctttgccttgttcaaacacaaagatgaattgatacgattcatttatctggattcttgtcacaggaatcagtttttggtcttgagccaaaaaaacaccttgataatctgtttttttgggtgattttgtaagaattgtcaataagtctgctgctcgcatttttccactcctttttgataatttggaagaaacaaccaaaaataaatttttttcattttcctcttgaagaaagagtataagtcagtataatgaagaggttgctgaaaattttcaaaagaaaagaggctagaaatgaaaaaattaaatttaatgacagaattgtgcggaatcattttaggcgctgggatctatggattggctgtgacaggcatcaatattccatctaaactggcagacggtggtgttactggtattgctttactcttgcataatctttttggattcgcgccttctatcacttcgctgctttttaatttacctttactgcttatctcattgtttctttttggaaaacacgcttttcttcggacgatcgtcggaacatttgcgctggttttctttttacatttatgggaaagccttcatatacattttgctgtagatagtctactgatcaatagtttgatgacagggattctttctggcattggttgcggtctcgtctttcgatttggcggaagcacaggcggaacagatatcatttatcaagccattgaaaaatattttcatattaagattggcaaaagtcttttcttgatcacttttggtattttagttgtctccttgctttatttggatctcacacattttctgtatacattgcttagctgttctattctatcttatacattgaataaagtgaagtatctggaaatgggacctgttttgccccatttggaagcaaaacagactacagaaacatttgaaccacttgatcctcttgaacagttagagcactaattcttatttttactattttagttactttactaaaaaatcattatgtaaactacaacgtatattttttcaataaaattttctataaaaatatgaaaacaaactatttttgcagacactctgttaaaatagtttgttttttactcttcaccctttctcctcttgctcacggcagaaaacatcagctaagaaaaaaataggttacgatataatctttcgagtagagtataaaaaaagaaacgccgcagcgtttccttctccactataacataatacaaggttgtatttgtcttatttaaaatagctattctctcctaaagaatttccctgatcgtcaatcagcccttgcagtgaacgttctaagataccgtggttttttttcgattttttttcttctgactgctttgtttcccctaatgtttttgttcgattgaacgtgcgtacagacggctcatcatttcttttttcttgataaggcgttggttctgtatcaaacaacagataagagtcatctgtttttttcattgattcgatcaaatgctcttcagaaattttactttctctagggtctggaataatggatgcaggtacatatttaggaacaaaataagaacgttcccgtacctttgtgtccacagatgaatttctcatagtatttcgagactctgtcctcgtttcactttgcctgacaggacgagaagactcaccaaaaagttttttccgtccagtcgacgtgagttctgattgatgatgtccagtataatccggtaatttttctttatgtttttccaaattttccttgcgcggagctgacttcaatccatttgttgcgcggcgcttgcgtcggacctgttcagtgtttgtgttcgtgaaatggaattcgttcatttgttcaaacgggtgctgattctgttcagtcaaaagatcttcctgtccgtcaaataatacccgcttcttctcgctggttaattttacgcctaactcgtcatcgtacgcaggaaaacggaaatgttttcgtctgatttctttcattcaaaccatccttctcaaaaatggaacttttctcaataatagcacagattttttgttttcagtagcaatgcgctgattattttaagaaaatagcgatgaatttcataaatatataaaaagtaacgaggcttaatttgtcgtttctctgataactagttcagggaaaaagcgacgataaccttgacttgcccctttctcttctatttttttcagcaacatttccccgcatacttcccccatacggataatatcttgcttgatcgttgtcaatttaggcgaactgatttggtctaaaaacacgccatcaaagccgattacaccaaattcttccggcaagcgcccaccagcatttacaattcctcttaccgctcctagtgccagtcgatctgagctgcatacaaaacaagttttatcggtgaaacctgcccagttttctatcatatatctttctacttctgtcgaatgatttggaaatcgcaagatcttacttggaagatcagcttccttcatcacagataagtaaccagcttcccttgaaagctcaaacgattcgtccacttcaatcccgatataaataattgtttggtaatctctttctaaggcatattgcgttgcttttgctgtaccatattcattatcgctgtctacatagtcatatccttcacaattttctccaaacaaaacaactggtttttccaagcggtcaatccaatcgaagtctttttttctgacacctgtgatgatgtatccatcacaagaaccgacatcgaatgcgtcatttgtaactagttggagagaataatgcgcttttccgatccgtttagcgatccccatcagcaaattcatgtagtagggctcggttgtgtcgatttcttccagtataaataatttgatgatctgtgaccgattcgtgacaagtgcttttgcagcaatatttgggcggtaatccaattcagccattgctgagaaaactagctctttcaattcatccgtcacctgttccggatgattgatgactcgagaaaccgtcatttttgaaacattggcacgttttgcaacatctgctaaagtgggcatgctctcttcctttctaacatgttgtcgttcttattaccaattataccaaattttcctaacagggttcattatagcccaaaagaaaaatcagaaaatctcctatcctccttaagtgatttcccaattcagctatttctatttttttatcaaattctttgctaaaaaagcggaagcttcctccatcagtggtatttgtaccatgtgtcgctgtgttttggaggaacgaaaaacaatttcttttccgtaaggctcaggccggtttttctctacaaatctttccgtttgtatataagggatcttttcatctgcttgtccatgccaaaagaacagagggcgtccatctagcttttccggttgcaatgataaatcataactcttgacccacgagatcaaatcaaaatagtcttttggcaagatatagttgtattctgacgctcgtcttgcgatttctttcccatattccagaagcgcaggagatcccatcaaacatacacctgctgctatatgaggatgcttagctaacaacgcgcatgttgtcattccgcccatcgaaaccccaccaactgcaagccgatcatgtaaaagatctcttttttctaaatgcttgataagcgtgtcaaactcaaacaagttcccgtagatactatcccaaaatgtataggatggaatagaagaaactggctgttttcgttccccatgtttcatcgcatctggcaggatcacgcgaataccttgctgtgcaattttccttccttgtgtcaaaactaactccttacttgtctgccatccgtgataatagatgacaacgggaatccgttcttctcttaattctttcaggacaacttctaacactggaatttgattgacagaacgtttcaatataattggattcaatggctactcacctattttcattaaatttcctgatcgccatagcaaccatgatccgacagtcgtctggaacaggttcagtataccaaataatataaatgcaggactgaatggctcaggaaataagaatagggaacaaagccccaccactcctaatgctagcgaaagtagaggataaatagagaaattcaaaaaactggcaacgctaccgaaaatattaccaataaatagtatcaaaaagaaaaaaacgcttagaatcaaaccatctgtcagcgacatctgaaaaacaatgttctctacatcaattggctgttgaatcgcatagacacctaagtatatactgagaaggagactgagcacgtgactggcacaaaatactcgattgaccgttttcattttaatcacctaacctatctttataattctattataatcattttatcattttttggtaccaataaagtttcaatttttcttcacttgcgattttttttgatattgttgttatacaaatgaaaggagttttacaaatgattgatcctaaaatgttagggatgatcttcctcatcaattttgcttatatcactttgaacacgttacgttttatgctaacaatgaaaggctaccggctgattgctccccttgtcagtatggttgagatcacgatctatatcgtagggctatctcttgtattggatcgtttagataatccgctgaatttatttgtctatgcgttaggttacgcagtaggtatcagtgttgggattttgattgaagacaagctggcattaggatacatcatggtcacaacgattttgccagcaaatagcgcggaagataaaagtttgcctggtatactgagagaacacggttacggtgtaacacagacttctgcaatgggtctagaaggcgagcgactggtcctggaaatactttctcctagaaaaagcgaacgtgaactgtatcgcctgatcaaagaaattgaagagcgtgctttcatcatctcatatgaaccaaaatatatttcaggtggtttttggactaaaaaagtaagaaaaagacaaggaaaataactcacaaactaaaaagctgtcgaacatataaattaaattttagatgttcgacagctttttatttattattttgattaaaaaacatcgacatatactcattgatttgttattatactttatatacttatcaatttaatttggagatattatggaaattcaacgtaaaacaactaattttttacatttaggctctttttttgcaactttgacgattttattttttctatgttattcgtacgttaagacctcacaggcgccttctagtgcattaggctggttgcttttagatcattctgatattacagaaacagaagaaaatccgttttttttaattttatcttctctatgcgccttgatgttttctgtgtatttcagtgcctatttttttcatcgacatcctggtaagttaaatgaagcttcaggtgtattgattgcatttaaaacgttttcttttttagctatccttttttattcgtttaatcacaatacgcttttcttctttatcatgaatggtttagtcgtgattttatctattttcacttattttattttttcactcatttttagccaaatgagatgtccgctcttctttcgattagttcctgtcacatgttttatctacagcttgttttccttttttgtccttgctttgataccattggccaacccttcgacgatccaagtcgcaggaaatctgttggatatgctcttcatcgtcagtctaggtgtatttatgtggcaaagaaaaaagaaacaaaataaaaagcattttgaagcctgactacgacgacttcataaatgcttttttaattttaaacacttcaatctaaaagaataacccaagattggatagatgattaataatgacttaccattcgtttctgagtgattctggatcaccaaatgaacttcctaatctaatcgctagttcttcccttagaatgccatacttgactgaatcataatattaattatttaaaaatctaacttttcttatgagcccttcctttgtcattccacatttctcaccaattttttgcattcctttatttccataccatgtagtgaatccaatatgtggtagataggcaaaatactccaataattcttttaactataaaagaagagaaagactcctcttgcaagaatcagcataattttagcttactgctctcttagattcttctcaccaaagctgttctatattgttctatattgctccatattctttgatataagaaaatgcatgcggcataaattttttgctcaactcagaaaagatttgtcgtttaagaaaggccgtttcctccattgtcaatgaaggatccaatgttggaaattcaatctcaggattgtttttttcgacaataggcaatgctagtgtaaatgattcttcttcctttatggtatccgtcacaagtaatgactgatggaaaatactaggccgacgatttttatatttatttttacgtatcctgtcaacgataacttctatttgatcaaaaaagtacgcttcatttacatctccaataagttcggctaattctttgaatgccttcgttacaggaagctgattcttttgtataaaaaaataattagccaacgtaagcgggaagtgttctttagaggaaagtgtaataaaacggtacttctgatttcctgcagtcgttctcagcaattctgtctctcggctgtttcttactccataaaaatatgcttcttttcgttcatcttcaaaacaatacgcccaaataacttctcccatcgctaatttttgttcagcaacagagagtctcttcaattggtcggctatggtttcagcagccgaagtgacttgttgcaagtaatcgttgggatcaaatactggaaagttcaaatgatatcttcgctcttctctcttgattaatcctgcatcgatcaacagatcaagaaaatgagaaaatttgttttgcgggaattcttttttcaattctcttagaatcgtttctttttctcgatgttcatatagataatcggtcaataaagaaaaaagcggatcaccggtcagtttttgataaaaattttccttattttttgaataataatagttcatatatgttctcttttctatccattttattttacttaaaagacttttacataaaaaggaggaagaacaagagtcatgtttgactgttattctcctccacttcttagacttttagtatgttctgtgtttctttttattcaatcgcttatcccattcactttgaatgcttcatcctaccatttgattagctgaatacagccgtcaactgaggtacgacttgttttttacgtgaaacgacacctttaagtaaagctcggttattggtcaaagttgtttggaaagcttcttctactttttctttacctttaccagcaacaagtaattctgaatcgctgtctaagatatttgtgacaactaatacgaataaatcgtagccatttgctttcatttcttcttccatcgctgcttctagttctgcttgtcgatccatcacttcattcagatccactgtattgacttgagcgatacgcacattggaactgcccattgggaaactttttgcatccaaatcaagaagaaccgcagctgatttatcacttagattcgttccggctttcaacatttcaagaccataggcagttagatctacttcagcgattgctgcaagttcctttgcagctgcttcgtcttcaggtgtacatgttggcgatttgaacaacaatgtatctgaaatgatagctgaaagcataatcccagcaatttctttagggatcgttacttggttttctttatatagttttaaaatgatcgtacttgtacatccaactggttctgcacgatagtacaatggattagctgtttcaaagtttgcaatacgatggtggtctactacagccaaaatatttacttcgctgatatctgaaatactttgttggaattcattatgatccacaagcatgacatctgcattttctgctttagctgactctactactcgtggtgcagataattgaaagtggtctaatgcgtattgtgtttcttcattaggtgtacctagagcaactgcttctgtttcgttacctaattcattttgcaagtgtgaaaaggcaatggctgccccaattgcatctgtatctggattttggtgaccaaaaactataatttttgacatgtcattcgctcctttgtgatttctcctatttaataatagcaaaaaaacggaaagaagcaatacttaacttctttccgatgcgttctatcgcgttaaatattttgtatactcttctgtatgaagcaatcgtttagcattttcgacacgttcttttgtaggtggttcgattccttctaatggatatttcaaaccaagtgtttcccacttgtattttcccatcgtatgataaggaaggatctctactctatctacatttgacaaggtttggataaagttgtctagtcggatcaaatattcatcataatcacttcgctcaggaactaatacatggcgaatccaaaccggtttgttaatttttgacaaatattgagccatttctagaatattttcattgtcccaatgcgttagttttttatgctcttcattatcgatgtgtttgatatcaaataacagtaagtctgtatacttcatcaattcttgaaaacgagagaagaaggggtcttcatacgtaaaaggttttccgcatgtatccaatgtagtatgcattttccgctcttttgcttttttaaatagttcgatcaaaaaatcgatctgcaatagaggctctccaccactaacagtaataccacctttatctccccagtaaggtctgaagcgttccgccttatctaaaagttcatctgctgagtactctttccctccgccaatattccaagtatcaggattgtgacagaattggcaacgcatgcggcatccttgcataaacacgacaaagcgcagtccaggaccgtctactgaaccgaaagtttcgatagaatgaacatagccgattgttttttcttccatttaaattcacatcttttctttgatttcattttaagtacaagttagctgtcgaagcgaagctttttgaacaaaatttttcgcaatcaccgcttcgttatgtgtaaaatttacagggacggaacatacatgtcctgcccctgtaaatcgtgtctttcaaataagcatactgatcattcgattatgatgcgaaggatatctaacgatctttcggcactgagtcgaaaggctgtttcacaaacttttttacattctgtcgtgtgaagttctcatcaagacatctagttgttgttctcttgtcaagtcacggaatttaactgcataaccagatacccggatcgtcaagttcggatatttcattggattttccattgcatcacgcaatagatcattactgaatacattgacattcaaatgataagccccttttgagaagtatccgtctaagacattacgcaagttttcgattcttgtatcttgttcttttccaagaccagaaggattgattgtttgggtatttgaaattccatccaatgcacaaccgtaattcattttagctgttgagttcaggctggctaataacccactttgttctgcattgtaacttgggtttgctcctggcgcaagtggttttccagcttcacggccatcaggagtatttcctgtatttttaccgtaaacaacatttgaagtaatcgtcaataatgaagttgttggttttgagttgcggtaagttttatgacgtttgatttgtcccatgaagtattccaagatccatgaaactaattcatctgcacggtcatcatcatttccatatttagggaaatcgccatctacttcaaaatcaactgctattcctttttcattacggattgcttttacttttgcatatttgatggctgacaagctgtctgccgcatgagagattccagcaatacctgtagcaaatgtgcgttgcaagtcagaatccatcaaggcaagctgagctgcttcataagaatacttatcatgcatgtaatgaatgatgttcaacgtattgacatatagttctgctaaccaatccatcatattcatgaagttatgtttcacttcttcaaaatctagtacttctgatgtgatcggacgatattctggtccaacttgggcgccagtcacttcatcgaccccgccattgatagcatataatagtgttttagccaagttagcacgagcaccaaagaactgcatgtcttttccaacaactgttcctgatacacagcaagcaatcgcacaatcatcagaaccccattgttcacgaagctgattgtcattttcaaactgaatcgaagaactttcaatagcgattcggctcgcatatgttctgaatccttctggaaggtgttcagagtacaaaacagtcaagtttggttctggtgaaggtcccatatttgtcaatgtgtgaagcagacggaaatcattcttcgtcactaacgaacgaccatctaagcccataccagcaatggataaagtagcccagatagggaatcctgagaataattggttgtattcaggtgtacgcgcgaatttgaccatacgtaatttcattactaagtgatcgatcaattcttgcgcttctttttctgtgattactccattatccaaatcacgttggatatagatatcaaggaatgctgagatacgtccgattgacatcgcagcgccattttgtgatttgattgctgctaaataaccgaagtataaccattggacagcttcttttgcatttgcagctggtttagagatatcatagccgtattttgcagccatttctttcatttgtgctaatgcacgatattgttcagtgatttcttcacgtaaacgaatcacttcttcactcatcgtatgataaccagtcatatcatgatcttttttcttttgttccatcaaatagtcgattccatacaatgccacacgacgatagtcgccgatgatacgtccacgaccataagcgtctggaagccctgtaatgattttgtttttacgagctgcacgcatttcagcagtataagcatcaaacaccccttgattatgtgttttgcgccagtcagtgaaaatatgtgttaattcatcgtttggtgtatagccattgcttttcagcgcattgttagccatattgattccaccgaacggcatgaatgcttgtttcaaaggtttgtctgtctgtagaccgacgattttttccaaatctttatccaaatagcctgcatcgtgggaagtaatggttgatacgatttctgtgtccatatcatagacaccgttacgttcgaattggatatcattcagcttttgcaattcatcccataatttttctgttgcttctgttggaccttccaaaaagctgtcatcaccgcgatattcagtgtagttgttttgaataaagtctctagtgtctacgccttctttccatttggtacctttaaatccattccattgctccattgtatggacctcctaaatttctgttttatgtaacagtttttacgtgattagtataacacagcaccttatctttgcaagggttttcttgttttttatttaacaatttttatgttttatctatgtatattgcaagtaacgttgatttaccaatatttaagcattgtgaacactttcatcttttttttgcaaacgtataaggatttattaaaaatgaatgaaaaagagggaccatctgtattaatacagatggttcctcttcactaaaataccataacagttatgtttcaatgaaaatctcaggagcatcgataacttcgatgacttctccaccttttttctcgtccatagcaaacgaaccattcgatgttcgatcacctataggaaaatccgttggatcaatcgttatctgttgtcctttttgattcatcaaggttatttcttttgatcttccttccgacatatagataatacggtgcggattttttttcagctcacgcatgaccgtcactccccgcttcgcacgtgaagtttggctgatttcttgagcaagcatgcgtttcacggctcctcgctgagtaacgattacgattggcgtatctccgtctgctaacacaagcagcccattgacaatcctatctccatctttcaaattcatagacttcactccagctgcctttgctccaacaacgggaacatctgttaaaggatagcgcaagcccattccttgatgcgttactaagaacacatctaagcctggctgatcttctttcagatatacagcaataagttcatcttcttccgcctttagcttcatacagctgagcggacggctcttataggtgcgccatggttcgaactctgtcattcgtgtttgcttgatcaatccattcttgctgatgaatacaaatgttttttctgcttggattttttgatatgggaaaacagctaagatcgattcatctacagacagattggagattgtttgagaaatgtgttcgccagcatctttccatttcaaatcgggtagttcatgaacaggacggtagatcacatttgctttattcgtaatcagaagaacatggtccaatgtgctcaattcacctgagtacagcaagtaatcgccttctcgcatcccgatttcttctggtttcgaagcactataagaacgaaggcttgttcgcttcacatagccttctcgcgtcacactgacgattacgtcttcttgcgccactaaaacttgcgtatcgattttgatttcttcgatttcgtcttggattgtcgtcagacgagcggaagagtaattttttttcacttctcgcaattcttttttcataacagagaaaagctctttgtcgtttgaaaggattttattcaactctgtgatttgtgcaatcaagctttcggcttccttttgaagctctgtgatatctgtgttcgtcaaacggtatagttgcaatgtgacgattgcttctgcttgttcttctgtaaattggaaaacatcgactaaattctttttagcatcttttttgtctttactttcacgaatcgttgcgattacttcatccagaatcgataaagctttcatcaggccttccacgatatgctgtcttttttgagctttggctaaatcgaattggctgcgttttgttatgacttgctttcgatgctcgatataacttcttaaaatgtctttcagtccaacttggtgcggagtcatatgatcgatagcgaccatattaaaattgtaattgatctgtagctcagtgtttttgaacaaataattcaaaattccttgagcattggcatcttttttcaattcaacgacaatttgcagaccagttcgatcactttcatctcgtacttcagctattccatcgattttcttattcaaacggatctcatccatttttttcaccaacgtcgctttatttacttcatatgggatttcagtgatcacgatttgctgtttattgcccttcattgcttctatctttgttttcgaacgaagaataacttttcctcgccctgtttcataagcttttttgatttcatctttcccttgcaagatccctcctgttggaaagtcaggtccaggaatatattccatcaatttttcaaggctcgcttgtggatgatcgatcatatagattgtgccgtcgatcacttcagctaagttatgagtcgggatttctgtcgcatatccagcagatatacctgtcgatccattgactagaaggtttgggtatcgagctggaaggactgttggttctttttctgtatcatcaaaattccacacgagatcgactgtttctttttcgatatctgctagcatctctccacttaacttggataatctggcttcagtataacgcatcgcagcaggtggatcaccgtccatactcccattattcccgtgcatttcgatcagtacttcccgcaacttccaatcttggctcatgcggaccatcgcttcataaatactgctgtcaccatgaggatgataattccccatgatatttccgacagattttgctgatttacggaatcctttgtcatacgtattgccatctttgttcatggcaaataatatccggcgttgcactggtttcaatccatcacggatatcaggcagtgcacgttcttggataatatatttggaataacgtccgaagcggtcacccatcacttcttctaaagttaattcttgtacttcttgtcgattttccatcaggtgacctcctattctacttcaaataactgattgtcttcttttttatctgctcgttcttcatctaataattcattagaaactgaaggagagatttcagtatcctcttttttatctaagatactgccatcttcttccaacgtaaattgtacgtgattttcgatccattttcttcgaggttctactttgtcacccattagtgtggttactcgacgctcagcttgcgcagcatcgtcgatacggacgcgaatcaacgtacgggaagttggatccatcgttgtttcccacaattgttccgcattcatctctccaagtcctttatatcgctgtagcatatatcctttgccgacttttttaatcattgctgccaattcgtcatctgtccacgcatattcaatgacttgcttcttcccttgtcctttggatactttatataaaggcggtaacgcgatatatactttcccagcttcaatcagcggtttcatataacgataaaagaaagtaagcagtaatacttgaatatgggcgccgtctgtatccgcatcggtcatgatgattactttgtcgtaattacagtcttcgatagaaaattcagggccgactcctgcaccaatcgtatagatcatcgtattgatttcttcatttttcaagatatcttgcatttttgctttttcggtattgatgacttttcctcgtaaaggtagaattgcttggaactttctgtctcttccttgtttagcagatccgccggcagaatccccttcgactaaatacaattcatttttcttaggatttcgggattgtgcgggtgtcaattttcctgaaagaagagattcgccttttttacgcttctttccatttcggctttcttctctggctttacgtgctgcttctctcgcttctctcgctttgattgctttacggaccaacatctggctcatttcgctattttcctgcaaataaaagcccatttgttcactgatgacgttatctactacggttcgagcaactggcgtaccaagtttttctttcgtttgaccttcaaattgcagaagattttcaggtacacggatagagagaacagcagctaatccttctctgaaatcactaccttccagattcttgtcccgttctttcagcaagccgacttttctcgcatattcgttataagatttcgtcattgccgctttcattccagcttcatgggttccaccatcttttgttcgaacattattgacaaaagataagacattttctgaatacccgtcattgtattgataagcgacctctacttcgataccttctttttctcctgaaaaataaacgaccggtgtcaatgtatctttttcttcattcaggtaatcaacaaattctttgattccttcttcataatggaaaacttccttgactggttcttctccccgaagatcagaaagtgagattttaacgccttttagaagaaaggcagattctcttaaccgttcggctaaaatttcatatgaaaattttgttgtactgaatattgtatcgtctggtaaaaaatggacaatcgtcccatttgctttttttgtttttcctatctttttcaacgtaccgtcaggtttaccgccgtttttaaatttctgctgatactctacgccatctctaacgattgttacagtcagccatttcgataaggcatttaccacactggctcctacaccgtgaagcccaccagaagttttgtatcctccttgaccaaactttccgccagcatgcagcacagtaaaaatcacttcaactgttgggataccggaagcatgcatccctacaggcatcccacgtccgctatctgcaacagttatactattgtcttcatggatggtcacatcaatctcactgccatatcctgataatgcttcatcaactgcattatcgacgatttcatagactaaatgatgcaagcctcggctgtcagtggatccaatgtacatccctggtctttttctaactgcctctaatccttccaatacttggatggacgagtcattatattcgttgtttactttttttgccaaggcaaacgctccttcaataatactttgcggcaaaaccgcaccacgattatcatactagaaaaggtcgtgaaaaaaaagaggttagatgagaaatcaattttaattatctcctaaccgctttttcgacattcctctctatcgatcatctcttctttgtggtcatttttatttttggttttctttcaacttaccaagttcaatcttgatacagcgatccattacgacgtctgtgcgtcctgcttttcttagcatctcatctgcttcttcgttttcgatccctagttgtgcccaaaacactttagcatcggttttcaaaaaatcagctgctacttcaggtaaaaattcgctccgtctaaatacatctacgatatcgattgaatcatcgatttctgttaaatttgcatagactttctctcctagaatttcttcaccagccaataatggatttactggtatgattttatatccattgtcttgcaatacctgtgcaaccatgtaacttgttcgctctggtttattgctcaagcctacgatggcaatattttttgcttctttcaaatagttaaaaatcgtttcttgtgttggattttttatagacatttctgtcaccccttgcttttctttttatttcatctattatacttctatctttcattttttcaattgttcctgttacctattcatgctaaaataaaggatagttttcaacttgagagagggtaaaaaatgaaattgatcttattacttattttagcatatcttttaggttctattccttccggcgtctggattggcaaattgtttttcaaaaaagatatccggcaacatgggagcggtaatactggaaccaccaatacatttcgggtattaggcaaaaccgccgggattgttgtccttcttatggatattttaaagggtacattggctacttgtctgccgatgatttttcacctttctgggattaaccctctttggtttggggtatgtgcgattcttggtcatacatttccgatatttgctgggtttaaaggaggaaaagctgttgcgacaagtgcaggaatgcttttaggatttaatcctgtattttttgtttattcctgtatcatttttatcgttagtctattttgtacaagtatggtgagtttgagcagtatgatcagtgcagcgttgatcactttctccacgatcgtccttccttatgtagctcctgtgattttggctaagcccaattggttgctgacgatcattgcctttttagtctcttcctttatcttctatcgtcataaagacaatatcaagcgtatcagaaaccatacggaaagtcgaatcccatttggtttgaacagcagcaagaaaaaatcctgacattttttcagtccaaagagataaaacaggagtgtgacatggatttgtcacactcccttttttcgaacaaacggtattccagaagctgaccacttctgtcacaacctcttattacttgatgtagaatagctttttacaccctcttacttcactgtgatcgaatattttgtcttgaagatttcatgggcacctagttgattgattcctactttttccatcaagtttccactgctattcaccgtgtcagcaattccacaccatggttcgatacacacgaaaggggcttcttttggataaggagaccagattcctacataaggcatatctttatagcttaaagttatgctatggtaagatttttcactccgaatggcgtacgcatttagtcctcttgtttcaaaaaccaatgcatcttgatcaaaaagttcacgattcaaagccagattcgtatttgtctgtcctaacgtcttttgttccatatcaatgaatgggccttttaaaggtaggcgtaatcttgatttcaatggagaaaatgctagataaaagtcttcgaatgacaatccttcttcaagaggtacattgaaagcaggatgtccaccgatagaaaagaacatttcttcttcacctgtatttgctacttggtaatggaccgtgataccgtctcctcctaattcataactaatcactaattcaaaatcaaaaggatatttttctaatgtctccggtgtactccgcaagatgaaactagccatttcttgtccatgttcaatgacttcaaaatccatatctcgggcaaatccatgttgtcccatttgatatgttttcccttggtaaacatactggtcatcttttaaacgtccaacaaaagggaataaaactggtgcatgtctgccccaatacgctggatcaccttgccagatatactctaaaccgtgttcttttgattttaaactgatcaattccgcaccgtgttcagcgatttcagcgatcagctggtcattttgaataataacagtcattgccattcctccaacttcgacttactttttaaaatgggaaggctggagcaaacatctgtatccgccccagtcccttgtttctaataactatgttttgctaattcttctttaaaacgggaattcaatacttttaaataagttcccttcatgcctaacgagcgagattcaatgattccagctgattccaattttcgtaaagcattgacgatcacagaacgagtgattccgatgctatcggcgatattagaagcagtcaaacgtccttcatctccatccaacgcttcaaaaatggcttgtacagcctttaactcgctgtaagacaatgtgttgattgccatttgaacagccgtcgcactccgtacatcagcttcgatacttcgagacttctgataaaggatctgcataccgacaaccgtagctccatattctgctaagacgagatcgtcatctgcaaacgattgttccatgcgagacaaaatgatcgtccccagacgttcgccagctccaaagattggaacgacagtcgtcaaaccaaatgggtatttttctcttgactctaccggaaacgcagtgatatcacttgtaatcgggatattagcttcagttttcatcagctgtgccactgtatcagtgtaagattcaggaaattgtttctcaacaaacattgttttgattcgttcattattcacatcgtggcgttcattgtaacctagtaatactccgtcacttcctatgatataggtgttgctgtcaagaataccacctaatgtgacagccatattatcgtaaggcaaatctgcttgcatgtcaaaagtattcttttgctgcaaaagtgtgtttatcttgcgagttttcgttagcaagtctgtcattgtcgtcctccgattttataaaatatagcgacttaaatcttcatttgccgcaattgagccaagtttgtcatcaacgtatgcttctgtgatcgttatttcacccatttgcatatctggtgcttcaaataataggtcttctaataatttttccaaaatagtgtgcagtctacgtgcaccgatattatctgtgtcacgattgacatcgaaagcaatttgagcgatccgttcaattgcttcttttgtaaatgtaactgacacattttctgtaccaatcaatgctacatattgttttatcaaagcattattcggttcagtcagaattttcacaaaatcttcagctgtcaaatcatctaattctacccgtattgggaagcgtccttgaagttctggaattagatcacttggtttagacaaatggaaagctcctgaagcaatgaataggacgtgatctgtttgaatgatcccgtattttgtgtttacttgtgaaccttcgacaattggcaatatgtctctttggacgccttctctggatacttctccagattgctgtgatttagaagtaatcttatcgatttcatcgataaagataatcccactttcttccgctaatttgattgcctcactatggatatcagcatccttgactagttttgctgattcttctttgattaataactctaaagcttctttgactgttaccgtccgttccacttttttcttcggtgttagagcacctaacgtttcatttaggtcgatccccatttgctccaatccattgttcatcattggtgcaggtttcttttgatcttcgacttcaatggttacttcacgattgtccagtaatcccttttgtagttgttccaaaattgtacggcggttgatccgaatatcttctgtcacttcttcttgtggttcagcattgttttgctgactagcattaaaaagattcatcatttgttcaaattgattagtggattgtttctgttctttttttataccaggcactaagatttttaccaaacgtttttcagcattttttttagcacttgtgtatacacggctgtattgctctttttctacgatttggatcgcattttccactaaatcccggaccattgattctacatctcttccaacataaccgacttcagtaaattttgttgcttcgactttgacaaatggtgcattgacgattttggccaagcgtcgcgcgatttctgttttaccgacccctgtaggtccgatcatcagcatatttttgggtgtaatatcttgttgcattttttcatctaactgcaaacggcggtagcggttacgcaaagcgacggcaacagatttttttgctgcatgctgtcctacgatgtactcgtctaattcacttacgatttgtcttggtgtttgtttcaattcatacatatttactcacctcttacagttcttctacgataatattatgattagtaaagatacagatgtctgcggcaatatttaacgcattttctgcaatttctttcgcactcatgtcattttgagcataatttttcattgctcgggctgcggccaatgcaaaattcccgcctgatccgatagctaagatgccatcatctggcgtaatcacttctcctgtacctgaaacaagaagcatttctttctcactcattacgatcagcatcgcttcaagtttttgcatagattgctgtgtccgccattcttgagctaattcaacagccgcacgttgcagatttccattgtattcgttcaatttgccttcaaatttttcttctaaagtaaacgcatctgcgacacttccggcgaaacctacaacaacctctccattgtagatacgtcgtactttctttgctgtacctttcatgacaacagattcacccattgttacttggccatctccagccatggcaaattttccgtctttttcgacagcacagattgtggttgaatgaaatggtgattcgaccatgtttgtttcctcctaaatttgttcttttccttattttacgctcttggatggaatgaacgatagtttttttgtagactttcttttgttacatgggcatagatctgggtagttgataaattggcatgtcctaacaattcttggactgtccgcaaatctgccccattatttaataaatgagtggcgaatgtatggcgcagcatgtggggatggatatcgctatccaagctgctttttttgatgatctgattcaagacatattcaataccagtaggcgtgattggttttccatgatgattcacaaaaacaatatcatgctcttcgtggtattttgtcatcaatacctgacggccttctgtgaaatattcttgtagagcatcttgggcaaaagaacctagcggcgcgtatctctccttgtttcctttaccatgaatcaacatgacctctgaatcaaaatcaatgtctgataccaacagattactacactcgcttaaacggataccagatccgtaaaggacttccagcaaagcgcggttcctcaaatctagaggactgtctcctgctacgctgtcaaaaagtgcttgcatttcattttcataaaaaaagcgtggcaatctcaaatttttctttttgagatgaacgtaagaaaatggattttcttttatcacttcttctttgagaaggtactgataaaacgaacgtaggctagctatcttgcgactgatagagtttctgctatagctggggcgatgatcagctaatgcactcaaatagacacgaaccgtaaagtattccgccttcagcagatcagcgtctccagattcctccaagaaatgtttaaaatggagaatatcttcttcatatgcttctttcgttttttctgaatatcctctttcgacaatcaaataacgcaaaaatttttgttcccacgtggcttccgtcattttctcaccttccttttgtcccagagaataatttagcacagcgtctacaaaaagacaaataaattgtcagaatttaaccaatatttctaagtttgttcacaattaatgcaattcctcacattttgtttgagaaatccttaaggaaaacgcaagaaaaagagcgagactatccgtctcaccctcttcatcgagtttgctcactcatttgggactgctgtttttctaattctttttttattgtctcattagcttttaaagcacgttgggcaattgcttcatatcttgcttttttgtctcgaatgcgttccggcaattcaggaaatagaccgtagttggcattcattggttggaaatgttttccttccgcatgagtaatgtaataagccatgcttccaatagctgtttcttgtggaaactcgactggttccatttcttttgctaagcgtgccgcattgattccagcaagtaatccacttgctgcactttcaacatagccttctacaccagtcatttgacctgcaaagaacaaatcttcgcgtttcgttgattgatacgtcggtttcagtaattctggcgaattcataaagctatttcggtgcataacaccatagcgaacgaattcagcattttccaatccaggaatcatccggaaaacacgtttttgctcgccccatttcaagtgagtttggaagcccacgatgttgtataaagaagctgcagcattgtcttgacgtagctggataacagcataaggacgtttgccagttttaggatcttccagcccaactggtttcataggaccaaaaagcattgttttgaaaccacgctgtgccattacttcgattggcatacatccttcaaaatatttttctttttcaaaagatttaagttctgccacttcggcattgattagtgcctcatggaaagctttgaattcctcttctgtcatcggacagttcaagtaagctgcttctcctttgtcatagcgggacttcaaatatactttatccatatcgatcgtagctttgtctacgatcggtgcagctgcgtcgtagaaataaaaaccatctgaaccattgaatgctttgatactttctgccaatggatgagaagtcaacggtcctgttgctactacggtgattccttctggtatttcagtaatttcttcgtttatcactgttactaatggatgctctttgacttttcgggtaatcgtttcagaaaaagaatctcggtcaacagctaaagcaccaccagctggcactgctgtttcatctgccgaagtgattactactgaattcaatcgtcgcatttcttctttcaataatcctactgcgttagccaaactatttcctcttagtgaattggaacatactagttcagcaaaattacttgtgtgatgcgcctcagtcgatttgactggacgcatttcatataaacggacaggtactcctgcttgtgcgatctgccaagcagcttcacttccggcaagtcctgctccaacaacatttaccattttcaatgaaagaacctcttttctattatttttggatgtcttcttcgtagtctccatttacacagactacttgtttgccacctttgactttcttctcaaccagatatccatcacattttggacaatttctgcccactggtttatcccaagaagtgaattcacattctggaaaacgagaacaaccgtagaacagtctgtttttcttagattttcgttcgataacttgcccttcatgacatactggacaagtcacaccgatttcttttacgattggtttggtattccgacaatcaggaaaattgctacaagcataaaacttcccgtatttccctaattttatcaccatcggatgtccacagacatcacaatcgaatcctgctggttcatctttgatttggattttttcgattttttcttccgcattcgtcagttctttttcaaacggtttatagaaacgatcgactactttgacccacgcttccgtgccttcttcgattttatccaaatctccttccatttctgctgtgaaatggacatcgacgatttgagggaaaaattcacagatcagcgaattgacaatctctcctaattctgtcggctcaaatcttttttgtgtcaattttacatagtagcgtctttggatcgtatcaagtgttggtgcataagtggaaggtcgccctaccccgttttcttctagtgcacgaatcaacgtagcctcactgaaacgtgcaggtggttgagtaaaatgctgttttggttcaatatcaacagattggacgacatcgccttcttcaagttctggaagaatgttttctttctcttctttgccgtcgtctctaccttccacatacacttgcatgaatcctttgaatttgatttttgaaccgttcgcaatgaagatcacaccattttgttctaatgttactttcattgtatctaaaatagccggcgtcatctgactagccacaaaacgtgaccagatcaatgtataaagtttcaattgatctttatctaaatattgtttgagttcttctggtgtacgaagcacactcgttggacgcacagcttcatgggcatcttgtgcgccttgagcatttttgatctttcggtgatcatgtctagaaaattcttttccatacgtatcttcaataaatgctgcggcctctgcttttgctgtatcggcaatccgggtagaatcagtacgcatgtatgtaatcaagccgactgttccttgtttacccaaagtgattccttcatataattgttgtgctaccatcatggtttttcttgttcgaaagtttaatttacgggcagcttcctgttgcaggctacttgtagtgaaaggattcgcagggtttcttttgcgctctttcttttctactttttttacttcgaagtctgttccatcaattctagcagtgacttcttttacactttgtgcatctggtaacttctttttcttaccgtcgattccccagaaatttgctttgaatttcttgcgagcttttttaaaattaccgtcgatgctccaatattcttctggaataaattctcgaatctctttttcacggtcaataataatttttaaagcgacagattggacacgtcctgcacttaaccctttcttgactttgcgccaaagaatagggctgatcgaataaccaacgattctgtctaaggtacgacgagcttgctgtgcatctactaaatctacatcgatcgttcttggttccttaaaggctgctttgactgcatcttttgtgatttcattgaagaccacccgatttttttctttcagatccaacccaagtaggtacgctaaatgccaagcaattgcttctccttctctatccgggtcacttgccaagtaaactttttgagctttttttgctgcggctttcaggcttttgatgacatcgccttttccgcgtatagaaatataatggggttcataattgttttcaaaatcgatacccattttacttttcggtaaatctcttatatgaccaacactggccattactttatagtttcgtccaagatatttctcaatcgtcttggcttttgcaggtgattctacaatcactaaatatttatacgccattactgaatggactcctttccattgtcgtgttcctactattaaaagaggattcatacaaatcgtagctaatcatatccattcagaaaacgtttgtcaagaaaagcaaatgaaaagtatggtgttattctttaaattctgccaagatatcttcacccgaaaccgtgcaaactgcaccgtcttggatcaaatgatgacatccggcagaatgttctgttaaaatatttcctggaacagaaaaaactgttcttccaagatccaatgcttgctgggctgttatcagagagccgctttttttcttggcttcaaagacacatgttcctttagacaaagctgcgataatacgatttctcattggaaaacgatgctttttcgggccggattgaggaggatattcactcaaaagaagatgatcatttgcaatcacctcttgcaggtcacgattttcagcaggatagacttgctctatccctgttccaatgaccgcgattgtccgtccaccatgagagattgctgcttggtgactgtaggtatctatccctttcgcgcagccactgacgattacatatccagcttcaaccactggttttagtaaataatacactgtttttttggctaaagcagaagtacgtcttccaccaacaacgcttaacatattacaagaaagtaaagataggtcaccactgtaaaacaggacaattggcggataggtcaagtgaagcaactgagggggatagttgggatcaaagcaagtaataaacgactgtttcaattggattttgccccaattatcgtgaatttcatgccaacttgtacggaacagctcccgatgtgcggtgatttttcctatcttaacgacgtcttcaaatccgatttctttgtaaggatactgcatcatccagttagcaagtgcccatttcccttggctactaattccttttgcataagcaagtttcaataaattctcttctatttgatacatcataaaaccgcctttcgtctctctttctaataagatacgtaaaagcggctgttttttattgtaaatatttttttacaggtgcaaaacttttgcgatggattggcgtaatcccttgtctttcaagtccttctaaatgttcctttgttccatagcctgcattatgcgagaaaccatacccaggataaagcacgtcatattctttcatcaattggtctcgatatactttagcaatgatacttgcagccgcaatcgacacagatcgtgcatcccctttgattattttttcctgctgtatagacaaatccaaggtcatcgcatcgatcaacaaatagcttggtgcaatagacaagttttctactgcttggatcatcgccaatttacttgcttcataaatattcacttcatcgattgtctgctgatcaatgattccgatcccgatggccaaagctttttcttgaatttgttgagaaagaagttctcgttttttctctgataactgttttgaatcattcagccctaatatgatctcatttttcggcaagataactgcagctgccacgacaggtccagctaacggtcctcttcctacttcatcaatgccggcaatccattggtgaccttgtgcgtacccttgtttttcaaagcaaaacatttcttcatatttttccttgatcaatgcctcttttttcaatcgtcgttcaaaagaaactagcgcttgctgtacgcctttgcgtggatcgttcctcaatgattctagtgtaggatcatctattctctgtatgcttttcaatcgttctttgatactttggatggattcagtcatcgcttttttgctccatttcttcgcaacgatccaatgtgtatcgaccaagttttccttgacggatatcatgcacgactaattcgctgccgcgatcatagtcttctttatacccacgttttgctgtgatatccatcagcaattccggtgccaatttttcttcttgctcgattggcaaaccataacgatcgctgattcttcctgaataatatcgggcaaaaaagtccaatccgtaaatcgccaaatcatctaaatggacaagttggtctttgatggcgcctgtcagcgctagttttttgccgatttcttcatcttcaaatttgggccataaaatccctggtgtgtctaacaattccaactcgttacccaaacgaagccactgctgaccttttgttacacctggtttatttcctgtctgagcaatttttttgcctactagtcgattcatcaacgtagactttccaacattcggaatacccaataccattgcccgaatagcgcgaggcttgatcccacgagcagcgtctcttgctcgtttttctttcaacgcttctttagctgcaggtactagccctttgattcctttactttcttgtgccgtgatagctaacgcaaggtggccttgcttacgaaaatattcttgccacagctttgtctgttgtggatctgccagatccgctttattcaacaaaacaagccgaggcttttgctgaatgatctgatctaacattggattacgagaagataaaggtaaacgtgcatctaccaattcaaatacgatgtccacatatttcattttttcagaaacttctcgtcgggcttttgccatgtgtcctggaaaccattggatggtcattgttctctccattcctttcatatcggaatattctccgactttacttgttttttatttttcaatatatattcacttttttctattataaaaaatcctatctattagttaagtgaaagtgaaccagtcctcattctatcacatcttctcttttttgatgatgtaaattttttattttgatttctgtatacgagtctgattttttgacagcgcttcctaaataagagatgatagacgaacaatgcagaaaggagacgaaacaaatgaatagtatggtttttgttaattttcctgttgccgatgtcaatcgttccgttgctttttatgaaaagcttgggtttaaaaaaaacgaagaattctctactgaagaagctagttcaatggtgtgggatgacactttttgggtgatgctcctctctcatgatttttataaaaaatttataaaagataaagaaatagccgataataaaaaaacaagtggcgctttgatttcgtttagtatggacaacgcggataaagtaaaaaaattcgctcaaattgcaaaagaaaatggtggtgctttccacgaagtcgatatgggaatacctgaagaagaaatgttttcattagaagtccaagatttggatggaaacacattagaacccgtatggatgaagatgtaagcagataacgaaactgacgtttttataacaaaaaaatagggatggatgatacgataagtattatccacctctatttttttcgatcgtacaattgccttttttacagtttataaaagcagtcttcttctcattttattagtcgttggatggttatttttgtaaatcgccaaggtgtcatgacaccttagcgattttatggtatccttttcttattaactgacaaaggagagaacattttgaacactttgattgcaaaagacgtttttagattgcccgaaatgaatgcaagattgttatcgacttctgcccttttattagctcttgatgtcatcttatacaagatagcgattggtcctgcttattttcaagtcacattcggatttttaagtatggcacttatgggttatctatatgggccgatctgggctggtttgcttgaaacgttgtcgaacactttgaatttcacaatatttggttcaggtacgtttcaagttgcttttcttatcacagcattccttggtgggtttatcaatggcttatttttatatcataaaaagataaacctactttccgtcatcgctgcccaactattgattatgattccagttagcctttttatcaattcttggctgatgtctgttttgtttggtgcagatttcaaagtgatttttctaggtagggttatcaggaatatgattcagatccctattcaaataacggttgtttattcatttatcaaagctttagaggctagaaaagtgtttaaacgagctgtttgattttatgtactaaggtaatatgctgattttggaccaaacgataaagaggttgtgacaaaagaatggtcacaacctctttattgtttctcactgaatccattttatttcatcaagcggataataaacgaatcttgctttacctaaaatatccgttttattgatcgtaccaaatgagcggctatcttttgaaactcttcgattatccccaagtacaaaataactatcttcgggaagcttcgattgtcccgtcagttcttgtagtgtgaagtccgtcgtataggatgcatttgcatgatctgactttatgtttttagttagataaggctccttcactacttttccattgatcttcaattgatcattttggtagctaacattttctcctggaagcccaatcactcgtttgatataaatcgtcccatctgctaattgaaaaacaacaatatcaaatcgtctgatctccgaaaatttttccatcacaaccatgtcgccttgtttcaacacattttccattgaattgccttctactggtacagggatgaacaaaaatccccgcaacatgaacgcaatgaatccagaaacaagtaagtatttgaatataagccagaagcgatcaatatagcgttgtttttttgtcaatctctatcaatccatccttcgttttttccttctttctttattataagaaaaatatcaaaaaaatgcgactagatagctgaaataaaaataattctttctatcaagctgttggacaaaaagcgcttggatcataaatggaaaaccaatttttataagtcatgattgttctctaaatatttttcccaagcttcgtcaaaaatatccatggatggcaaatagtcgacattcaattctagataactagaaatttcttcgtagctagagctgtgcttagggaattggatatctttaccggcttctgtagcaaaaatagataaagtatcatgtgcaccaccgcctcgcagtgtcattaaatagtgaaaaaagcttcgattcacccttcgttcctccaattttcttcaataaaggcagcccggcgtgcatggtttcttttaaaattttcaggatgctttttataatactcttgatggtcttcttctgctagataaaatggttgggctggttcgattttcgtaacgattggctgttcgaaacgtccactttcagctaattgtttcttactattttcagcaatgatccgttgttcttctgtcaaataaaagatgaccggacgataattgtcgccgcgatcctcaaattgtccgaaagcatcagtcggatccgtttgctgccagtaaagttctactaactgttcatatgaaatcaatgttggatcatagataatctccactgcttccgtatgtccagtcgtttggctttttacttgttcataagttggatctggtacgtgtcctccagtatatcctgacatcactgtatgaatacccggaagcgtatcgaaaggttggatcatacaccagaagcagcctcctgcaaatattgctcgttccattattattcctcctctaatactactcatttgatgtttttttgttctcttttgacttgctttcagtactgctgttgctagttttgtttgtatttgagttgcttgaagcatcagaggtatcttttggcaaatatagactaaatcgaatgtcatcatttactaagtcgattttatctgctttaatatacatcccgttttgcattcggaattgatccaatctaagcatgatagtcaaatcatctgtattaacttcgatccaatctggcaatttatagtttctcttgatcatattcatcacatctttgattggcaaactcaaggttccaatagaaagacttctagcttttagttggacatttccattttccatcacataaggatcaaaatataaatagaaattgataggaaaacctaatacttcgaaagtaccattgagtagtgcttcattttccaaatagaatttatattcgatatcactatctttttgatactcactaaggaaaaagctaatgatttgattgactttttctttatttgaattgattgtgaggacaggattgccttgcctttccgtgagggcaggtatttctgggagttctggttcccgatgagcaaaaatacggctacctaaaaatactgtcgaaccgagtactaccccaagaaggataagaaaagcgactttccagtaattcgttttctttgctttgtttgaagttgctccagaccttgttttcatgttttttactcgtcctccttctctagccattggttttgtgtctcaatcagctgatctctcactgcatttgccatcaattgataacctaaattattcggatggaaatgatcttcttcgtaaagcacattgtttttgatgccatttagattttctgtcgtgctagttgtttgatctgtgccttcttctgtgacacctacttcttgattcaatccttgataaagcaagtcattgattggaataaagtagcagttcggcatttttttcgtcaccgtttctgttcctttgttccaattattaacgatggtctgcatgtcagtgatttcaggaaagttcaaataaaatggattgtagatgcctaaaatataaattggcgcagttttattgagggatcgaaattcttccaatagttctgtgacattttcctgatagtttttcatcggttttttaaaggaattgaccgttaacccgaacaaattattttggataactttcatcaaatcatttccgccaacagtcagcgtgataaaatcagctgttttgatattgtttcgaatttcttcttttgtttttactcgctttaagatctggtcacttcgttcaccatttacaccatagttttctgtttcaaccgcagtcaaattataacggtcttttagatcatttgcgacaaggggaacgaagcctccttgtttggtttgatcccctactccttcagtcagcgaatctccgatagctatgtagtgaagtttttcttttttatttggatcttctctcacagtagttactggtttcattagagggccagctttcggtatggaagcagctagacctgcatagatgatgatcgcaattaataatgggaacaaaacgaggatcaaatgccgtttcgttaatttcatcttttcacctcttgtattcgattggtctaatgttatcaaaaattttatcaaaaaggtagtctttatgaaaaaagaaaataattatttccctatttttacaaagaaaaagagaataagctaaaagccttgcaggctgagggcttatcctctttttgactagtctacgtaatacatgattgcaaacgcgtctttaccagtatgcgtagcgataaccggattcgtatgcagtacagggatatgcatatccggaaacaattcttgcagaccttctttgaattcttgtgccagttcttttgcatccgcatgagagatgccgatttgccgcacatttggcaattctttcagttcgtttttcaaattattgaaccatttgtcgaacgttttctttcctcgccccttcgttacagggatcaattcagagtgggcgaaattcatcaccacgcgtatgttcaaaacactagacagtaaaccagtcgttcggctgattcttccaccttttaccaagttgtctagtgtggaaattccgatgtataattttgtattatcttgtacttttttgacttcttcaaggatttcctctactgatttaccttcttttgctaattcagctgctcgaattacctgaaacgataatccttggtcagtggtatcactgtcgataaccgttactttcgttttggttaaattactagcttgtcttgctgcttctactgttccactcaatccttttgtcatatggatcgaaatcacttcactgccgtcttctcctaactcatcatacattgagatgaattctccaatcggtggttggctggtttttggcagattttttgctttcgccatcatttccataaatctttcaccgtctaattggtcatcatccggatatactgttccgtcaatcatgatggatagcggcatgacacgaatgcctaaagcgtcgcgtatgtttttttccatcgtacatgaagaatctgttacgatttttacgtttgtcattattttctctctctttctttaacaagatgtcttattcatgttaaactacatgtaagacaatttctatttttagtataacagacaaataatgatttttcattaattacacctagtaaaggagccgttttcatggaaaaaacgaaatttaatcgaacgtatgaaatattaaatgaagtgtttaatgcagtcacccatggaattgggactggattgagtatcgcaggactagtgattcttttgataaagggtgcccacttgcattcctctctccatattgtctcttatgctatctatggatcgatgatgattcttttatttttaacgtctacgttgtttcattcattgatttttacaaaagcaaaaaaggtgttccaagtattcgatcatagttcgatttttcttttgattgcaggaagttatactcctttttgtttgctgagtatccgaggatggctaggttggactttatttgtattgatttggttgtttgcgattcttggcattatatataaagcgttgacgttgcataaacgcgagagagtatcaaaagtatctacgatcatctatatttttatggggtggctctgtgtcgtggctgctgttcctctttatcattctcttggaatgactggtgttattttgatggtggcaggcggtctttcttacacgataggcgcattcttttatagcttgaattctatccgctatatgcatgtggtttggcatttgtttgttatgttaggtgcaggttttatgtacttctctgttttattctttacttaataaaaaagctattgatgggtcagctctaaataaaagctgttccatcaatagtttttttatcgtctattcgcctgtcccattttttaaaggattctcattacgctgataggtttcaaattgatgcgggtaacgatttttttcatctatttctccttgactcgtattgatcaatgaccaatcagaccagtcaacaggtggaaaataagcatctccatcaaatacatgatagatgactgtccggtataatatcgtacaaaaaggtagaaattcttgataaacagctgaacctccagcgatgaaaaaaataccatctgtttctttttccaaggcaagcacttcttctacactatgcataacatgcacgccttctgctgtataggaagaatctctagtcaaaacaatcgtttgacgattcggcaacggacggctgcccatcccttcgaaagttttacgtcccatcactaatgtatttgcttctgtcatttgtttaaagaatttcagatcatttggcaaacgccaaggaagacggtcttcttttccaatcaatccgttttcgtcctgtgcccaaattgcagctaacattttctcatcctttctgattttaaacagcgataggcgctttgatcgttggatgtgggtcatatccttctaactggatatcttccatctcaaaatcaaatactgactgcttttcctgattcaaagctaaagttggaaatgcgcgtacttctcggcttaattgttctttcatttgttcgatatggttgatataaagatgagcatctcctaatgtatgaacaaattctcccacctctaaacctgtttcatgtgcaatcaagtgagtcagcaacgcataacttgcaatattgaacggaacacctagaaagacatccccactacgttgatacaattggcagcttaaccgtccctcttgcacataaaattgaaacatcgtatggcaaggaggcaaagccatgctaggaacatcttctggattccatgcagagacaatcaatcttctagaatcaggtgtttttttgattgcttcgatcacttctttgatttgatcaataaaaccgccgtcttttgtctcccagtgccgccattgataaccgtagatgtggccaagattaccgtatttctcagcaaaggaatcatctgttaggatcttttcgcaaaaaagtttgctctgctttttatattcttcattgaattcaggatctgtcaaacttctatgtccaaaatcagtcatatctggtccgttataatctgtacttttgatatagcgttcaaatgcccactcatcccaaatatggtttttattttgtaatagatagcggatgttcgtatctccttttaaaaaccaaagcagttcgcttttgatcaagccaaaaggtactcgtttcgttgttaacaaaggaaaacctttttgcagatcaaaccgcatttgatacccgaataaacttaacgtgcccgtgcctgttctgtcttctttacgatgtccttcttccaacaattttcttcctaagtcaagatacgcttgttccatcccttttcctcctaatcttctgcccattcactcaaatattcccaacgtgccattttttcttcaagttgtgcttctgtctcagatacgtcgttttgcaattcctgtaaccgagtgaaatcatctccttgatgattcatctcttcttggagtaatgagattttttcttcaagttctgcaatatcctcttcaatcgtttcccattctttttgctccatataagataattttttctttccagcaggttccttgctctgtgtttttggcttcactttttcagcaggctgctggagttctttttgcttcagcaaataactggacatgtttccataataaagttcttgttttccgtttccttggaataccaatagcttatctgctaccttatccaagaaataacggtcatgggaaacagtgatcacagcacctgggaaacttctgaaatagtcttccaaaatcgtcaatgttgctatgtccaaatcattggtcggttcatccaataataacacattgggttgttggatcagcagtttcaacaaaaacaatcgccgtttctctccacctgaaagtttgccaatcagtgtcccatgcataaatctcggaaataaaaatcgttcaagtaattctgctaccccgatttgactgccatcaaccgtttttgcttcttcagcagcttcttgcaagtaagcaatcatccgtttatctggcgccatttcttcattttcttgtgtataatacgcaagccgaaccgtttcaccgatagaaattgtaccgctatccagaggaattctgccagctagaatattaagcaatgtcgatttccctgccccatttttaccagtaattcctagcctttcccgagattggatcagcaaatctaaatgttctagcagtgtttggtcatttatacggtaactgccatctttgatttccaatactttttttcctaaatgttgtgtcgctagattcaattctaagtcatcttcttggtttacttgatataaattctcctttagattttcgaaacggttaattcgtgcttgctgcttggtaccacgagcttgcactcctgccctcatccatgctagttcttgcttataaagtcgcttgcgcttttcttcttgttctacttctacacgatcacgttctgctttttctaagacgtaagcttcataatttcctttgtactcgtataattttccaaatgaaagttcgaagatccggtttgctactcgatctagaaaataacgatcgtgagtaaccatcaatagagcgccacggtattgtttcaaatagttttccaaccactcgattgcttgataatccaaatggtttgttggctcgtctagtaatagtaaatcgggttcatcaatcagcacttgagctaaactaactcgttttttctgtccacccgatagcgtattgatttttttatctaattcactgattcctaatttttgcaaaataatcttcgcattggtatctgtggtccaagcatcttctttattcatttgttcttctgctttagcataacgtttttgcacattagggtcttctccattttcccctagttcgatcaatgcttcctcatatgctcgaacagtttggatcaagggactgtttccctgaaagactgcttggagaacagttagttcatcagaaaattcagctgcttgagaaagataacctatacggtaatcagttggataaaacactgtttgccgatcgccatcgccgctatcgataccagcaataatatttaagagacttgttttacccgtcccgttcgtcccaatcaacccgatacggtctttttcgtggatcaaaaaagaaatctggtcaaacaaatctttttcaccataagtttttttgaggtcagttacttttaattctttcaacgtgttccctccttatcttggatattgtatcataaaaatagtgaacttcaggaaaaattttttcgaatttgttctttttgtgttccaaaaaaagaacaggaccgatctgatcctgttctgacatgttttgtttttatcgttcttgaaaatctatttttttatttcgttgcgctcgatttttttgactttgctcgaaacgcaaatcggaaagaaaagttatctgacggtttgttcatcgtgtaagattctaacaaattgatattcctacggtagctattcgcagaaaacgtcgtgattttctcagcaacttcgtattcatcaatgatttttctttcaagatagtaacctctcagcatttttttcgtaaacaggttatcttgctggatcatccacgaagaaatcaaattccccgagctcatttttattccctcaagtttgcgttgctggataaaaaattgaagcattgtttcatcataaatatcagtcaagttatctaaactttcaataatcaattgtgtatttttttgatatgtctccctgatttcttggatatcttcatcactaataaatgtctgacgatccgcataccttctttgccaaaacatttttgggtggagaacgattcgcatcaacctacggacaacaatgaaccaaaagccgataaaagataaaaattgactggtgatcgaatgttcgaaccgggaaagaaaacgggaataaaagcgataaccattagaagaaagtttacccgaacgataactttcatctaatccgtcgcgttcgatcgacaaaatcagtgcttgtatttcttgtacttcttgcttttcatcatcggttaaatcttccaagtacagatcacgtatccgttcctggtaattttctatcactgcttcagtggctaaaaattcttttgtatcacgatcaatttcctttatttcttttcgcaaaacttcaacgacctcttctaagatcatcaaagcattcaaatccgtgcttttcgcttcctctgtttccgtcagcataggcaagacaatgatccctatgaccaaagtcactaagatgacaccggccgtcaaaaacaaaagtaaagatcgctggtaaaacatcatattattgattgaaaagggcaaaataaagatcgtagccaaactgactgttccctttacaccgccaaatgtcaaaatcaagatctcgttcaactgttttttgaactttttactgccatctttgaatacataaaaaagactgatggaaatgaatctaatcacaaaaagcataatagagatcaatacgataattgctaacaaaagaccatttggatataaaccgtctccccataccggcgagaatacttgtgtcagttcgattcctaagaatataaacactaatgcattcagtgtaaaagcaatagttgtccatgtactgtgggacaaactcgacaactctgcatcaaacacggtgattctcctaaaaccagaagcttggagaatacctgctgccaccgcagcaatgatcccagatacatcaaatgcctctgccaagacataggctagaaaaggaagcaaaagttcgattagcagataccctgtgacatcttgtgccgatgctttttcaatcaaatggattattttttgtttgaaccagacaagcaaaaaaccgatcaaagctccaccaatactggagaccactaaactcaccccagcgtttactgcggaaaaagaaccggtgattagcgcaccaagagcaaactggaaggcagtaacgccagatgcgtcattcaacaggccttctccttctaaaatatgcattgctttcttaggaatattcacccgtccagaaagcgaactgactgctaccgcatctgtcggacctaacgctgctccaaaagcaaagcaggcagcaagagggacacttggcaacaggaatgacaacgtcgcacctacgccgacaagggtcaaaatgactccgccaaatgccaagaacagaatagtcccgaaatttttgagaatcgaagaaatatctgctttttctccttctctaaataacaatggtgcaatgatcataaccaagaacaattcaggttcaaaatcaactgattgtccccactctgtcagacctaataccactccaaggaaaatttggatcagtggagctgggatcattggcaaaatgcggctagctatgttcgataaggtgatcgttactgcaaatacaataactaactcagcaaattccatcgtccatcccctttactttttattttgtgtaagcatttttaaaaattgttcttttttctttaaaattttggtttcaactacttcaacttgtgtttgatttccctctaattcacactgtacacgttttgactccaagcgaagcagatcatgtttcagacgttccaactgacgatacatcaatatatttcttttacgcaacttacaaagtatttgacggcggtcatccatcgaaagggcgccatagcgatcatgcaacagttttttttgttgttcaaaactttctctcattttctagatctcctatacacaaacttccatcattatagcaaagttctctttgaatgaaaaatatttcattgtttcatcgtttattgctagttagaaatttccataaatttttcaacgcctcattctattccaaatagtctcagatatcaagtaaaacttaagaaagataaaagtttctaacaaaaataatatttgtttttttatcatatcctccttgttcctttgtcacaacaaaggttgtgacacgaattttgtcacaacctttaaatgtattcctagagcaaataagctaagcgaagaaattcaattctgattatttattgtatttctttgttcagcatccttgctaaaagcccatattggacaaagtattcactacacccatgatctcatcttttcgagaacgtgctttttctgtcggatcttctacctcttctgtgtcgattcgaacaataaatttccgattcatcgtcacgtaagcaccgtcgttgatcaaaataaacagttcgttctcattatagtctgcacaggcatctttccatacgtcaaagccgtttttttcagaagggatatcccgtttaacaacagtttttccacttaattcgtggaacgttacgtcatagtatttcattatctcaacctctttcgtcattcaatattttggacctgttctctgattttttctaagatcgtcttggattggacgacttgatttttaatttcgattgcatttgatttggaaccgatcgtgttgatttcccgattcatttcctggatcagaaaatctaattcccgacctacaggacattgcgcctcgataagttcatctagtttttggacatggattgccaaacgatccagttcctcgtggatatctccacgttccagcaagatagccaactccgtcagcaaccgttgctcatccactttcgctccaagaaattcctccagctttttttgataccttaattgaaactcctgttcatagacgtctacaaaactattgagtttttttagtacttgtttgaattcttccgtgttctttttcagcaccgaagctaaggcttgtccttctttttctcgactggcttcaatagaatcaagtgcacttttcaatgtatctagagctaactgtgccaattcttccatgctctcttccggtttttcttctaccgttacgaagttttcatccagcgcgaagcgttccgccagccgacgaattgacacttgattttgactcccgtatcgttgttgaatcccgtctgtcaattgggtgataagtgaatcaatcaattcccaattgatgacgatctgcttttcgtttttgccaatataagctagattcacaaatacctcgatccgtccgcggcttaactgctgtttgataagctgccgaaaatcgttttcaataaaattcaggattttaggacttcgtatttggacatctagaaaacgctgattgacactttttatttcgatatctagctgatatgcttttgtttcgcggatggctttgccaaaaccagtcatacttttcattcgacagggtccttcctcattacatattttctattgctttttgcagttgttcaaactcttcgttcgtcagtgtcagccctttccccatcttttcatggtcgggtgcccaatctcgaagatcgaatttcggcggacgaccattccagctgactaagttcagctctttacgccatcctttgttgttttctgataaaacagcgatttcttctacgatttcatatgaaaattcttgtgccatggttgttcctccttgagataatataaatataggatcagtaatgtgtcaactggctgttcaagcagttcacgctgcaaacgatccttacatttttcttgcagcagtttttcaaaataaacggctttcgtgcgttcattttgtattttctgctgatattttcgatacctccgccattcttctgtacttaattgaccaacttgtgccaataaatcgtctggcatactttttctatcttgttggcagatcatttgaaacatccaatctacctcatagactttgtttggcaataaaaaatgtttttttgctaaaagttccagcatcgccagtccgcatgtttctggttcgaccctgttcttatatatattacgcagtttttgccaaaattttatggttttgaaaaaagatagctctaactgaagttcttttattaagtaagataaaaatctacgccagcatgttcctgcttgtttgacagaatcaaatgtataccaattcccgtaataacagcctaatcgttttttcatttccagatagcctaattgtaaatttaattggtttctttggctatcaaaaagcagaaagctgccaagcgtccacaatgtttgacatctccaatggataaacgtatctggcacacggattcttttcactggccctggtccttgcacatccacgacaaacgcctctgttgcgccttcgttaatcgcgatgtcaatagggattttgttacgaaatccaccgtctgcgtatttattttttccgatctttcggtaagccatagcaggataaaatgaagcagaggcaagtatccaatctggtatttcttctgtttctgtctgttggatagcagtcactacttccgctagttccggcaatttagtagacaccgtgtataaacgtattttggaattgtatttgagcaaagacaaatctaaattttccttgaccagcttttccaatggcgcagacgaaaccccaccttcaactagtgccgttttcgtcatttggcgtctttcttgatagaaacgttcacgcaagtcttcaacggcagccatttctggcaacgcaagcacttgtcttgttgatagctttttccataaacccacagctttttccatgtctccttgtaaaatcaatgcgccgttcagcgcacctaccgaggtcccagtaatgatttcaaagcggatgttatgttccttcagcgcctgccatacaccaatctgataggcaccgtgtgctccccctcctcctaatacaagtgctgtgtgatagaccagctttttatttagtttcatggttccttgatagccgtttttatgaaaaatacgcaaccattcttctgatagaggagattgaaataaaaaacaacagttttctttaataaaaaaacgagcacaagcttccatatgctgaaaaagtttttgccatttaaaagtttcgccttcgatcagcaagttgttaaaaataacatcttctctacttttatcaatagtaaaatagatggtatatttttttgatactgcttcaaaggcacattgcttttttgcagaacgccaaaatgcttctctactttcttgatggctttgaaaaaacggaagaggttgttttgcttggttgatacgcgaatacagcgacattttctgtgaaaagtaaactttttttatctccatcgctttctcctttttcttcaagtataccagtacgtcgaaaaaaggtcatgagtatcgtattcgactttggatattccataagaaaacaattcataaaacctcctttaaataaaaaaatacaaaaattaattgaaaatgagagtattttcaatgaaaacgtgattttgtaatggaattttaaaataaaagaaacaagctttttttatgcaaatgttgtaaaataaaagagattaagaggaaataagaggaggaacatgatgactgagtcagtttatgtacatattgataccacaagtaatgctgttttaacaaaaggactgactgctactgattttgcaaacagtatcgtgcattttcctcaaaacttgctcttactcgatccatctgcttctgctggagaatacgaatctcatacagggctgaaagtaatccgtggtacagaaaatatccagcgtttcttttcctcttctcgaaacaggcgtggattcgatgaattgaagtggattgactttactgatttaacgatgctgaaagaattgacacctttagaaatttcagaattgttatattttggccatatgaaaacacatctccactcaccatttttttataagctacaaaataatttcgtgtacttcgacctgaacgatcaattgaaccgaatttattatcgctatttagatgaattttacaggatttttgctagtaaattaagttctatcctgtcagataagatcaatgtaaaaaaatcctttttcaaaaaggaaacacctgttgaaaaaatcagtgtggaattattgaaagaaatgcgtaatttaatgcaggaagggatcattttttcttttgatcaagttggtttgatcgatgacgaataccgtattcctatttatgtgattgaggactatatttggaaattgaaaggtactcggtatcgggaagaagaagtcgtcgctactttaatctactctgtcaacgatcggcgctggcaattggtagaagatgccggtctttcttatctgccattgaagtgaatctatttcttgccgaaaaacaaaaaggaaacaagaaactaggacatgattctgtctcaagttttttgtttcctttttatttaaagattctgtcgtttatctggcacaaaaagtgatggaatcgtttgttggatccctaataaaacgatcatcgtcacaatcgctgtgctcaacccgctagcaccattcattacgaaagaaaagagccaaggattcattccccatagtgcataggctccccagaaaacaactcccgcaataaaatgccaaaaatatctggaaagtgcgccaatcaatgcaccaaacactatgttttttctgatttgtttcgtatttccatctgcatagcttttttggacatttgaagccatgagccctgctgcacctgcaaaagtataagcaatcggatactcaatcaacacttgaacgacacttaaataataaacttgtcccaacggaaagtgtaagatcccccaaatgaaacctgctagcatacctgcctttgtccctcttcttaatgcaaaaagcgtcaacggaatctgccccaatgaaatagaaaaactgctgccaatctggattggtatcaatgacagcaccatcgctaacgctgcaacaatcgttccttctacccaaactctattttttcccataaaaaaacttcctcctttgaataaaaaagtcacaaaggaggaagcagctttcgaaaaatttcaaatagctgttttttcacaattcctacgctcgcataaccgaaacaggtacgaagggtttagaaatagattcaatctcagcccaattggactcccctttgtgagtttatttattatttattttttgtttcaaataatggactaactggtttgttttcatggatacgtttgattgcatctcccattaatccgccaacacttacttcatcgattttatcgattttacgatcttctggaagatagatcgagtctgtgacaactagtcgctcgatagctgaatcttctattctttgtaaagcaggaccagataatactggatgggtacatgaagcatacacacttgttgcaccagcttctttcaaagcattggcagccaacgtgatcgtacctgctgtatcgatcatatcgtcgatcagtacacaagttttacctttgacttgtccaatgatgttcattacttctgcaacatttgcttttggacggcgtttgtcgatgatcgcaatcggagatttcaagaattccgctaatttacgtgctcgtgtaacgccaccgtggtctggtgaaacaacgacaacatcatcacctttgattcctttttccaagaaataattagcaataagtggtgcacccatcaaatgatcgactggaatatcaaagaaaccttggatttggactgcatgaaggtccaaagtcagcattcgtgttgcaccggctttttggatcatgtttgctactaatttcgctgtgattggttcccgtgcacgtgctttacgatcttgacgcgcataaccataataaggcatgactacgttgattgttttcgcacttgctcgtttcagtgcatcaatcataatcagcaactccatcaagttatcattgactgggctgctcgttgattggatcacatagacatgcgatccacgaatactttcttcaatgtttacttgaatttctccatcactaaattgagtaacagatgattttcctaactcgacaccgactgctgctgcaattttctctgctaatgggcgattggaatttaacgcaaaaatttttaatcttgggtcaaagtaatgttttgacatggggacctccactttctttttcacaactctagaattctacctaataaatagtagtcatattttttaaataaatcaagtgattttgcaaaagtcttagtttagataagggagtttttttgcatatccttctttattgacttgtcttgctctcgcaattgccaacgcatattctggaatattgtctgtaattgttgacccggcagcaatcgaactgtttttagctacctcgacaggtccgatgatattcgtgctagaaccaataaagctgtggtcaccgacagtcgtatgatgtttgttctttccatcatagttgacgaagacaacaccacatccgacattgatctcttctcccaacgtagcatcaccaacataagtcaagtgaccgactttcgttcctttgccgatttgagcatttttcacttccacaaagtttccgatatggacgttttcgccaatttcagcttttggtcgtaaatgtgcataaggtcccacatctgcatgtttcttgacatggctgctttcaatgactgagttttcaatgacgacgtgatcctcaatcctactgtctacgatttttgaatgtgccccgatgacacaatcagaaccgatgactgtattgccttggatttgtacacctgcttcgatcaatgtgtctggaccaatctctacgcctgcatcgatgtatgtcgttgctgaatcgacaaagcttacgccattgaccatatgcatctggttgatccgctttctcatgatctcatttgctttagctaacgcgattcgatcattgactcccattgattcttcgaaatcatctgtttgataagcagcaactgtattgccttcttcttttaagatttcgatgatatcggtcagatagtattcaccttgagcattgtttgttccgactttgcttaacgcatcgaacaaagcttcgttgtcaaaacagtatgttcctgtattgatttcttgtacaagtgcttcttctggtgttgcgtctttttgttccacgattttttctacgatcccaatatgatcacgaatgatccgaccatatcctgttgggttttctgcttgtgccgtcaagattgtcgcacttgcattttttccttggtgatattcaaaaagattgttcagcgtttcagtagtcaataacggtgtatcgccactgataactaacgtcgttcctttttttccttccaagaaagaagcggcttgcaaaacagcatgtcctgttcccaattgctccgcctgtaacgcatatttactgcgctctcctagttgtgctttgacttgttctgctccgtgtccaacgatggtaatcacttcatctggtttcgtttcactgacccgattgatgatatgttctaccataggtttaccagagacgggatgtaaaactttatataattttgacttcatgcgggtacctttccctgccgccaaaataattgcataacgtgcgtccaactgcgtcactcctaaatatagtttgctgatttcagtttatcccagtatacccattttttcaacaaaacaagtgattttctttcatcacggtgttctttggataaaaaaatagatagaccataaagggcctatctattgggtaaccggtgctctcctgccagctcctcggtcacaagtcacactactcataaaacaagaaaagctgttttttgaaattgctccttgtgacttagagttaaacggtaggcttatatctgcggtaataagctcaaccaaacaaaaaataggaggagctattttttcgttttgtttctcttatactcaggtcaggacgctgatttcacaacctctcgataaacggtgttcaaaagccagtttctcggtattaagccaaatttatgaaaaaatgtggaaagcccttttcacaaaatttttcttactactcgaaactaagcggctttttcacaacctcttattctgaaaaataatttcccggcacaaccgtgatgtttttcgtttgagtatctacatctttgacataaagcagtgacgtataatcatcgatagcgcgatgtccgttgaatttcgattcggcaaatacagtgatgccaacaagttctgattcgaattcttcgatcaagctcttcattccgttgactgttccgccgcctttcatgaaatcatccactacaaggacacgtgaaccacgtttcaagcttctcttagacaattccattttttcaattctttcagaagaaccggacacatagttgacacttactgttgacccttctgttatttttgagtctcggcgtacaataacgaatggtgcattcagataataggacacagcttgggcaataggtacgccttttgtggctacagtcattacagcatcgattttttcaccaaggtatttagaagcaatgattcttccaacttgacgcagcagttcaggttctcctaacaaatcagagagataaacatatcctcctggaagcagacgatcttgttctgatagacgttctgctagagattcaatatattttttcgcctcttcatatgaaatttcagggatgaacaatacaccacctgcagcacctgggattgtttccaaggtcccataccctcgttctttaaatgttttcttgatgattcccaaatcttcactgatggaagatttagcagattcataacgttcggcaaagcttgttaaggaaatcaattcatgcgggtgattcaataaatactgtgtcatgtcaaccagacgttcactgcgacgtactttcacctattccaactccttttaagaaattttatcgttttacattatataagtttttcttcaaaaattcgagcattttatgaaaaaataagaaaatagttcggtatttattaaaataaaaagaagcctataaaaaatttttcgtttttatcaggcttcttttctttataatttagttattttttcttctgaaggcaaccaatattcgtttgatgatattgacaatcaggaacaaagcaataaagactaatgtgattgttgctcctggaggtgtatctagataaaacgagctagttagtcctgacagcattcctagaaacccgacacaaacactgatagcaatcacgacattgaaacttttgcctaatcgcataccgattgctgcgggaagaaccatgattgcggatatcaaaagtgcaccggcaatcgggatcatcacagcaatagccacaccagtaatcacattgaacatcatcgacatcaaatgaacgggtagcccatccacgtgggcagtatcttcatcaaaagtcagaacatacatcggccgtttgaataaaaagaacaatataccgatggcaacgaataagattcctaaaaagatgacttgctcccatgtaatggtcacgatcgaaccaaacagataagattggatacttgttgctgaattccctccgctcaaattcatcaatactaatgctagcgccaaaccaccagccattaaaatggcaatggagatttctgaataggttcggtagatcgttcgcagatactctaatatcacagctgctaatacaacgactagcatggtcgtaagtgtaggattaaggttcaaaaagaatcctaacgctacccctgctaaagagacatgagaaagtgtatcagccatcagcgattgtcttctgatcactaaaaacacacctagcatcggggcgatccccgctatgaagatagccgcaagaaaagctcttctcatgaattcatatgaaagcaacgccattgagaatcctcctttctcaccagtcggatctgtctgtccgcatactgtttgatatcttcatgatcatgagtgatcattagaactgatttcccatggacatgcgcactatgtcggagaagacgataaaattcatttctggattcttcatccattcctgttgttggttcatcaagaacaaataagtcagggtcagtagcaaaaatacgcgctaaactgattcgctgcttttgtccgccagacaattcacctattcgccgatttcgcatatcccacatccctacagcttctaaagcacgctgtacatgttgatgatctttttcagagagacgcttgaaccagcggcctcttggatatcttcctgaacggactaattcgatcaccgtactaggaaaacctgcattgaaagatgcaacttgttgaggaatatagccgatacttaatttttttccttcttgatttttctcagcaatctttatcattccttttgaaggtttcagtaatcctaacgatgctttcaccaaggttgacttggctgctccattttctccagttaaaatgacaaattcacccgcatctacatgataagagacatcttctagtacaggctcatcatcataataaaaggtcaaatcagatatttcgatataacgcaccatacaacctccattctaaaacttaattgatactttcttttaaagcttccagatttttttccatgacagaaatataattttcgcctgctttgatttgttcattagtcaagctttctaaaggattcaacacttctagcttcactcctgtttcattcgacaatgtctcagctaccttcgaagaggcattttcttcaaaataaatcactttgatgttgtttttcttcacaaattcttttagttcagctaagcggcttggtgtgggttcctgatctggtgaaacgcccgaaatcgctacttgttttaagtcgtattgattcgctaaataagcaaaagcagcatgctgagtgacaaatgtgcggtttgttgcatcttttagcccatcggagtatttttgatccagtgcttcaagctttttgatataagcatcggcattcttcgtaaaagtttcctttttatctggatatttttcgcctaattcttcagcaatcgttctgacttcttttatagctaataccggatcgagccaaacatgtggatcgtattcatgtgaatgaccatgcccttcttctgattcttcatgttcgtctgcttcttgcgattctaaacggtcgattcctttagctgcttcgatcatcaaggtctgtttgctatccactgaatcctttaatgaatccacgaaaaattccatgtctgaactattatacacgaaaacatctgcatcggaaatttctgctctttcttttgcacttggttcgaaatcatgcggctccgttccagcagggatcaaaagtttcacgtttccttcatcccctacgatttcttttgtaaaatcatacatcggataaaaagtcgtaacgatcgtcaaatcctcttttttgtctgcttccttgttcatatttccacatgctgcaaacagtaaagcacctatcattaccgtagctgtcaaaagatattttttcatttatatgctcctttcaatgaacaaatcggaattttacgatttattaacgagaactaatgtatcaaaataaaaaaacacagtcaatagaaatccatcaatttctgatttaaacatgtatattcttgattaaatcgtaaaatggatgagttgctgctcatatctagtcatttcactacaataaaaaactgaagaataccactttaggattcctcagtttttcatcacctattttactttttatgttttattgcagggttcgtactaaataaacttcctcacaaaaaccttttaacccattatatactctctgcgctcttgaataatgttgacacaaggcaaaaacggttggtccacttccactcattaatgcagcatctgctccgtacttgatcatacgctctttgatttgatggatgactggatgccgctttcccgttatatcttctaaactatttcccatttttttgatcatctgctgataatcttgctctcggatggcttcaacaagtccgtggatgtcttgatgttggatggcttgcgtatctacttctctaaacactgtacgtgtagagacactcattcttggtttgaccaacacaacccagcactgtggcatagaaggtaatacttggatttcttcccctttgccaccgacaaatgccgtacttccgtagacacaataaggaacatctgtaccgacttccaaaccgatttctgccagttcttctaacgaacagcccaaattccataattggttgatccctcttagagcagctgcacagtctgtacttcctccgcctaatccagctgctactggaatattcttcttaacaaagatcttgacaccggttttgatattgtatttattttttaacaataaagcagcttgataaacattgttccgttcatctaccggtaaaaatgctttatttgtttctacaatgattttgtcttctgttatttcttcaaaaaatagatgatctgccaagtctacgctcgacattaccatttccaactcatgatacccatcttgccgtctatataatacatccagtcctaaatttatcttggctggcgctttttcaatcaattccatcctctcacccattcgaaaagtctaagtcgcaagtattctatcatagggaaaaataaaagtatagcttatgtctgcctagtggttgattttgtcatcgtttcaacagctttcatagaattttctcttcataatccaaataaactctagtgattcttataattctgtgagcacttcttctgccaaactcggcacatttcctttttctttccctatcagactgagcagctgcatggtagcaaatccgaaattacttcctttccgatatgcaaagtagcgaccttcccaatgatcgacatattttaatttcttttcataagcagactggaaggaatagaaaaaattaccataattatatacgatatgcatgactttttcttgaaagaaagaaaaatctgtttctccaacatttgctaaaggggctaatcctagatttgcttccagatagcccattttctcgtatacaatgaacaaattagctaatagataatccgctaattcttcaggctcttcaggcaagattcgcagtaaatcataccccgcttgctccttcgtcatcggttgagcggtgatgaagcccacgactttttgctctttacggacaataccgacgccactagacaatacataggattcatcgaatcgtcccacagaaaagtatttttctcgtgcaccgtgaagccatttttgtgaaacttcatttacagcttgatgtaattcttctggtagttggtcataccaagtgaaatggtatccttctttcatcaaacgttgatattcaagttgctgactcagccgagacaagtcttctgtcgctagatcaacaattcctgcttcacctactttcgtgaaatgaaagcccaattcgtgaagcatcactacgtagctttctgatatcttataaaaagcaagctgataacctaaacaatctgctcgtttcatgaactgattcgttgctgcctgcatcattttgggattaccaattggatctcctaaaacaaagcatttattccctttgatttgatagccaaaaacgacttggtcatggtcgtctttttggtaataaaaataactgtatcctggcaagcgaagctgatggcttgtagctgtgcctccatatgtttccaataaacggtcaaaacgttctttttcgtactcactgccaagcgtcgtagtatcttctgctaagtattgataaagcgccactaaagctagcaatgagatgcccaaaccaatgagccctgagaaccacacatcatctgaaggaaacaaaataaaatggttacctgttatccgtccaactaaaaagcgtccactatgataacctgcaattgcgtaaacaataaacaagaaaccgaacaagctagcatcaaatagtatagctccccaagaataaacgaattttgttcgataaaattcttttctagataaccacacagctaatagaatcaagacatataccaataacaattgccaagatagtgtacgtgtgattgtatttaaaataccaaaagctagtaaagcaatcgtaggcagaaatgcctttttgacttttactgaaagcgctcgagcaagaccgagcaataaaaagcccactaataggttcaatgtctggtctaaaaagttgaacgagaacggcaataacacctgaaacagccgactaattgcagacagattagtgatcgttgacaggagtaccatcatgattcctgcaaaatatacagcacttacgagcacgatatgcgcaaccttttggaaaaataatcgcggtatattatctaaaaatcgattgattttgactcctgtatgtgtgatgaacaatagaagtcccgtcaaaaaaggcaggacataataaaacaaccgataatataacaaccaaactactgctacgtcttgccgaacagacaattgactcattcctaaaatcatcaaaacatcaaaagtccccattccacctgggaccattgtcaacattcctatcagcgtcgcaatcatgaacataggatagatcgaaaacatggaaatatctattctcatcaacttgccgatagtcagaaataccgcaagtgcccctgtccattgtccaaaagatgccagtagcagaccaaacaagccttttggataaaactcagagaacaaggactttctctttagataagcaaaaaagaaaatgactggcgctaaaaaactaccgccgaaaagccagatccaatagctccgaaaaatactttctgactgaataaaaaagacatcaataaatgtaagaaacgaccatacagacaaaccagtcagcataaatagcgcgacttttgaaacagtcactaacaccattttcctatttgtctgctttccataaaaactagcccgaagactggctcctaccacaccaccaaaaccggcgagattgttgatcgtgtttgttacccacgcagcaagaaggaactcttttctttccatttttggttttccttgtttttctaagactctgatcgtcacccaatcatacaacaacatcggagtgacacccagcagtccagccagaatcatgagcagaatcgtcatgtggctttgttgtcccatcctttgccaaatatcttgccaactcatgccattagcaatatttgcgacttgatttgccacaaagactaacacggagccgaaaaaaatcaattttaaaatcagactatgttcctttatccattgcagcatcaagtatcgtttatttttcacattttcccattcctaacttgtatacttttgtgttataccccaatgttatcttatttattttaatttttccactttagacctgttctttgcttgcgatcatagaaaaagaaagatatcctaatgctaaaggagaggataacatgaaagtaggatttatcggtacagggaatatggcacaagctattattgatggtttattgaaaacaggaacagtctcgaaagaagaagtgttcgtttccagtggtcattttgaaaatgcacaaacattcgctgctgaaactggcgtccatgcgtgcaaaagcaaccaagaagttgcatcaaaatcagatatcgttcttttagccgtgaaaccaaaaatcattgaaaaagtattgaaagaactaaaagaatacagccagaaggtcttattcatttctattgcttcaggaaaatcattaacagatttagaaacagcgcttgaagatcctcaggcctccatcgtacgtgtgatgccgaatgtcaatgtcagcgtaggagcaggcgtttctgcgatttgcaaaaatgaagctgccacggaggaacagcttcaacaagccacgataatttttgaagcaattggtagcgtctatcccttagcagaagcagatttcagtacattcatcggccttgctggcagctcgcccgcattcatttatatgctgatcgatgcgatgggacggactggtgtattaaatggtttgtccaaacagacggccactgaaattgctgcaaaagcaatcatgggttcttgtcaaaaattcctttcaagtgataaaaatccatgggaacttgtagaccaagtttcttctcctggtggtacgaccgttgccggtgtagttgccctagaagaagcaggattcatcccagcaatcatcaaaggaatcaatacgacgatcgagaaagatcttgagatgttgaataaaaaataataatagcaatgttttttcgtaccttacaaaaaaagaagagctgcggcttttgccgcgactcttcttttgtgtttattcttatttagcataatcagttgcgcgagtttcccgaataacgattactttgatatgtccaggataatccaactcttcttcgattcgtttacggatatcgcgtactaaacgaacagcgtccagatccgagatttcttctggtttgaccattacccgaacttcgcgtccagcttgaactgcgtaacttgattctacaccggcgaagctgttcgaaatattttccagacttcttaaacgacggatgtagttttccaatgattcacttcgcgcaccaggtcttgctgctgaaagcgcgtctgctgcagctacaaggacagagataacagaagtcgcttccacatcgccatggtgagaagcgattgcgttgattactactgggttttctttgtacttggcagctaattccgcaccgatctcaacgtgagatccttcaatctcatggtcaagtgcttttccaatatcatgaagcaacccggcacgttttgctaattggatatcttcgccaagttctgctgctaagataccagctaattttgcaacttcgaccgaatgcttcaagacgttttgtccgtaactagttctgaatctcagacgtccgatgatcttgattagatctggatgaagtgtatgggcaccgacttcaaatgctgcttcttccccatattcacgaatacgttcatccatttctttacgagatttctcgaccatttcttcgattcgtgctggatggattcgtccatcttgtatcagtttttccaaggtcattcgtgcgatttctcttcggattggatcaaatccggaaagaacaactgcttcaggtgtgtcatcgatgatcaaatcgataccagtcagcgtctcaagcgttcgaatattacgaccttctcgtccaatgatacgacctttcatttcatcattcggaagggtaacgactgaaacagtcgtttctgaaacttgatctgctgcgcagcgttgaatcgctaatgataataagtttttcgctttgcgatctgcttcttctttggcacgctgttcagattcttttaccattagagttaactcatgattcagctcttcttcagtcgatttcatgatgacatctcgtgcgtcctcttttgataaaccagcaattttttctagttctttttgttgatcttcaatcattttttcaacgtctttttctcgctcttcaattaattgctgttttgaactaagtgcttcttctttactttcaagtgagttctcgcgtttttctaacgagtcatctttacgattcagcgtttgttcgcgttgaatcaaacgattctcttgagattttaattctaacttactttctctcagctcactttcaacttcagaacggtatttctgattttcttccttagcttctaacaatgcttctttttttagagtttctgcttctttctttgcactatcgatgatcccagcagctgatgattgtgcaccagctatttctttctcgtgacgtgactttgcgaccataaaccctaaaccaagaccgacaattaaaccgatgatagcgaggagaatgttgaataccataaaatccacctccatactatctttttcatttttatcatctatacagcttctatgataaattattctaaacttgtcaatatgcatcttcgcatatatgtgtacaaaaaacatgcacaactttattctaatgtttgtaccccgtagtgtcaactttaaataaacaaagaaacggctttccgttcattcattaaacggtggtttttagaataaatgacactagtttcatataagtaaacctttaagttgagaaactttttcactaaattactttttgtagtcgaatagatattttttattttatgtagctactcgtatgattaaataactcaagatttctttgttctttattcaataaaaaaacggcagatcaaggagagtatctactcttcagaccagccgtttttgtttatcatgatttttattcttctaaaggcaattcttcttgtccttttgtatcttctgggacagccacttcttcaccaatgccataagctgctctaactagagcagaaacttctgccatcatttcaggatgattagccatatagattttagcattttcccgtccttgaccaatccgatcttctttataagaataccaagcaccgcttttatcaacgatgtctttttctactgccatatctagaagttctccttcttgtgagatccctaaaccatacatgacatctacttcagcgattttgaaaggaggtgctactttgttttttacgactttgatctttgtacggttaccaacaatatctgtaccttgtttcaattgttctgcacgacgtacttctaaacggatcgttgcgtagaatttcaatgcgcgtcctccaggagtgatttctggattcccaaacattacgcctactttttcacggatttggttgatgaaaatagcgattgtttttgttttgttgatcgaaccagagagtttacgcaatgcttgagacatcaaacgtgcttgtaacccgacatgtgagtcacccatttcgccgtcgatttctgctcgtggaactaaagcggcaactgaatcgactactacgatgtctacagctccacttgatactaaagcatcagcgatctccagaccttgttctcctgtatcaggctgtgaaagaagtagttcatcgatattcacacctaatttttgtgcatattgcggatctaacgcatgctcagcatcaatgaaagcggccgttccgccatttttttgtacttctgcaatagcgtgtagcgccactgttgttttacctgaactttcaggtccgtatacttcgataatacgtccacggggataaccgccgacacctaaagcgacatctaacgcaagagagccacttggaattgtagagatttgttggtcgattttttcgcccaatttcataatagagcctttaccatagctcttttcaatttttttcagtgcagcatctaaggctgctttacgatcatctgccaatacgataatcctccttatatttacaaatcagagcaacatttcattatccttatcatatcgtttttagtaataaaaagcaagaaaaaaccgaacaaatattcgcatttatcattttcttaaaagctgttttctcaaaagatcaaatccttgcataaccgtattatatctgatagccgcacggtctctggcaaaatgatatttttctgaaaccacgccatctttagatgaaatagcgatccatactgttcctgcagggtgaccttctaatgtgtccggtccagccactccggtgaaagctacactgtaatctgttcttgctatctcacgtgcttgaatggccatctgctccacacattctttgctgactgttccatattctgctaatagctccggatcaatctccagaaaaccagcttttgtttggagcgagtaggtaacaaagccgcctggaaatacttcagatacaccagcaatatcgcccaatgcggcttggaaggcaccggctgtcaagctttccgccgctgttacagtctgcttgttttctttcagcagttccactacgacttttgctaacgaattatcatcgccatatccataaaaatattctcctactcgttcttgaatcttttcttccaatgctaaaagagcttgatttcctgcctgaacatcctttgtttttactgttagacgcaatgtcacttcatttggtttggcataaggagcgatcgttggattaatctgtgtctcgattagatcttttagttcagtgaccagtcgcgattcaccaatcccataaaagcgcaaaactttagaaatcagtttttcttcagaaggaaaacgttcctctagtaaaggacgtacttgttccacaaacattggtttcaactcattaggcggaccgggaagaagaatatatgcatgtgtatctgtttgataaaaagtccctaaagcaagccctgtacgatttggtagaggaaccccaccttcgatgatttgagactgttgcagattgtttttggtcatttttcgatgggttgtttcaaaatatgccaataattttttgtatccttccgtattttgtatgagagacttaccgaggtgagccgcagttgcttcttttgtcagatcatcttctgtcggccctaatccgccacataagagtatgagttcacttcttgtttcagctagagcaatcaactcttctaaacgctgctgattatctcctacgacggtctgataataaacttcgatacctagatcagctagctgttctgacaagaaagtggcattcgtattcacgacttgtcctagtaaaagttctgttccgacagctattatttctgctttcattacttcccgctcccttatatagtatacgctgtacttatatatttttttatttaaaaagagggcaaggctgatccatggaccagcctctccccagttcttttttcattatatgatcaaattattttcactttatcaagaaccgacgaatctgaccatccacaaaacaggacctacattgatcctttgaacacgccgctatttttgatgaagtaatccgcacctgaatagatagtaaaaatcagacaagcatagagcatgatttggtctactggaatactaatcagattgaatgggatattattgataaacagcaagataatagcaaccatttgtgtagccgtcttgacttttcccggccaagcagcagccatgacttctccatgttcgacaagtagtaaacgtaagcctgtgacggctaattcgcggcagacaataatcgcgactacccaacctggggcctttccttggtcaaccaacatgataaaagcggtcataactagcattttatctgccagtgggtccgcaaatttgccaaagttagtgacaagacctcgtgcacgggcaatttttccgtctaaccagtctgtgatgctggctaatgcaaaaataactgcgcctactagctgcgtgacagccagtgtggtgtcccctacgttaagttgtccccaatctaacggtaatcctacaaccaaaatgaaaatcgggatcatacaaattctaagtacagttaatttatttggtaaattcacattatcgactcctttcttccctattctacgtgactatccgctaagtttccaccgatattatttacttttccaaacgaatttattcaacggagcatttttattgaaactgatcttttgaaaataatgaagaaggaccgcgacacagatttgtcacgatccttcttttttatgccacaagtaaatagatgaataaactcatttgtacgatcactctgcgtattggagagtcaggttcacatttttaggactctgattgttttcccctggattaactggtacggattctccattcgctttgatcgtcgcattgcttgctgcaccgatcgtaatggtcgcattggccgctgtttccggtaacacggtactttgtgtttcatttgctgccagtgttccttgataaacataagcattgtctactagtacaccgatccacacacgattaacagcggtaaactcaagagtgacaggcttggtagcatctgtaatatttactgcgatggcactgccggaatcctctcctgcagctattgccattttcttttcttcacttgattctgttgttgactctactgtagaagactcttgggtctgcgtgctttgctctgaggaagaggactcctcaactgatccttctactttgagcgaagaagctgtatcgccgattattggatcagcttgacgatcttgccaagtcatatagcctacgacaacgacgattgccaaagcgaccaatcctaataaaatgacaggaagacttgtccaaaaacgacttggatgcgattcttcttgatgtattgcttttctggaagtacttactgtttcaggctgcggacgttcagggaccgatcctgtcaatttgctttttccatcaaaaacatcgactaaatggtctccatcttctcctacagcttcagcgtattgcctaataaacgcccgtacgtaaaacttaccaggcaattgatcaaaatcatcattgtcgattgcttccaaataacgtttttgaatttttgtaatctgctgtaattcatctaaagatatctttttattcaggcgtgcttgccgtaatttttctccgatggtttcaaaagccactcgttcatcttctccagtctgtttgattctccgaagcatctgctgttgcaacgaaagacgttatgtttggggctgtgacaaaagtcgtgtcacagctcctttttccgtataaacggcgttccagaagtagcttcttcggcaataagccgaaatttcacaaaaatttgagaagcaattttcgtcaattccttcttatttcttgaagctgaccacttctgtcacaacctctttgattacttcgtttaattttattttaatataagttgattaaaagagagcatgatttgttttattttctcattaatatttccaacacatctaagaataccataaaagctggttttggaggaggttcttgctacaagtctaaaacgaaatttaagacttttctccataaaacactggtttattttggtctcatataaaactcactgaaggcctcttcacttataaatgcttctccagctaccagtacgtctttcatttggatcgaatcgatgatttcaggaagatcaaataatgttcgatcaccaaataaactttgcgtaaattgattagcaatatattcgattgaattcaatgattggaaatactgtccaagcattttcttcttcagcaaatcgagattcatttctgacacttcaggatcatcagcgaatccaagaatgatttctttgattttttctgctgctttctctggttcatccgtatctccgctgaagtccgcaaagtgaaattcacgatccaagctgaattcaaaaccaaagctgtcatcgataattccttgattgtacatagctaaatagtttcgagaagtattacctaaaatcatttggaacaacagattgatagctgttttataacgtagtagttctgttccttcttgcggcaatgtgtctaatcctttaataccaagtacaaatttatttcgtgtaatggctgcttccaatgcactttgtttgatgatttcttttgtgttttctgggaaataacgtacaatttcttgctttggcgggaaatttttttcttcttggttttcccgaataagtttcatcaatttctcaggctccatcttaccaactacaaataaaaccatattgcttggctgataaaacgtccgatagcacgtatacaaatcttgagctgtgattttgtcgatactttcaaccgtgcccgcaatatcgatatgcaacgggtgtgtaggatacaagttatttaggataccaaaaaacatccgccagttagggtcgtcttcatacatttggatttcctgaccaatgattcctttctccttgtttacagtttcttctgtaaagtaaggtgcttgtacaaagtcgatcagggtcgtcagattcttttctacctgatcagtcgtagagaacaggtaactagttttcgtgaaactcgtgaaagcattagcggaagcaccttgctgtccaaataattgaaagacatcaccgtcttctttttcaaacagcttgtgttctaagaaatgagcgatgccatctgggactttcactttttctttttcaccataaggaataaattcgttatcgatcgaaccataattcgtactgaacaaaccatatgtcttgtgatagtcgtttttaggtaataaatacacggtcaaaccgtttggcagtacttcatgataaagcgtttcattgatttgctcatattctgttttattcatttgcatttcctcctgctaaaaagaagattgcttgcaattcgatttgctcagctacttgttgtatctctttgatcgttacactctccatacgtttcaaccattcttcatcagataattttgtttccggcagccagctgtccaaaaaagaagcttcgattgccgcttgcggagagtctagagaaagcaggtattggtttcttagcatcgcttttgtctgagctagttccaaatctgttatttcaccgtttcgcaaactttctaattgctcgtgaatcaggcgaagtacttgatttcggtttttttcgtcgataccagtctggacactcatgaaccctcggaatgtatccacgctgctagaggcataataagctagactttctttctctctcacattcatgaacagtttggagtgaggaaacccgccaaataaaccgttgaagaccattagcgcaaaacgttctggctcatcataatacacatttgtctgataagctagattcagctttgcttgaacgattggctcacggacttgtcgttccttgacgatattcacttgaggctgagtataaaacaattctggatgagctgtttcacgcggctcaaatggtaattgcccaacagcttcggctgctttgtccggatcaacatcgccgacaacaaaaatgtcaatttgatcgttcgccatcatttcttgatagtaagccgctagtgagcgagcagtgattttgtctagttcttccactacgcctaaacttgggattttttgttccgggctgttttcaaaataaagttcttgcagtgcataggaagcaaaagtttgtttatcttccttcaaactttccaaatagagacgcagattgttcttttccaagtcaaacgtcaactgatcaaactgttgatttttgatatttggataaaataaaacctcttttaaaaaatccaccgcttgagagaaaaggttaggatcattgacatattcgccgttcacaaagctgattcctgcgtttagccaatgcaagttccctttttttcttactgatagtccgaagcttgcaccataaagctcagcaagtttcgcacttaactttgtctgatccggataattcaaactatttgtttccaacatactgctgagtagtgaacgttttgtaatgacttcttgttgcagacgtgccgtaaaacggataaaaatccgaatcgttttgtattgttttgttggtaagacatgaagattcacgccttctgccaattgatacaccatatttatatgctccttttcatagatgattgccccttactcttttagtaggacaatcagccttttttacttatgcatctgcttgaaatatatataagttcagacaattcgccgatttttctaaatgatgttacactttatagtatagcatagaagttttttatcaaaagggacagacagctaaaagcgtatatcgtttttttattttttatttttcgatatactaaagacatacaaaagaagggagggtcattcatgataaaagaattcagagagttcatcatgcgtggagatgtcttggatcttgctgtcggtgttgttatcgggagtgcgtttacaagtatcgtaaaccaagtggtgcaaggattaatcactccgctaattggttggattgtcgctatgatcacaggaacttctgatttagaaggagcactttcaattcttgactggtcgccgacaaaaggtgtcacatttgcgtttggtaacgttattagtgctatcattacattcctgattactggttttgtcttattcttagttgtcaaagcggcaaaccgtgcgaagaatttacgcgccaaagaagcagaagaagaagtggaagaagcacctactgcagaagattatcttagtgacatacgcgatcttcttgccaaacaagtggcagaagacaatacgcatccggtagagcaaacaaatctttcagatacttctaaataatgaagaatctaaaaaaagaaagccgattttcagtgtcggctttctttttttagattcttaacttgttacctgttcttttttcatgtcgatatgcggaatatcatcttccaaatacacatctgagattgccttgaatccaaaagactcataaaaagcctgtagatattcttgtgcaccgatcacaattggtttttctggaaattttttctggatcatgttgatcgtttcttggacaatctttcttcctaagccgtctttacggttattttgatgaacaagaacgcgaccaaaatggatgctgtctgcttcttcatatacccgcgtgtaggcaaggatcttcccatcagtatcttggaaatacgtatgccaagcttgtccatcgatatcatcaacttcttgataagggcactgttgctccacaacaaagactgcaatccgttctttgacgattgcataaaactctgctgtcgacaattcttcaaatttctttacctgatattccactaagtaaacgcctcctacttttttattattagcataccgattcatacacaaaaaagcaaacgaaccttacgaatctcaggctcgtttgctttttaaactgcttcagttaaaaattcgatctcaactgttcgagtaagtacatctgaatagctgtaagatactcgttcaaaagaattttcttcaggatccaagtcaacaacgaatactgaaggataggtttctgttaaaacgccgcggcgttctgtttgacgctttcttcctgtctgagcaaccaacatgattgggctgccgatacggccttctaaatctttcttgattgaagctaaagttgttggcatacagttcacctctactaccaactataccacatatttttaaaattttcaagtttaccataaaaaaaaaagaaatgcaataaaaataaataagaagctcattaagatttttctaaattattcctcattataaaatttcaagtgtttttttattttgagttttacccttccatatgcactcatcacttgcttgtgatccatgacaaccattcagccatctccgcaaaatcaaccccttgcatgtaataatgaaaaatttgtgcttctttttttgaaaatcggatctcgcaattttcgattgcttcttttaacaaaagatgctgaatcgctaaaggttcctgcaaggtaatctctgctaaaaaatctggtccttctgtctctattttttggtcgatcgagacttcatctttttggtcacggcgcttcagcgcgttctgttttctcaataaagaataaatttgattgcttataatacttttataataacttccaaagctaactcctttgcttttttcgtaagttctcaatgcctgatataaagcgatcctcgcttcttgttcccaatcctcagtaacataatttcttaaataataagtgtttttcaaacgtagtaagagtggaaaatatttttgatacagggcagcaaatgcttcttcgtcaccattacgtgcagcgcgcaataactcctcagacataaaataattcctccataaattcgtttatggaggaatcttatcatcaatgattcatcgaactgattagaaagatatgttatttattttttctcattaaatcgtccaatttttgggacaatttttttaactgctcttcattccacggagaattacgtcggaaatcaacaaaatgcatatctttattttcttgggctattgttttttccgtttttttaatcgttttatataattcataagcagaagtccgcaacgccccctgagaaaaaatcatccactgttctgctagatcgcttgtcgccactgttacttgtgtcaaacgatcattcagctgcccagcgattctttcgatataactgtcagccgtttcatcttctttcgtaaaaacaacatccaactgatatttcctataattttgctggatgcctggtactaattgagcatcgaagacaacgatgacttccagtccttcatatttcgcataatttgataaacgatgcaaaagagcttctcttgcatctgccattttgtcctgctttttaagctggaccagttccggccacgaaccgatcatgttgtagccatctacaatcaacagctgttttttcatgacctactccccctgacgttgggaaaaagcctgatacatcagcaatccagcggcaacactggcatttaaactttggacgtgcccagtcattggaatcgtcagtaattcatccatttcttttttcaatcctggactcattcctttgccttcattaccaatgactaaagcaatggatcctttggcattccatttttggaagtttgtgccggtcatatctgtgccaaatacccaaaatcctgtctctttgagctgttgcacagcttgtaccaaattcgtcacacgtgcaacaggcacatattccactgcaccagtggaagtctttgttacgataggcgtgattccaactgctcggtgttttggtatgatcacaccatcgacgccacttgcgtctgctgtccgtaaaatcgacccaaaattgtgtggatcttcgatgctatccaaaatcaaaaagaagggggcttcttttttctcttttgttcgttcaatcagttggtcaagggataaatattcataaggtgtaatcgcaagaacgactccttgatgcacgccatgatcgctcaaagtttctaatttttgtttagggacccatttgaccggtacagcttgctcacgtgcgatttctttcagttcttctactttttctcctcgtgaatcttcttgaagaaagagtttattccctcgcccttgttgtagcgcttctactgcggcgtggtgtccaaagacgaaattatcttctaatgcttcttcattttgatcagaaactgactgatttcgtccagtttgctttttatttggatatctattttgttttttgtcttcaaatccacgtttcgattgatgtttgtttgttctttctttacccatttttttcaccaactttctgaatacaccagcggatcaattcttccatccgctcggtttgttttgtcaaatgcagatagcccatcagtgcttcgaatcctgttgcgacccggtaagtcgtaacatcagcattttttgcactcgtatggcttttggcatttcttcctctgcgataataaagctcttcttcttctgtcaaaagatgttcctccagcatttgctgaatcaaaaaagcttgtgcatttgcagagacataattcgttgccgcacgatgcaacttattgggttttgtttctccttgattgatcaggtggtcacgaacatagatttcgtaaatcgcatctcccacgtaagccagggctaaaccgttcaattgtgtgtaatctctcatgcttctcttctccatcgggttccttggggtgtatcttctaataagatccctttttctttcaacaaatcacggatttcgtcgcttcgggcaaaatcacgattgcttcttgcttgatttcgttcttcgatcaattgttcaatctcttcatccaataattcttctgctgtaaataaaataccgaagatcgaaagccattgcgagaataaagcttctccctgtgccaagacagcggcagaaacttccgcttggtctagataagtgttcagccatttagcaagctcatagaccactgtgatcccatttgctgcattaaaatcatcatccatttcttcgatgaatcgctgttccaaattttctaacaaagtgattttatccgcatcatctgccaaattctctgaggcagtttcttggcggaatttcaaattgtcaaacgtattcttcagtcgttgtaaattggtggctgcttctttcatcgtcgtttcactgtaacggatcggacgacggtattgtgtggtcgccatgaagaaacgcaagacttgtggatcaacgttttggatcatttcatgtacagtgatgaaattccctagagatttactcattttttcatcgtcttcgccaatcgttacatagccattgtgcatccagtaattagcgaattttttccctgttttcgcttcactttgtgcgatttcattttcgtgatgaggaaattccaaatcttgcccaccaccatggatatcgatcgtttcgcctaaatgttttgtcgccatgacggaacattcgatgtgccaaccgggacgccctttgccccatggtgaatcccaagaaatctcgccaggttttgcttgtttccataaagcgaaatctaatgggtcttctttttgctgctgttcttcaccagtacgctgacttgcgccgacttccaattcatcgatggattggtcacttaatttcccatagttttcaaatttacgggtacggtaatacacatcacctgaagattcataagcatagcctttttcaaccaacacttgaataaatgctaaaatatctggcatatggtccatgactcttggatgcagtgtagcaggctcgacattcaacgctttcgtatcttcttcaaatgctcggatgaaacgatcagcgacttctggtgctgtgatgcctaattcgtttgctgtacggatgattttatcgtctacatccgtgaaattcgatacgaaatcgactttatagcctcgatattcaaaatagcgtcgaatcgtatcgaaagcaatggtgctacgagcatttccaatatggatataattatacacagtcggtccgcagacatacataccgacatgtcccttttgtatagggatgaattcttctttttttctggtcaatgtattgtagatttttatcattctgatctcctcactttttctcctttgattcgaacgacttttgctggtactcctactgctgtagcgtcgtctggaacatctttcaacacaacggcacctgcgccgatttttgcgttttttccgatcgttaccggtcctaatatctgcgcattcgcagagagcatggctccttgtttgaccgttgggtgtcttttacctgtttcttttcccgtaccgcctaatgttacgccatggaacaaaatcacatcatcctcgatttctgcggtttcgccaatgacgatccccattccatggtcgatgaacacacctgttccaatcgttgctcctggatggatttcaacacctgtcaggaaacgccaaaattgagcattgatcttcgccaataaaaagagccgatgctgatataaaaaatgagagaaacgatgccaaaacaaggcatgaaaaccaggataggtcaaaacgatctccgctgtcgaacgtgcagccggatcgtttctctttgctgcatcaatcgctcgggcaaaccaactcatgactttccactcctttcgtaagtattttatgtaggaaaacagcttataaagaaaagaagcgccttttaaataagtttccttatcaaaagacgctttccgcgtggttccacttttcttcataatcaacgattatctctgacagctaacgcctgttatacgttcttggctacttcgtttcctgtaaaacagtttttcctgttttctgtgttttcgccaagaccactcccagaggcatttcggcaactattcattgacgccttgcaccacccggcatctctcttgtaatgatcagctgcttacttttttctgttcatcgtgtttagttcagtacttgatttaaatgtgctaatgatttctcacgaccaagcaattcgatcgtttcaggcaattctgggccatgcatttgtcctgatacagctacacggatcggcatgaaaagatttttcccttttacgccagtttctttttgaacagctttgatggcagcttttacagttggagcatctactacttccatttgttctagctgtgctttaaatgcgtggagaacagtaggaactgtttcaccagcaagtacttcttttgctgcttcattcaatacagggtgttcattgaaaaatagcgtagacagatcaacgatttctgcagcatagctcatttgaggttgatacaggctaacgatcttcttcacccattcaattgtcttttcatctgggttttctgctacacgtccgtcagcgattagataaggcagacacatgtcagtaaatgcatctagatccattgctttgatgtaatggttgtttacccattgcagttttttcgcatcgaaagctgcgggtgatttacttaggcgttttggatcgaacattttgatcaattcttggtgttcgaagatttcgtcttcgcccacaggtgaccagcccaataatgcaataaagttgaacattgcatctggtagataacctaattcgcgatattgttcgataaattgtaagattgattcgtcacgtttgcttagttttttgcctgtttcactgttgatgatcaacgtcatatgtccgaatgttggtggcgtccagccaaatgcttcatagatcatcagttgttttggtgtattggcaatatggtcatctccacgtaaaacgtgagtgattttcatcaaatggtcatcgaccgcaacagcaaagttataggttggcataccatcgcgtttttggatgacaaagtcgccgccgatattatcggattcgaacgaaatagcgccttttaccatatctgtaaatgcgtattctgtattgcgaggcacacggaaacgtacaacagattctagaccttgtgcttctttttctgcttgttcttcaggtgtcaagttcgcacatgttcctgcgtaatgaggcatttctcctcttgcgcgttgtgcttcccgttctgcttctaattcttcttctgtgcaatagcatttgtatgctcgattgctagcaagcagctgatcaatcagcggttgatagatttctttacgttcagattgacggtaagggccgtattctccaggattttcaggagattcatcccaatccattcccaaccaagcaaggttttccaactggcttttttcgccatcttcgatattacgtttttggtcagtatcctcaatacgaataataaagtctccatcattgtggcgggcaaacaaataattgaacaatgcagttcttgcatttccaatatgcaggtgcccagttggacttggtgcatagcgtacgcgtactttcgtcattttcttcctcttctttcaaactagactttgactaacagtaaaaattccgtcagttacggcttctcaaatatcatttatttaaagccactcagcacaaattttaccttttctaaggtaaatagtaaagccaactggttgaatttccttaccagttggctgaatttcttttttattttgattattttgtctttttctctgtctcttttttattgtcgatccctcgtcctgcatgggcaggtttagcaaagatcatgcgtccagcagctgtttgaagagcgcttgtcacaacaacttcgatacgttcattcatgtaatgctgtccatcttctacgacaaccatcgtgccatcatcaagataggctaccccttgttggcgttctgttccggcttttactactagaacattcatcgtttcgccaggaatgacgactggtttcacggcatttgccaacgcattgatattaagaacaggtacattttggaattcagagactttattcaagttatagtcattggttacgatgacaccgtctaaaagcttggctaatttgatcagcttgctgtctacttcgctgatatcttcaaagtctccatcgtacatttcgacagatataccttcttctttttgcaaagcatttaggatatctaatccgcgacgaccacgcacacgtttcaaactatcccctgagtccgcgatgtattgtagttcgtaaagaacaaaattagggatcatcaaggttccttctaaaaatccagtctttgtaatatcataaatccgaccatcaataatcacacttgtatccaagattttatatttatggaaattttctcctgattttcgttctaacagttggctctccacttggctagctgtttcttgctcgatttttttgcttcgtgaaccaaagactttcttccattcttcgattcgtgtcgttcccattctcaatcccaaataacctaagatgatcatcagtaaaatcggcaatacactattgacgaatggaatttccatattgtaaagaggggttgagatcacaacgcctaaagtcaatccgatgatcgcaccgatcgcaccgaagagaagataagtcaagctgacctcgcttagtttttgttctacttgtttgataatagctgagatatgtttggccaacagcaaagataataaaaagaaaataagtgcgcctaacaaactgttggtaaatgtattattcagccacccatttgactgttgaccgattgcctgccaagctgagggtaaaaatgaaatacccaagcttgcgccgacaatgatcatcagcaacgtaatgacacgtttttgcatcgtttttcctccgtttcgacaatcatttattatttagtggaacacacgcttcaacgtttcagccaaagttgctactccaacgatctcgattccttttggcgcttcccagttgcctaagttgtttttaggcaggtaaacttttgtgaagccgagtttttggacttctttgacccgttgttcaatatgactgacacgtctgatttctccagtcagtccgatttcaccgatgaaacattccgtcggctgtgttcctttttctttgtagcttgaagcaatactgacagcgatagctaaatcaatcgctggttcatttaattttaccccacctgcagcttttaagtaagcatcttgattctgaagaagtagtccagctcttttttccagcactgccatgattagagatacacgattgaaatcaagacctgttgttgttcgcttagcatttccgaacatagtaggtgtgactaatgcttggatctctaccaaaattgggcgtgttccttccattgctacaacgatagcagagccagtcgcaccgtctaggcgttcctccaagaaaatctgtgaagggttagcgacttcttccaatccatgctcatgcatttcaaaaatcccaatctcgttcgttgagccaaatcggttttttaccgctcgtaaaattcggaaactatgatgttgttcaccttcaaaatataacactgtatccaccatatgctctaacattcttggaccggcgatcgaaccttctttcgtaacatgaccgacgataaaaatggcaattccattcgttttagcgattttgagtaattctgcagtggtttctcttacttggctgacgcttcctgccacacttgtgatgtctggctgcgtcatcgtttggatggaatcaataataacataatcaggggagatatgttcgatggcacgactgatttcattcatatctgtttcagcgtatagataaaattctgtgttgatacttccgaggcgctccgcgcgtaattttatctgttctgcgctttcttcgccggatacatacaagactttcccgcctatggctgctaattgttgagaaacttgtaacagcaaagtggatttaccaatacctggatctccaccaatcaagaccatggatcccggaaccacgcctccacctagcacacggttcagttcttctaatttcgttttgacccgaggttcttttttagggacgacgtctgcgatttttgttggtttcgctttttctcctgtcaaacttgtccgcgttctgcggtctgttgtatcttgttcgatttcttcgaccatcgtgttccattttccgcaatttgggcagcgtcccaagaacttaggcgacacatacccgcaattttggcaaacaaattgtacttttgatttttttgccattgtaccgcctcctcttattctaaccatgagacattaaatcaagcttaaatttctttatcattttatttactggaagaaccaaatccgccttgacgttgagcagtcgtttgatcttgatctgcttttaaaaatggcaagaagatcccttgaccgatacgctcacctttcttgattactacatccttgaaaccaaagttggtgaattggaacatgatatgtccttcatttgccttattattgtaataatcactgtcaatcacacctacgccgttcgtcaacactaaaaaccgcttcaacggattgcttgaacggttagcaagctgcaaaaattcatcttctcccatgtaggctttgaccccagtaggcacaaggatcggttttaactgtttttcattttctgatacgtcttttttcaatgcatctgcgattgtttccaatccttttttccagcctgctttccagatacttggaatcacgacctcttctgctgcttcaaaatcatagccagcagcatgatgtgtagcgcgctgcggtagattgatattttgctctttatatttagaaataacttcaaatcctctttttctcaccggttttcctccctaaataaactactcctattctaacatattcgaggctataaaagactctctttacaaattcttcaagaaattctgctatcctaaagtcaaccattaacgcgttcttttaccaaacaactgcaagttgtacaaaaaaactattttttacatgactttactcgtcaaaacaagtagaatagaacgaaattaatgagtggatatttgattgaggtgtcacatgcgtaaagaaataaaaaatgcaaaacgaattattgtcaaagtaggaacaagtacattgatatatcccaatggaaacatcaatcttgcagcgatcgatcagttagcttttgtcctttccgatcttagaaatcgtggaaaggaagtgatcctagtctcatcaggggctgtaggcgtcggtatgcataaattacatttgtcagaacgtccgactttgatccctgaacagcaagcgacggcggctgttggccaagccgaattgatgaatatctataatcaaagattcagtgtatataatcagcagacagcacaaatcctcgtgacaagagatgtggtagattaccctgaaagtcgtaaaaatgtgaggaatacattggaacagcttttgatcatggatacgattcctattgtgaacgaaaacgatactgtcgcagtagatgaattagatcatctgaccaaatttggtgataatgatcagctgtcagcaatcatggcaaaacttgtcgcggcagaccttttgatcgttctttctgatatcgacggtttttattcagataatccggctacaaatcccgaggctcagatgtatcgctatatcgataaaatcgatgaaaagattctggcacaagcaggtggtgcaggtagcacctttggaacaggcggtatgcaaagtaaattaaaagcagcttctaggatatttgaagcaaacagtgcaatgattctagcaaatgggaaaaatccggcaatcatttttgatattcttgcaggaaaagaagtaggtactttatttaaggaggacttgaaatgactgatttgatgcaattagggcaacaggcaaaagatagtgcgcaacaactagcacttatgcctacaaaccgtaaaaatgagctacttgttcagatggcgaaaaccatcaaaaagaatcaacaggcaatcatcgaagcaaatcataaggacttagaaaaagcagtcgaaaacaatatcagtgaaacgatgcaagaccgcttacagctgacacctgagcgaatcaatgccatggttgcagagatcgaaaagattgcttcgttagacgatcctattggaaaagtagatgagatgtggacgaacaccgacggattgagaatcggcaaaaagcgcgtgcccctcggcgtgatcggtatcatttacgaatctcgtccaaatgtcacgactgatgcagccagtctagcgttcaaatcaggaaatgccgttatccttcgcggtggcaaagaagcattcttctcgaatcaattactggtccaactattgcagcaagtattgcttagtgctggcgaatctccttatgccatccagtttgtcgatgatacttctcatgaaactgcagaacagttgatgcgattgacagaatacttagatgtgctgattcctcgaggcggagcaaaattgattcaacgagtcaaagaacaggcaacggtacctatcattgaaacaggtacaggaaataatcacgtatacatcgataaagaagcacagttgtctatggcagtgaaaatcattgtcaatgcaaaagcttcccgtccttctgtctgcaacgcggcagaaacattactgatccattctgagatcgccccctttttcttaccagccattgaaaaagaactggtagaacacggcgtctctttacgtgcggatgctcgtgcgttagaatatctagagacagctgctttagcagaagaggcagattgggatactgaatatctggattatatccttgccgtcaaagtagtcgattctttaagcgaagcaattgcgcatatcaaccgacataacaccaagcattcagaaacaatcgtgacagatagctattcggctagtcagcgtttcttgaatgaagtggacgcggcggctgtctatgtcaatgcctccactcgttttacagacggatcggtatttggttttggtgcagagatcggtatctctactcaaaagttgcatgcccgtggtccaatggggttaaatgaattgacttccacaaaatatatcatttatggcgatggacaaatccgcgaataatgtttcgtgtgaaacattattcccgccttttgcctttttactgtaaaggttctatccaattagaaaggtgtcaatatgtttgaaattttaatgattttttttatttaccttatttctctgaatatcgctgcttttctaggagtcggtattttatcccttttttttcagttcaaaaaacgaagcatagggggtcaacgggaaaaatgggcgcagtattttgacaaaattggtccaaaaggtttggttgctcgcttacacatcagctacatggttgcattatgcctgttagctggagtcaattactattcttttttcgatcattcaattgcctatacgattacgttgctgattgctgggatctttcacttatcttataaatatcagctgaataaaaaccacttgaatcggactttccgctaaaaaatgtccgtatgataagtagggtgccttgaacaccggcaaaaaactgccgaactttttaggggctttgacaaagattttgtcaaagccccttttcccatataaacggtgttctcctaccagctgcctggtaaatctgtttcctcttcgttaagaagcgaaaatccgtcaaatgtttcgccatcataataacgaagcagctcatccatggacaagtccatcgttttttctttttcttcttccgctgattctgccaatagctgttcccgatacatctgatatataccagctattttttgctgcatcgcttttctagtttcaccttccgcgttgatcattggcaattctttgatatagccacgataaatcaaccgatcatctaaaaattcaatgggtaattcaacgagtgtcaacccgacttcctgaaaatattcttccagcatctattatccccccattctttttcttaaatgaattttagcttacctactaaaaattttccagttacattattttgagaaaaaaaaggaatgtgacacgatttttgtcacattccctttttccaaataaacggtgttcaaaagccagtttctcggtattaagccaaatttatgcaaaaatgtagaaagccattttcacaaaatttttcttaatacttgaaactaaacgactttttcacaacctcttccttaaacggtgttcgcctgccaactcctcggtcacaagtcacgatattcaacaaacatgagaaactgttttttgaaattgttccttgtgactcggagctgaacggcaggcttacgacctcttgataaacggtgttcaaaagattgcatctgcggtaataagtccaaccaaacgaaaaataggaggagctgtttttgtttggctgttcttatgatttgaggcaggacagctttttcacaacctttagtttcttatttttcttcatttgtagcaaaataattacggtgataaatgatacaacatacactgataagaacaatggcacctgcaaaataaaacgcatatctttcaccaatatgttcgccgatcacacctgcaataaatggtgctaaagctccaccgaaaaagcggacaaaactatagctggaagaagcaacgtttcgttgcagaccgggtatttccatagcaatcgtcgtcaacaatgtattaatgatcccttggaaaaatcctgctaacacaatactgatcggtacaaggactggcatagaagtaccagctcctaataacagcaaacaaataatgaataagacaaatgcagctaaaatcgtccgataagtcgtaaacttccgctcaagagccggtgcaacgaaaatcgaagcaatagccagaagcacaccccagccaaaaaatacaaaaccgacttctaattcagaatagccaatcaataaaaatggcgcatatgcaagtaaagtaaagaatccgaaattatataacaatgcgatcagtccaactgaacgaagtttatgattgcttaacgctttgacaccttcccaaaggcctacttttctctttggtttctcagtttcaggtaaaagtaccgctagggctataaaaccgcaaaacatcaaaaatgctaccccaaaaaatggataacgccatgaaccactgcccaagactccaccgactagaggaccaactgccattccgcagccaagtgctgcttcatacatcatgattgctttttctgtgttaccgactaaaatactgacgatcgttgctagagcagtagagacaaataaagcattcccgacaccccagccagcacgtaacccaatcaacataccgatattgccagataatccaccaagaccagcgaatacaacgatgataaacaatccggtcatcaatgtttttttcaagccaatccgactagataagaaacctgtaaatagcatcaccacaccagtgactagcatgtaactagtaaataacagggtcgtttcagctggcgtagcgtttaactgtgcagcaatcgtttttaaaatcgggtctaccaggcccactcccataaaagcgatcatacaggtagctgctacaactagcgccgaacttttcccctttgtttcttcatttgtttgttcttgtatatctatttgattctccaatatttccatccctttctctctattagcatcatacatgatttattttacatgtcaatatgcacatgtaaaacatggaaactttactgtgatataataaagaaaataagacgagaggtaggatttttatgaatactttagcctatatattattatgcgtgcttttatccaaaccgcgttctgggtatgaattgaagcagctgatcacgattttttgggaagctcatcacagtcaaatctatacgacgcttgctaagttagaccaacagggttatgtgaccgttttggacaaagacgagcattctcaaaaaaagatctaccacttgactgatgaaggacgtgcccttgtagaggaatggatcaaagaggagaccccagctcctacgcaaaaagatgaatttttagcaaaaatctatgctttttcgacactcgacaaaacaacagctactggactgctattcactagagaacaacaactgaacaaaatcatgcaaaaaaatcaaaaaaaattgaatgacctctcgctagacaagagacaagaatttggacgttatgttgtgatccagcgtcgaatcatgctttgtcagcaggaactccaatggtgtcagcaagtaagagaacaaatgcagccgttttttgagtaatggataaacagaacctttctagatttatctattaagcaacgaatcatcttcactaaaagaacgatacagctgaaaaagaaaaacgatccgaaagacaggcaaaaacctatcgttcggatcatttttctttctagaactgcattgaaggaactgtgacaaaaagcaggtcacaacctttttttcaaataaacagtgttccattattcattgctttgaatggctttcaacacacttcttgaaagtgggccaacgataatcaactgcaacggtaaagcggcaatcacattcattttccaagcattcatataagcagagaataattgatcaggtattccttgttccatgatcacaccaaacaaagacatacatgtgaccattcctaaaaccatcaagcaggaaatagttaagatcatttggatcttgctttctggatttactggtagtttaaaggcaatttttttcgccagcacaccgatgatgaagacatccaaaatgaaagccaccacgaatccaggcactagaccaatcaataaacttgataaatgaagatcttgatgcaaccataaattatacgcgctcattcccaagaccatcaaaaaacacatcattgttgtaaaaattattccttcttttttatttgtaggcaatctgtaccactcctttaaatttgtcacgaaaatcatcgtagcacatttaaaaatttctcgtaagtactttttttattttctgcccttttatttcataaacttcatcagccgtacgctcgacaaagtaggaatcatgtgaagtaaacaaaatcgttcccggatatacttgcatcagctgctctaaagcttcgatcgttgccacatcaatgaaattagtcggttcatctaacagcaacacattacttggcttagtaaaaagcaaagcaatcgtcaaacgagtcgcttctcccccacttaacgtacacaacggtttcgtcagagtttcctgagcaaaccctaaatgattcaacaaactgcggacaagtgattccgaaaactctgtttgtctcatgacaaaacgaatgacggattcttcagatgtcatttgataatccttttgctgatatacttgaaagcttactttcggagagagaaggattccttctccttgtttgcggatatgttccaataaagttgtcttacctgatccattttcgccgacaatcgcgatttttttacctaaagaaaattgaaaatcgctatttatcagtaatgttcttccgcttctttccaattggatattttgtcccatgattggataacgattgtggagttcaagagattttggtactggaaaacggatttgtttcatctgttgcggtttggttgtttctcctattttttggagtcttctctctaatgttttcgtattcttttggatggctttttgtacactgtctttttgtttagaggaagacaaccgatccggtctgatttgttgctttttctttttactggacactttttctaacttttccgcttgttttttcttttcttggatcgatttttccaatcgttttttctctttcatgatcgactctgcttctcgtagctgagtctttttctccaattccctttgagtgagataggcactataattctccggaaactctcggatttctccgtcttttacttcccagactttcgttgccaactcatctagaaaatagcggtcatgactaacaaaaatcagcgtgccataataataacgaagctcttcaattagtcgatccatactttttctatctagatgggttgtcggctcgtctagaagcatcccttgttcataagaagaaagaagacgtatcaactcgatctttcgttcttcccctccactccatttccgttccgaagtttcttccagtttcaactggaaatgactggctaattccaaatttaggtcctttgcctcagcaagataggttaattgaggcagatagttgaaagtgatctctgtttggattttcccttgattggggataagttcaccgactatcagtttcagcaacgttgttttaccgactccattttcccctatgattcctatccgatcttgctgatagacacgaagagaatcaatagataattctaactggttaccaaaacgaacttgcaggtttgttatatttactgctaaattttccatatgttttacactcctatttcatgtaaaacaacaatatcgatactaaaaaagagcagaaaaatctgtttgcaaaaaaactgcataacatcttttcctactctgaacgaaataactatgactaaatcatcaaatctgtcatagctttcacctattctactgtcgttcgaaaaaatggacatactccacccatgaaattgttgtttatacatgtcttttgaatttatttagttgttattcaaaagttcaaaacgtaatttcatcgatgcagtcatttttccgacctccttttttattaggttaccacacacgattcaaaaaaagcaatagctactgaacagtaactgaaaaccttttatttgaacgtagtgatcttttctggtgctaaacgtacagactcgtaaccttcttctaccgcttttcctattgataaaataataactggaacatagcggtctttatccaaaccaaatgcctctgccaactgatctgcttcgaagccaccaattggatttgtttcatagccatgatcacgtgcaactaacatgaattgcatagccgctaagctagaatcgactttgactacatcgttcatttcttctcttgaaaaactcttgtaataaggaatgatcgcagctaattgttgatctctgacttcttttggcatcttccctgattcgtaagcttggttatagatttcttcgccatattcataacattgcatatcgccaaaaatcatgaccattgcagaagaagtatcattttgtctcgtattgaaacggatcaaaggacgcaagatttcttttgcttcctcgctttctgcgactacaaagcgccatggttgcatattgacagaagaaggagcagtcgtcgcttctttgatcatttccagcatttcttcgtgtgggattttgtatgtttcatcatatacgcgaacggatcttctaccagtcataattgttgaaaaatcatttttttgttccattattattaacctctttcgtttctgttgttatattgcaaagttgggtattcaatttatctaaaagtgttaggaattgtttcatctctacatcgctgaaagctggggacagcacggaacctgtatctttatggtccatttcacaatactcgattttctgctgggctttttctgtcagtgctacgtaaacttcccggttgttctgaggatttctctgacgcgaaacatacccgtttgcttctaaaaccttcagatgacgagtaactgctccttgatcaatctgcaacttttcttgcaaactgctttgcagcaatggattttcttctttcagtctcatcatgatctcgtatctagtaagacttataccgatattttcctcaaagatctggacgattttttgatcggctaatttgatttgatataaaaggtggctaatctcttctaaagacataatttcctcctctccaataattgactagtcaacgattgacttgtcaataatagaataaaaaaagaaaaaagtcaaagaatcagctgtgaaattaaaaaacaaaggctttcaatagaaatgagtgtaaataaaagaaatctcttgtagaatgaaaagaaagaacaataaaaaagaaagagaggacaatgatatgagaaaaagaagattagccgcagtatttctcttagtgaatgcgacattgttacctaatagtctcgtatttgctgataccgttttgtcaaatgttcaaacaacagaaacatctgccctatcagaagatgaaagcgcaccatcccaatcaagcctatctggagagaattcctatcaaaatctagaagacagctcttctgcagtagaaaatttcacaccgccgaaaatctctggaaatccctctttgcaaggagcaaatggtagatttgaacaaatgaaacctgataaaatccacctttcagcttcaaaacaaacaaaggaatcgttcattcagcagcaatctactcatagctacattgatgcgcaaggtgtgtatgagattgtctctactgatgtccagctacccgatggacaatgtgtggataaaggaacgatccaactagtcataccaacagagccaacagaacaagtcaccaattatctggcctattatgtagcaaaaaaaatcaaaacctattctttacccttggaaaaatcagctgatttcttgatgtttgacgattcgatcactctagacaaggagcattttctttcttccgtacgtgcgtattactcggaagtttcagctgatcctatcattcaaacacatataagtatgacagaaacctatacgactctgaatgaaacagatatttatcctaccttctatcgccaagaagaacatcaaaaaatatctggaccagccctcatcacagataaagtagcgttatctgatcaaacgacttgggtacatatccaaacagcaaactatgaaggatgggtagcagcgaactctgtaactgctcatgagccaaaaacagttccagttgaagcatcacaaggtcagctttctgaatcaactgttgcctctctgtcccttgatcaagcttggctagaacaatcagaggaaaccatttcacattcagaaagttatcacgtacaaagagcagtccaaatcagcaatcaagtgttttatgtgctgacagcaaaggattcttcaatcgtttttgtcccacagaaagaattccaaccagagggttcagtatcagcagagactgattcctcaaatgaacagataggaacagctgaaagtacagcatctgattcaaaagaaacaactgattcttctttccagccgcaaaacaaagtgccacagacagatgaatctaccttgcgtactgcacgtccatctattacttatagtacacatgtcaaaaatcgtggttggctgccaaatgtttctagcggtcaactttcaggaacaacaggtcaatctttacaagtagaagcttttcgtatccatctttcatcctccctctctggtgctattgaatacacctcttatgtccaaggttcaggatggcaaaattgggtagctaacggcgctatttctggaacgactggacaagtcaaacagattgaaggaatcaatattcgattaactggacaattagcagcaacttacaatgtttattatagagtccatgtacgaaattttggctggcttccttggacaatgaacggaaatccttccggaacacttggatacggtcatcaaatcgaagcaattgaaatccaattattggacaaaaacagttccggccctgctaccaacggtatttcttatatcgaaaaggaaccatccgtattggcgaatactcacgtaactaacagaggttggttaggccagacagatgctgctaatcaagctggtacgactggccaacggttaagtcttcaagcaatgcaactgcgtttatctgaaaatacaattggtggcggtatcacttatcaatcccatatcgctaacaaaggttgggagaccaactgggcacaaaatggcacgatttctggtacgactggacaaaatctgcctattgaggcgatccgcatcaatctgactggcacaatcagcacccgatatgacgtttattatcgtgtacatgcacaagaattcggctggatgaactgggcaaagaacggtgaatcagctggtacacaaggctatgcttaccgtgcagaagcgattcaaattgtattagtaaggaaaggtggagccgcacctggtgcaactactcgcgcctttcgtatagctccacctagaatcacgttgcaaggacatgtatcgaatattggctgggtaagccaaacgagcctgaacaactcgatcagctacgcaaatcaaggaagacaatttgaagcgattcacgcaaatttaggaacatcaaggtatactggcggtatccaatatgattcacacctagctgacagcggttggaccagaactgtagccaatggagcaatctcaggaacgactggacaaaatcgctctcttcaagccttttcctttcagttgacaggagaacttgctgaaaactatgatatttattatcgtgcctttgttcgttccagaggctggttaggctgggcatcaaatggacaaaaagcaggctctgtcagaatgaatttgcctgttgaaggtatccagctaaccattgttgaaaacgaccggcggccaagcggctatcagccaaaccaactgacgattctaggacaagtgaacgatcagacacctcagggaagattcatcaattccgtcagccaaagtgcgaatcgtatcgcgcctgctcatggcttgtatacttctgtcatgttggctcaagcaatcctagaaacaggatatggcacaagctatctagctcagcacgcgaataacttctttgggatgaaattcaaagacggcgaagatgaaggaaagtatggctatatctggcatatatctaacgaagtgatcaatggtgtcgttgtccctgtcaattcaaaatttcgggtctatcagtccactgaccaatccttcttagataatgccttaaaattaagatatggtgtttcttgggatccaaaccgatatgcggggacatggaaagtcaatgcacgttcttatagagatgctacccgtgcattaacaggaacatacgcgacagatcctgattacggtcaaaaattgaataatctgatcgaatattggaagctggatcaatttgattgaacgggcataaaaaaaggttgtgacaacattcttgtcacaaccttttttgagtaaacgatggtccagaagtaccttcttcaagaataagccgaaatttcttgaagctgaccacttctgtcacaacctctaaacagtgttcaatcagctgaccctcggtattcgctcaacaaacggcaaaatatgagaaactatttttccgtttgtttctctaatactcaggtcaaaacgctgatttcacaacctcttgataaacggtgttcaatcagctgcttctcggtaataagcccactagcctagaaaatatgaaaagctattttctgactagcgttcttattactcaaagcgtaacgccgatttcacaacctctctttcacaaccttattttactcgtttataattttcatcgaaatattttccgctacggatatcatcaggcattccatcatatggtgcttcactaataacatcttcattgtctatacctgcatcacccatataagtgatcgtagcaaattcaggaacaagtaattttggataagtttcatatttttcacgagctgcttccatttctgcgatatgttcattttggtaagtaacagtgatttctggatgttcttcaacccatttagggaaaaagatcattccgtgaagtttcttttcatttggcataaagtctaatgcaacgtctgtccctgttggttctgtccaagtaattttgaacacgccatctgtcaatttaacgatatcagcttcttggtcttttacccaacgacctttgaccattccgccgtggatacggtaatcgacagtatggtcattttttgcataccattcatattcccaaccgttgtcatacgtataaataaagtgagttccaataaaatcttccaattctttaaattctttcatgtttaagcatctccctctaaattaaaacatgtaataaactacatgtttttgattacttgtttatgatagaatggatttaaagatttgtcaaggaggaaaaactgatggcaagaaaaaatacacttcgctatattttattaggattattaagtaagaagcagatgacaggatatgaattgaatcaatcattcaaaaatgaaataggagaattttggcaagcaaaacatagtcagatttatcctgagctggcaaaaatggaagagcaaggaatcattcagcatcaagtagagatcacaggcgaaaaattggaaaaaaaagtttatgaattaacagaagaagggaaggaacaattagcagagtggattcatacaccgaccaatgaactgccggttaatcgagacgaattcgttttaaaattgtatttcgtcaaagacgtaaatgatccggcattagtagaaattatccagcagcaacgtgatcttcatgaagaaaaacgccttcatctattagagcggaaaaaaacaatctttcctacagaaaaagaaaaacatgaaaattacggacattacttgattttagcgcatgcgatcaatcgggaaacagaatatgcaagttggctgacagatgtattggaagaagaaaacaaccgaaaaaaataaactaaaaaatatccgaacagtgatggatgcttcctttctatatgaaagaaatgcagatcaccgttcggatattcttatgttcaagcaggctttttctaagtgttatatgtatcatctactttttaaaaagtctgatgtttaggagattagcggagcttagagttcttttaacagctgctcgtagtcagctttttcatcgacaggaaggagtttgtaagacaattcgtctgtctcgttgtcatgaatgatgtacatcttcgcattctcttctttgaagttaccgatttgtaaaatcgtatagcgttcgtcgatcaattcgatatctttgattgcttttgaaaaaactttgcggacatgatgcattttcttttgtcggatttctgccttttctgcagctttagataaggtaaatccgtcatctaagtattttttgatcagttctacttttataactgtaggcaaacgatattttctaggacaattcgcatcagcttcgatcgaacgaatgaatcccttttgttcccaataccgtaattgacgtggagacacaccgacgatatcacttaattcactgatgccaacaaccaattgatcgttttccaacaaacgtttaagggaagccccaaccatttttgtcactccttttgtcctcttactttctttaattatatctgtattaactaatgtgtcaagtaggttgacaaatggtggatttaggactaaagtattctagtagtttcagaaaaaattcagaaagaaggagaaatatgagtaacaaccaacccgtagatatttacggaaaaccatataatcggacacttttagttgttgtcttattaattggtacattttgtaccgttttgaatcagaccttattgacgacagcttttcctacattgatgaaagctttcgatatttcagcgtctgatgtgcaatggttaacgactggtttcttgctagtcaacgggatcatgatcccaataacagcatggctgatcaataaattcagttcaagaaatttatatctttctgccatgacgatctttttgatcggaacgattacttgttttacagcacctaattttagtacattactaatcggtcgcttgatccaagcttgcggtgtgggagtatcgatgccattattgcaaaatatcatgttgtctattttcccaccagaaaaaagaggatcagcaatggggatgtcaggaatcgttattgggcttgctcctgctttaggccctacattatctggttacatcattgataactaccattggcgtgacttgtttggtatggtactgccaatcgttgttcttgtcttggttttagcattcttcctaatgaaaagtgttattccattgtcaaatcctagcattgatattttatcagctattttgtcaacgattggattcggtagtttgctttatggattttctagtgtaggtgatgatggctggggaagcttgaaagtaattggtttcttagtcgttggtgtgattttcatcgccttgttctcatggcgtcaattacatttggaacatccattcttggagcttcgtgtattcaaatcatctacatttacgattgcagctgttttagccggtgtaacgaatatggcgatggtaggggcagaaatggtcgtgccgttgtatatccaaaacattcgcggagaatcagcattccattctggcttgatgttgttgccaggtgctttgatcatgggggctatgatgcctgttacaggtgcgattttcgataaatacggcgcgaaacgtttagccattacagggatgttcattttgacagccgcaactgcaccatttgctttcttgacaaaaacgactccagttttatatatcgtgatcctttatgcgatccgtatgtttgggatctccatggtcatgatgccggtaacgacttctggtatgaatgcattgccaaataacttgatcagtcacgggacagcggtaaataatacattccgtcaaattgcaagctcgatcggtacagctattttgatcagtgtgttgacgaatgtgacaaaagcaaatatcccaagcaaatctgtattggacaatacaccattagcttataaagatcaggcaattaatgccacactgtcaggttaccatgccgcgtttatcgtagcgattatctttgggatccttggctttattattgcctttttattgaagaaaaaagaacctgttctaacgaaagcgggggataatgcatgattattggagttttgattgtcagcttgcttgcttttgctttaacgaacgtgttcgctaaaaaaacatggcaaacctttttatctttgattttcggactactcttcgtcgcttcactaagtttgatcgtcgctaatttgtccaatcactttggaatggaaaaagtaacggaaacgaaaacagaaaaaattgtttccagtgctgattcccaaggagcagatatgcttttgtataaagctttagggaatggaaaagaaaaagtgtatctttaccgaacgaatgaaaaacaagagaaaccaaaagcaactggtacggataacgaaacaaataaagtagaaaagacagacggcgatgctgaaaaagtgacgaaaactacttattgggaatacaaaaacgacatgtataaattctggttcaatattgctgataacaatcacgaatatgacagccgagtgaatacattcaaaatcccagagacatgggtagaattaagtacggatcaagcatccaagttagctgaattagtgaagaaacagcaaagtacgatggaaagtgaagcaaaagcttatgtgcaagacggtatggtaaaagcaatgactgaaaatccgcaaatgagcaaagcagaacaagaacaacgtacgaaagccttaactgctgaattccaacaacaagcattcgcgaaattagtgaaagaagcaaaaggcgaataatattttgaacaccgtgtaggaggttgtgaaaaagctgctctgcatcaagcagtaagaacaatcagataaaaatagcactccatatttttcatctgattgggcttagtgccgtagatgcaagcttttgaacaccgtttaaggaagaggttgtgaaatcagtgttttgacctgagtattagagaaaaaaacggaaaaatagctcctcatattttgccgttttttgagctaatgccgagggtcagctgattgaacaccgtttaaggaagaggtcgtgagcctgccgtttcactctgagtcacaaggagcaatttcaaaaaacagcttctcatgtttattgaatattgtgacttgtgaccgaggagttggtaggagaacaccgtttattcgaaaaaaggaactgcgacaagacttttgtcacagttccttctttttttgctatactagatgtaaaaaataggagaaataaaatgaggaaaacttattcttttgaatcaaaaatctatgcttccgaagtcggcaagggtggcgcatatattgtttttccatatgatataagagaagaattcggtgctggaagagtgaaagtccaagcaacttttgacaatgtgccgtacgaaggcagtatcgtgaatatgggcgtgaaaaatttagatggttcggtctgctatatccttggactacgaaaagatattcgtaaaaacatcggaaaagatattggtgatatcgtagtagttacagtgaagcaaaaataaaaacaagaggttatgacaaaagatgtgtcacaacctcttctttcataatggtttttcaccatctgtataataaactggttctttgatatggaaatctgttttttccaaccaatctaaaatcttgtaacctaactcttctgacatcggaaaagaagcgttgatttgtgcattggagatatggtcaacatggataccggaagtgattgtacagcttcctggaacggcatttttgatgatcacagctattttttcggctaagacatcgtctttgtggaaacgaccatcgtggctagggaaacgtacagtttggatctctgtatcacgagaaaatgtagtgactgttccgatatgtggtgtatctccgcctgttaaagtaatcaataagtctttaccgattactttaacagcagcttggatcgtgaaacctagttttgttacttcaactatcgtttctttttccatattaatcaccttgccaacgttttgaatgttcatttacaatcccaaattgatccaaaagtttcattgtatggtgatcaacaagatcttggatcgtttgaggctgattataaaaagcagggatcggtggtatgatttgcacacctagtcgtgctaatttagtcaagttttccaagtgaatggcatttaatggcgtttcacgagggacaatgactaactttcgttgctccttcattgttacatcagcagcacgtgcaatcaggttgtcgcctaaaccaacagagatacctgcgactgttttcatacttgccggtacgatgatcattccatcggtcaaaaatgatccgctggcgacagcagcccctagatctttgtttgaataatggtaatcaaacaggctttcgaattcatttagggataaatcggattccagctttaagttctgttttgcccatggactgatgattccgtgtgtttctaccatcggatattcttttagtttcttcactaggttgatggcataaatggtgcccgaagcgccacttacaccaatcacgatttttttcttccgttgtgccaattgttccattttccgcactcctttttatgatgtcaaaacagttgcagatcattcattatttcaaatatttttcccaatcttctacttcttggaattttgcacgtacaaaatgttctttcatatcgaaaggaactgtaccgtcaaagatagtttttgcactcatcccacggaaacgaatagagccaggattatattctggtaattctgatgggtccaatggatggtttctcattcctgggatcacaatgacgtctttatctccttggaaccgagtgttgaaagtccaaactacatcgttcatgtcgaaaatatcaacatcttcatcgactaaaatgactgtcttcaattctttgaaggctgataaagcaagaatagctgcttggcgttggataccttcatccgcttcgttttctttacggatctgcatgatggtcatcaatttaccgccacctgcaggaggattgtagacatttactacttttcctggaatagctttatcaaccaaggcaagaatacttgcttctgtaggaataccggccatagatacgtgttcttcacttggaccaatcgttgtttgcatgattggattgtcttttcgatgagtaactgctttgactttcactacttgtacagctggattagcatccccagtatagccaggaaattctggcattgcttttcctgagttcgtgttgatatcttcttgcattgtttcatttggcatgatttctgcttcaatgataaattcagcacgagcaatacccacttcatcgactgctacaccatcaacgatttgaataggttcgttacgcaaagctcctgcacaccatagttcgttgtagccaagtggagtggtaggtggttcgaaagtcgtaccaatggcaattgctggatctaaaccaatattgatagtgataggcattggtttattcaatgcttcaaattgtttttggaagtgaccaatgtggcgtccaccaggcatgatgtacataccgatcgtatctttgtcttctaggaccatacgatggatcgttacatcgctcattgttttttctggatctgatcctaagactacacccatcgtgatgtatggacctgcatcttcaggagtatttgtaggtgcaggcaaaatgttgcgaatatcgaagtctgcatcggtagctagatgaacgacttcttgtgctggagcgtctgctttgtctactttcacaggtttgattggattttctacagcgtctttcaagaaacggccaagtgttcgataatcatggtgcaaaatttcacctacacgtttacgactagccattgtcccgatgttcacacgtgtgccggggaaacctttgatattgttgaaagtgatagctggtccttcttgagtcggacgttttactgtaccgccagcaccgatataacggtaaacaccagataattctgcttcaggatcgatttcaatatctgtttcgtgatattgacctggaagtgtttttagttcttcgatgacttttcttaaatcatacggttgatctgtcatgagaaattcctccttagttgtctttacgtatctatagtaaaaggtgcaaaggaggaaaacaattcaacttgtttgataaaatattccttaatggaatgaatacgttttttgctaatagaataaactatgatatacttacagcgataagaaagcgcatactaaatgctgatggaaggaaagtgaaaaaaatggaggagtcgtttcctaaagcagtaaaagtagaaaatatagcgaatattttgaaagttacatttgaaaacggggaagtaaaatacgtgaaatctcattggacagaagagataaccgatgccttgcaatttggaaaaaaaggaagaggaaaaagaaaaaatcttctcgctttgtctactaatatgtggattgggactgaagtaacgattgaagcagatggaacagtattcataaatggaaaagacaaatatacaccgcaagaactgtggctcaaaggggaaaaccatattccagaattataaataggcaagaggttgtgacagaagtggtcagcttcaagaaataagaaggaatatacgaaaattgcttctcaaatttttgtgacatttcggcttatttccgaagaagttacttcaggaacaccgtgaatcagaggttgtgaccgaggagttggcaagagaacgccgtttatcgagaggttatgaaaagctgtttattcgcaaaaaagagtggtgacaaaattgttgtcaccaccctttgtagtaatcggaaaaaacgaatagctttattctgcacgcaaagcgatagcagcgtcttttttcgctgccattcgtgcaggaagatgaccgccaagcatcgtcaatacagtagagacaatcactagaatgatcgcatggacaggatttagttgcgcaacattttttagatccgtcatgctgtacaagatgctattgatagggaatgtagctagccaggcaataaacacacctagtatcccagaagaaatacctaaaatacacgtttctgcgtcaaatacgcgagtgatatcttttttccgtgcacctaaagcttttagtacaccgatttcttttgtccgttcaatcacagatgtataagtaatgatactgatcatgatcatacttgttactaaagagatccctgcaaaagcaatgaggacataagtgatagcatccatcaatccgccagtcagttcagtcatcgttccagctaaatcagtataaatgattttatcttcatctgatttgcctttattgtagtcatctaaataatccaagattttttctttgtcttcaaaattgttcggataaatcatgatacttgaaggcaagctgtctccacctaaataactaagcaatgtttgtttggtactttcgtcaactttttcagtagttaagacatttacatcactgtctttttgggctttgacgatttctgattctttgttttcattgacgatttgagtcgttaattgatcactataagcgattcctggtgataagagattcattgtagaagaagacttcacccgtaagattcctgaaatctttaattcatctgaagcattctgatacatcgcatcataatctgtattagggataaaattcccagttggaagttttgtatagtaagtattgttgtttactaatttgaatgttgtaccgacgatctcatcgaaatcaagtttttcgtcttccttcacatcaaatccaagatttttcaatgcattgatattagtattattgttgccgtctacgatcagcacgacatctgttgctgaggctggataacttccggcaagtaaagaataattatcttttaaaaagttttctttactagtgtcaagctgtgtagggaaacttgacactcccacccctgtcattgctgacatcgtgctagacaaggaaagagattccgcatcagggttttgattcgagaagctgacaggctgtactttgccatttacatcacgtaaaagattgattcctgttgtacgagtaaacccaatattattacttaaattaggatcgatgtctgttacataatcgacgtatgtttgatcgattttattcgtatgctgtgccttgtcttcttcgctgacttttgctgtgatcgttttgctgtctggataatctgctttgcttgcacccaatccagcatcgtcacgggtctggttagtcgttaccttagaaatagtgatcggaaatttcgccattgtttcagcttgtgtgttatcgatttgcttttggaaaccagaagaaagggaaaggacgatcgcgattccgatgatcccgatactggaagcaaaggaagtcaagaaagtacgtcctttttttgttcggatattgttgaaagaaagcttcaacgctgtccaaaaactcatcttcgttctgcgcaggttaaattgatcatcttttggtcgttcgatgtgaggatgggaatctgttaagattttaccatcagaaaattcaatgattcggtctgcatattgattggccagctcaggattatgtgtgaccatgatcactaatttttctttcgataactcttggatcagttccatgatctgaatacttgtttctgtatctaaagctccagttggctcatcacacaaaaggatatctggatcattggctagcgctcgagcgattgctacccgctgcatttgtccaccagatagctgatttggctttttgtgcatatgatctgtcaagccgactcgatgcaaagcatcttctgcccgttttcgtttttcgtctttagaaacaccacttaatgtcatcccaagttcaacattttcaataatgcctaaatgaccaatcaagttgtaactttgaaaaatgaacccgatagagttgtttcggtaggcatcccagtcgttgtccttgaagtctttagtagactttccgttaatcaccatatcaccggaatcataattatctagtccaccaatcacattcagcatagtcgttttaccagaaccactaggacctaaaatcgctacgaattctttttgtctgaaagcaacagacacaccatccaatgctttagtggtggtttcgccgactttataatatttttttatatcttttaattgaagcataatcacccttctcccgtattgaaatattcggtatactaataagtataccagaacaataaacgtagtatacgaaataaatgttaactgaagatgaactgcaagaaaaaatctagaaatttttcaaaaaacagagggagaacaatgaatcgtattttaatagtagaagatgatccgcaattacagttgctttaccgttctgtgttggaacgagcgggcttttcagttatcactgcactgaatggagaggatgcgctgaaaaaactagaagcgacacgtatagaattgatcattacagatatcatgatgccgaaaatggatggctatgacttgctagactcattacgtagcaccagatttgacacacctgttctaatgattacggcaaaggccgattttgaggataagaaacgtgggttcaaattaggagcagatgattatatgacaaaacccatcgatgtcaatgagatgatcctacgtgtggaagcattgcttcgacgttcaaaaatcaattacaacagtagcttgatgattggacaaacaaaattagagctggatacttatacagtgttacaagatcagcattcgttgattctgcctcaaaaagaatttctgcttctgtataaattactgtcttatcccaataagatcttcactcgccaacagttgatggatgacatttggggattagatacgaatacagaagaacgaacgatcgatgtacatatcaaacgtttaaggacccgttttgaacagacggaagactttcaaatcatgacagtacggggattaggctataaggcggttatttaaagatgaaaaaaagctattttcacaattatggatctattttgctagtatcgtcttcatttcgatcttagtgacactgctgtgttttctcggttttattttcttattgtctcggcattctatctcacctgctgaatcggctggaaaaccaacgctatacccgttattcgtctttgcagggttcagtatgatcgtgggtacaggaatatcgatttttgttgggcggcgtattctgcatccaatcagtgcactagggacaaatatgagtctggtagcaacgggagatttttcgattcgaatggatgagcatcagaaagtagcagaagtacagcaactgtataaagatttcaatgttatggtccaagaactcaatagtatcgaaacattgaggaatgattttgtgtccagtgtatcccatgaattcaaaacaccattagcaacgatccaaggatatgtacaattgttacaatccccaaatctctctgacgaagaacgccaaatatttttatatcggattatcgaaagtatcacgcagctttcacaattaacagagaacatcttaaaattgaacaaactggaaaaccagcgtatccaactggaaaagaaagagtaccgattagatgaacaaatccgagaagtaatcgtttttttgcagcctaaatgggagaaagaacagctagaattggatatcgaacttgctgcagtaaattacacaggcaatgaagagtttttgtaccaagtgtggttgaatatcatggataacgccataaagtacaatcaagtcaatggacagattcatatcaaactatttgagacagccacagagattgtactggaagtgaccgattcaggtgtaggaatgaatgaagagaccagagatcgaatgtttgaaaaattttatcaaggagatacaagccgtcaaatttctgggaatgggctaggactttcactggtcaaaaaaattctagaactgcatgatggacgtattgattatagcagtatcgaaggagtaggaacgacagcaatgatacggttaagtaaacaataggaaaaagaataaaaccccctaaaattctattgaaagtttttaggggggtgttttttaaaaaaagttattttatttgtgtttaaccctttatattatgaatattttttatatgattagttatttaacgtttatgaatctaaaacgtttttttattatttacttttattatttatcaaattaaatgctatgattttcttgtgaaaaggaaaaaggatggctgttgaagaagaaaaaggaaaagttaatgtgcttatttgcaatacgaataatgaagacgggcaggaacaattttgtgaagaagcttttttataaagaatggaaaaaataggaaataaaaataaaaaaacaattaggagtcttccatgaaaaaatattttgtagctggtttgtcgtttattgtctttagctcggtgggtttgcaaaatatgactgtttttgctgaaagtcaagttattaaagaagaaggcacagttaaatctgaagatatctctcaagaagacattgaaaaaattgataacgtcacagctaaagatgtggttgaacatgcaaaaaattaggttataacccagaattaatatggacacgtcaggaattgcaagaagcctatcaatcaattcagacaagagctggtgtaaatagactaattactatgagtaatgatttaaaatatttgtatatgagcagttttacagcaaaattggctctttctggaggggctgcagcagttgctgcattgtttcctgggattggagtttcaataattgccacagcggttaccattattattgcagaaagaattaatcttgacagagggattattgttagactttctagaaataaaacaacaaatttacttgttcctacagcagtatggcaacagggatgagggctcaatccattttatcaagtgtgatttttgtgtttggtctattttgggcaggagtaggtgatggagatttttctttagacaatttttttgtatttagtggcttgttcttactgttctttaggcataaaatcgctgctttcttattgaaatacgagaaatgatagatgtgtcattgaaacaaagacatgatgcaaaaaagagagcgaaagtcatgagttgctctctttttggatggatagatagacagaaaatgaagggcttagtgttcttcttgtctcaaatactcccaaaatgtatctgaagccaaagaatgttcaccgattttacgcgtaaatgcgagataactttcttttgttggagagatggggaggatcacagtattttcttttaacagatttctgactgttttttccataacaatagcaatccccatgtcatttgcaatcatattgatgatcaagtcgatcctagatcctttataagagattctcggttcaaatccagcttcgcgacacaagttcagcacaggttgatacaagttcgtagtagggccaagaaccaaaaaattttcctttttcagttcacttagatccaatttctttttagcagctaaaggatgggttttatgcagaactgctacaaaatcgtctgtttcagtaggtagccactcaatcgaacttggtggggcctggaagcttctggcaaagtggatcgtatcactatgttcatttgtatcgtcgtaagtcagttcgatactttccacttctttcaactggaccgtaaattcaggatggcgtttcaaaaattcggtaattttggaaaagccttggtaattgatcatggttggtatcgttaagatatttaatgaaagattgttttcttgcgtataggtttcaagcacttcttgcatggcatggtattgttctacgacattttttacataagggagcaacaagcttccagcttcggtcaactcgatttttctatgggcacgttcgaataatttgacgtctagttctgtttctaacgaaagaatctgtttagaaatgtttccttgggtggtgaattgtcgttcagcagttttggtgaaattcattgtttcggctaaatcaagaaaaacttcaaatttatggatatccatcatattcctcctacttattccaataaagaatactttaacacaaaaaatgaattggtgtaacctactctgtctggtacaatctttcttgcaatgaaagcaatgattgcagaaaattttctgtaataattttcgctttatagagaaagagaggagtttttttgatgccaactggagttttgatcaatgtaggttccgttttgcttggcggactaattggcggattagtaggaaataaattaagcgaacactttaaagcgcagctgacgatggtttttggtgtgtgttcgatggggatggggatctattccattgcgccaatgaaaaatatgccagctgttattttcgctttggtgataggaacagcgattggactgattgttcatttaggtaatgggataaacaagggtgctgcgttgatgcaagtacctatttctaaaatcttccctagcgaaaagcttggtatgacccacgatgaatttatcagcacattagtgacggtcattgttttattttgtgcaagtggtacggggatttatggaagcttagattctgggatgactggagacagtacgattttgatttctaaatctgtccttgattttttcacagcagcaatttttgcatgtaatttaggatatgtcgtttctgtagtagcgattccccaattcattattttttatatcttgttcttattagcaaaatttatttatccattgactacaccagatatgatcttagactttaaagcttgcggtggattcttgatggttactaccggttttagaatgatcaacgtgaaaatgttcccagtagctgacatgataccagcgatgatcgttattatgccactaagttggatgtggacgaattggattatgccactgttataataataatcaaagagaagccattttttactgactaaaagggatcaaaccttttagtcagtttttttgtatttgacaaactgattttgaaactatattatatgttgtataatatagattggaataaaatattacacttgagaatagaaggtgacgtaatgcacatccagattccaactgttcttcttgatggcactgtgttagcagcattaagcaaagaagatatgtatggttatgccttaacaaaaatcgtacaagaaagtctctcagtcagtgaatctacactgtatccggttttgagaagattgaaaaaagaagggtatcttgagacctatgatgaaccttttgaaggcaggaaccgtcgatattactcgttgacacccataggaagtcgtcatttagaagaaattattgatgaatggattgtttttcgagattctttagaccggttattggaggagaacacaaatgaatgattatttgaatgaagttgtggatcatcttcaagaaattcctgaagacgatcgttttgatttgatccaatattatgaggaatattttttagattccggaaaaacattagatcaggtcattgatgaatatggtacaccaaagcagtttgctttaaaattaaaaatcagttacttttcagaagaagaacaagcagaagatgagttagtgagaagtccaaaaagacaaatacgtctgatttggttaatcattatcggtttatttgcttctcctgtcctcattccactagcattggggtttatattggttattgggggactattgattgctttgctggcgctcatttttagtatctatgtcctatgtatcagtatcttaggtattggcttattcatgatcatctcaggaatcagtgtgtttggtcaatcgattctgagtgggttgttctttatcggtgtcggtctgttcgccacgggaagcgcagtatttatttcgccactgttgctgaaaggaacaaaatggcttttttatgtcatgatgaaatttgttaaatggatggggcggcgttttattacaaaaagagatctgcattcagcgggcgtttgaaggaggacagataaatgagattaaaacattttttgattaccggtattatcctgatggttactggcggactcctagcaggtgcaacttatacattaggcgctcaaaagagtctgacttgggataatggtcctcgattgatcaatatggtgacggagacgaaaaaaatcaaagaggcaaacaaaatcgtcatccatgcagaacatcaaacagtgtcagtcatacgcggattggattttgagataaaaacgacctacgataagacagaaaagccagaaataaaggagaaaaatggtgtattgaccgtgaatgcagtcaaaaaatcagaaggtgcgattattggtttggaagacaccagtgcacaaatcactattgttgtccctacagatcaggaattatctgaattgacgattgaagggaataatagtgcgattgacatcaatgaagtatcaatcaaaaaagtgaatactacgacacacgatggttgggtatcattcaatgaacttacgggaggaacaataacggcgaaagatgaattaggttctcttcgtttagatgaagtcaaggtggataacttgaccgtcataggagaaagcagcaatttacatctagaagacagtttggtcagtaaagaaggaaaagttactctaaacagtagtaatttatctttgcatgagatggaaaacagtggctatactctccaaacatctggtgaatctcatattgaaaaagactaccagccaataacaaatacgttgttagagcaaggacagaaacggttgaagattactgccaaagacacttctatcaatatcatgacagatcaagaggacaatgaaacagattgatctagcaaacaactggatagtttaagaaaaaacagcaaagatcggaaggatctttgctgtttttcatcgcttaacacacataactatagtaaaataagtaagaacatatctataaagaaaacagggtgaaaaagtatatgaaggcagaagaaggtcaaagagaaaagttaaaaacagaaatggaaagattacatacttatatcactcaactaagtcaaaccttctatgatccagataaagaaaaagtgatggtcaactatccgaacaattcagaaggtcgtcaattagagcaagtataccatgaagttttcaaacatttattgacggtgaagaaagaactggactattattctttaccgattatcgatacaggaatattgaagtatgatggggagaaggaacgatttatctttaaatctgttcgggaagatttgcctctttcagcagggatggatctagaaatcttggtagaagactattttacagaagaaaaacactggattcgaacaagattggattatttgccgcaagcagccggaggaacacaggcaagcggttggtacatcactgaagacaaagatttggaactagaaggtgcaatggcgcgaattcgaaaaaaggattaaaaagcaacgctatatatttattgaaggataaaggagcgcagaaagtagaatgagagaaaaaagagcaatttatatcaatggttatgcaggaatcgtcggtttggtcgtattagctttagttggtttatttttcttctatttaggcatgtggcaagcgaaagtttgggcactatttttaagtatttttctttggttgatcgcgttactgttgctaagttcggcaactgtagtcagtcctaatcaagcaaaagtgattttgttttttggacaatatttaggtacgatccgggaaaatggctttttccttacgatccctttggcacaaaaaatgactgtttcgttgaaagttcggaatttcaacagttctgttttaaaagtcaatgatttagacggaaaccccatcgaaatctcagcggtagtcgtgtttaaagtcattgatacagcaaaggcattattcgatgtagcgtattatcaagattttgtagaaatccaaagtgagacggccatccggcatatcgctagccaatatccgtatgataccttcaatgatgatgatttaacgcttcgaggaaacactacggcagtgtctgacgagttgaaaaaggagttgcaagagcgtttagcagtagcaggtgtcgaagtaatcgaaacacgtttgaaccatttagcctatgcaacagaaatcgccagcgccatgctgcaacgtcaacaagcaagagctattttgtctgctcgacaaaccattgttgaaggagctgtcacgatcactcaaatggctttggagcaaatcgaagaaggacaagaaatcaatttcaccgatgaccggaaagtccaattaatcaataatttacttgtctcaatcattacagacaaaggaacgcaacccgttatcaatacaggcgacatgaaagaccgtaagtgacatactttttgtaaaataggaagaaggagtttaggacgattgtcttaaactcttttttagttgtttaaagaaaatgacaaaattgaaagaagaatgatagatgattcgaaggcagaattgttcgtttttttctataatcaatatataaagtaagagagaaggaaaaaaagtgaaaaaacttctgatcggactacttgttttcatcgttgtggcacttgcaggggtgaaaatcgcagattacgtagtgatgggcggagaagaatactatgtacagattacgacagatggtgcaaaaacagtatccaaagcagactctggacaagaaacagtcaactatagatatatcctgcctggttatacaaaagagggtaaggaaaaagaactagatttcaatgggcaattaactcgaccgcttcgtaaaggagcatatttaaaaatcacctggaataaaaagaaaggtgtcacttcatatgaagaagtcgaaaaaaaagatgtgccgaaaacagcactagaaaaactaattaaagggtagggaaagaaatgaacaaaatagtcgaagtacagaatgtaacaaaagtatacgggaaaaacaatgagaaaaagacgcaagcattaagcggcatcagcttcgatgtagaaaaaggtgaatttattggcatcatgggggcttccggttcaggtaaatcaacacttttgaatattttatccacattagacaaaccaacaaatggacatatccgaatcaatcaaaaagatgtgacgacattaaaaggaaatcaactagcagattttcgtgcgaatgaaatcggctttattttccaagatttcaatttattagaaagtttgacagcacaagaaaatatcgctgttcctctttctttacaaggtgtcagaccaaaagaaatcaagcaacgtgtccaaaaaattgcagaacgtttatcgattgctcatattttggaaagctatccttctgagatttccggtggacaaaaacaacgggtcgctgccgcacgtgcgttgatcacccaaccaacgattttattaggcgatgagcctacaggtgcgctggattctaaaagtgcccgtgatcttttagatacgatggacgaattgaatacaaaagatcatgtatcgattcttctagtgacacatgatccgttttctgcaagttattgccaacgtattttattcatcaaggatggcggtatccatcaagaagtgaaacgtggagatcaaagccgggattccttctatcgggaaatactatctattcttggaaacttggaacagtagggggagattgactatgctttggaaattatcacttactgggatcaagagccgtttaagagattacttggtattattctcaggattagttatggcatctgctattttttacatgtttgaatcaatggcgagcaacgaagcctttttgaaaagtaatacgatcgttgcagctacagttatcattttccgactaggttctgttttactagggatcattaccttcgtttatattttgtatgcgaattcctttttgatgacgatgcggcaaaaagattatgccatgtttatgatgctaggagcaaaaggcagaaaaatcgcacagatgattttttctgaaacattcgtagtagggatcgcggctactttagtgggttcagctgtcggtgtaggattgacaagtattgtccaccaattattagtggatcagttagatatcaatatttcgcattttacaccttttagcattcatgggttgttgatcaccgttttgttttttgctattttgtttttattagcagctattgttaatgctttttcgattgtcaaaaaaccgattttagcattgattcgtgcggatcagacaccaacaagaatcaagcagcataaattcttgttcttccttgaagtagtacttgggattgcttttctaggctgcggttattatatgatgaagcacgtgaagacctatcaagtttttggtatgggagtagctctagtcacgatcgtgttaggaacttatttcattttccactctgtgatcattttcttcttatcattactaaagaaatcagaacagatttcattgaaaaaattgaacaatttcacattgtcacagttaagttttcgtattcgtgaatatacacaaatgctctccatggttgctatgctgtttgctttagcacttggtgctttgacagtaggtctaggatttagaaatgaaatttcggaaatgacggaaaatgctgctggttatgacctagtgatgaataatcctcgggcagaagatcagcaaaaaatcaaagaactatcaccaacactttctgcttcttatactcaaaaagaagatgcgggaacgatttactataatgcaagtgaatttgtggctcaaccattgattatgataaaatatgaagatggaacaccgccaaaaatcacgaaagaaaaagttcctgctgaaaaaatgaatgaactgactgtacaagatgagcttcgaggctatgaattgcctgagcaacaagaaaaagaaatcaaggtagtcagtcaatcggaatttgatcaactgagcttgccacaatccactttacagctagttcaggtcaaagacttccaagcaaacttggaaccaatcaaagcacttgctacacaaaataaaacgaacaatccatctttgcaaaaagtagagtacagtaaccagaagtatgaaatgtatgaaggatataatagtctattctctggttttgaatttatgggattcttcttaggtttagctttcttgactatgcttgctagctgtttgatgttcaagatcttgtcaggaagcaagagtgacatcgctcgttatgaaatgcttgaaaagataggaacacgacgcggattgcttaaacaatcgatccgtagagaagtaggtgtgttattcttagcaccaggaatcttaggtgtagtccatgtcttattcggattacaaatgtttggtctattcatgcaaaatccatacaaagatatttgggtgccatttacgatcttcttcgtattgtatttcatctactatgtactgacgacatggttgtatactggaatcgtattgaaaaagaggttgtgacagaagtgatcagcttcaagaaatttcggcttatctccgaagaagctacttctggaacaccgtgtgttcggaaaaagaggttgtgacaatatttttgtcgcaacctttttttctcggtcttttattagaatatagtaaattttttctcgttactcacggaataagctgttaagaaagcggtttccatgtatactggaatcagtacaaatgaaagaaaagaggttgcaaggaacatggaaatcaatgaacaaaattttggcggaaactatcacttgatcacgatcacgaatcaaaatgggacatctttgtctgtcagtgatctaggtgcacgagtcgtccattttcaaacaatgatcgataatgaaaaacgagagttggttctaggctttgatgaagcaaaagaatatctggaaaaagacccttatattggagcttcaatcggacgtatggctggacggatcacggatggcacattcaaattagatgatgaaacattcaaagtaaaaacagatccagatactggacattgtttacatggcggtgcacctagctttgaagccaagcagtggcattatacagttattaatggtgaaaacgaatcctcggtcattttctatcagactagtccagacatggaaaatggatttcctggcacgttagacgtagaagtacggtatacactgacgaatgatgatacatggcgagtgacagtccaagggatcagtgaccggaaaacggtattcaatccgacaaatcatgtttatttcaatttaactggtgatccagcacagccaatcgacgaacatacgttttggttgaacagccgattattcgctacgctcaataaagatacgacgcctacaggagaagtggtttcagtaagcggtacagcatttgactttcaacatcctaaaaaattaggtgaggtattcgccagtgattttcgccaatcaatgatggtaggcggtatcgatcatccatttttattgaaaaaacaacccgatctgctaaaggcagcggaattgacgagccctgatgaaaaagtatcaatccaagtaaaaacggatgcttcgggaatcgtgatttttaccgcaaattttggagaagatgggccaaaaatgcgtgggaagaaattagtaaatcatggcggtatcacatttgagactcaagaattgccaggtgcggagcggcttgaaagctttggagatgtcactctggaacctaaccaagtacgcgaatttgtaacggaatacaaaataaataaatataaagaaatagagtaaattaaaaaagggaatgtgacactgtcacacgcccttttttatttattctatttctttaaaggcagatcaagccagaatgatttgtctaaacttaacaaagttagtaccggaacagttgcagctttaactgtacgagtagttgtttctggtatctgtcttgccgtgaaagtgttccacaaatcccagattgaagcgacacggaagatggaagcagcattgttgacgcgttttatcgttgaaaattctaatcctgtgattggcacgccatctgttgtccatttgattggcacatcgaatcgcttagacatatggaggatttcagtgcttgcttcttcagttgttgctgcttcttttttcggttcgtcatattttgtcaggtcgtacgcttcgatgatcgcgttcaatttttgtgaatattggcgatctgtagcataacgtccttccaaatatttggttgcttctttgtagtcttttgtttccgacttccaagttggtttgtagaagtcaggattgccagtcagtccatttttgatcaagtcggcatagtcttccaaactttccttgtaagaaggatacttacggaattgggcgcggatttggtagctttgtcccgaactatcttgttcaagtgtattgaaggtcacgctgcttcctttatacgatcctttgataccaaaaaggttatgatttggttcgcttgataataagctgtttccagatccactttcaaggatagcttgagccatcatgactgatgcgtagattccttctttttggccgatttcctgtgcatcatctgcaatctttttcaggaactgatcagttgtttggttttgactgaaatggaacgagccatctaatccatctaaaatagatgagccgcctgtcagcgaacctgaagcagcaggtaaacctgctaagtttactcggacagcaaaatcaggcgtgaaatctgaaatagaagttactcgaactttatctcctggttggggcgcatggataaattgtccgttcccaatatagatacctacatggtgagtaacaccggaagaaggtccccagaagacgagatcgccaggttgggcctgacttactggaatctgcgtacctgcatattgctgttcgcctgtccagccaccgatataatgaccggttgctttcatatatacgtaataagtcaaaccagaacagtcaaaagtatttggaccttttgctccccatacgtatggttttccaagatgcttgaatgcttctcgaacgattgcttgttggacattcgttgcatttgtaggcaatacagcatcaattggtgattttacaacaaaatcagaagaagcagaagatggattctctatactgctttgatttgctgtatttggacgagacgaagcattgtttgttccgccattcgatgaaccattgtttggatggtttggttctctctgagtatttccattgttattcgatccagatgggtttgtttgattcgaagaattcccgctgttcgaattattgttattattgtttgaattatttgaaccattattattgttgttattgttgctattgttgttattaccctcatctggtttatttggcgtttccggatctggtgtactagggacttcttcactaggatcagttggttcctctgttgaagtatccggtacaggttcaaattctgcagtaatagataaattgttcgtacctactgtaaaagtctttgcctcatagttcacttctttagcaccattcacagcgactgaagcaatttgttcaccttcagctggcgtaatagtgtaagtcaccttcattcctgctgataaaccttctaccgttccgctttctgtgatattcaaaggttgctgttcagcggtatcctctgacgaagcagttagttggatcttcccaatcaaagaaggagcaatcgtaagggtatatgtctcggctggcttttcattttctgatggatcagccggatcagttggttcggtcgattctgttgatgagtcagttgttccggttgtgccttctgcagaagaatccgttgtttcgctagtagctgagctggaagtagatgtacctgttgtgactgtttgatcggttgtttgattatctacagcaaatacggcattagtcgacaaaacagtaggagcaatcagccaagtagcagctagcaaacgcatcgtttttttgtttttcataataaactagtccttttcctttcattgattttctgttttattcagcattcataagttattcgtttgaacagataatcgtgtcgaaaagctttttctttccatgaatctgcttgagtattctaaataaaacaagttgtaaaaaagcaacgagcagtcattcgttgtggtttgatgttcattttattgcataaaccatctttgtttggggataaacaagtggggataaaaatggtcatgcatatgtaaattataccaaagattggagagtatcacaaaaaatttataaaaataacgatcctaaaaaagaaaaaaactgaaatatgtgataagcatctcatacttcagtcttttttcgttcattattcgtaagacatcaggtcttcatcaaacccgctaacaagggtggtgatcattgctacgactagactaacagccaatcctgctaagtaccagaaaaaagtaccggaaataaaggctggcaatgtggtcagactaccaaatacaaaagcgatcgctttcacttgagcaaatcccatgacagctccaccagcagctgcaccgatgcaagcagcaacaaatggttttttcaatggaatcgcgattccgtaaacagtaggctcggtcactcccgcaagtaaaatcgaagcgaaagcagaaccggagatcgaacgtgtttttgaacgtttacttcgtaggaatacccctaaagctgcaccagccattccaaaattagctgctcctgtcaacggaacgatacggtcgaacccataagctgagatattgctgatcatgacaggatttacagcccattggataccaaatatcaccaaaatgttccagcctccagcgatgattgctccactgattggaccgttaatatccatcatccaagtaattgctgcagctaagccttcaccaagataaacaccggcaggtccgaagaccattaatgtcaaaggaaccgtgatgactaatgaaagtaaaggtacaaatactaattgcatgttttcgcgaatatattttttaaggaatctttcgacaaaagaataaaagaaaatacctaaaatcgccggcatgacagtagacgtgtactgcatcagtactacagggatccccagaaaatcagtagctgcttttccactatctgaaagtaaagaggtcaaatttggctcaatcagcgctgcagcaatgacagccgcgatatatccattcactttaaacgttttggcggcagaaaaagcgagaaagatgggcagaaaataaaagacagcattcgacgcggcagacaaaatatgataagtcccgctcgtttcactaagccagccaatcgtagtcgctaaaacaaccagaccttttaatataccagaaccggcaaataggggaatgattggcgtaaagatttccgatatcaaaccaaatagtttttcgatcggatttaacttttctttcggagctgaatgatcgatttgacgtgtcaattccttataagcaggggccaatccctgatccataattacttctgcatatctatcgagtaaaatgaaatatttgatagaagggatttgctgctttaatttttctacatttgctgctggctgtttttgtaatttgatacgaagccgagtcgcacatgggaggacagaatcaatattgtcttttccccctaactgatcaatcagcagatgaatctgttcggacagtaccatctgttcaggattcattgtcgtttccattagaagaccactccactcactaagataatattggcataaggtgtcatctcgcctgtacgaataaatgcatggcagttattcaagtcttttttcatttcttcatgtgggataaagctaatcggtgtatctggtaacagtaatttgattttttccaatatttccggattcattgtctttatttcttccgccaattcaatggattgtacttcaagttcttctaaaacgttttctaaaacagataaaaaacttggaagtccatttgaaacagctaaatctattttttcagtaccaaagggaacaggcatgcctgcgtccccgatacttaatttgtcaaagtgtcccatttgcgcgattactcgtgaaatatctgaattgattacttttccttttttcatgtttgtttcttcctctcgttgttaatttatgactgctgattgttctaaagcttcacggtaagggatagaaggttgcgcaccataagactgtacggcaatagaagaggctagatttccataaaggatcgcttctttcaaattaccaagatctggctgaagtgtgctactcaatgccccaataaatgtatcacctgcggctgtcgtatcgatagcatctactttaaaagcagggacgataccttgttctttttctgtgtggtagaaagcaccggtactacccaatgtaatgattactgttccgatgcctaattcatgcattttttcagctgctgcgaccaaactgtcatggtctgtaactctgattcctgtaataatttctgtttctgtctcatttggtataatgatatctgtcttttcgagtagttcagtaggaatggtttctctagctggtgcaggattcaggatcgttgtttttcctgcgtcttttgcaatagaaaaagctaggatcgtcgcatctaaactactttcgaattgagcaataataaagtcactgtttgtaatcaattctttgttctttcgaacttcttgttcatggaaagcattatttgcgcctgcatgaatcaagatactgttttctcctgctgcgtccaccataatcattgcttgtccggttgcggcgccctcaatttcagcaattccagatgtatcgatattttctttcgtcagtagatccaacaattgctgtccttcactgtcagttccaacacctccaataaaagatgttcgtgcgcctgaacgtttggctgccactgcttggttggcgcctttgcctccgccagcgtgaaaaatctcatgtgcatgcatcgtttctcctggttttggcattttggttaaacgaagggtagtgtccatattaatacttccaattactgtaaccgtgttcatttcacaaacctccaactatctcattcattttgatgggaagaattattttttaaaacgttttagtaaaacgttttaatagttcgataaaaatatagcacaccttgaaagctatttcaagggtgcagtcgaaaatcttttttctagtcgtacaggtagccgtttttcttcccactctttttctgggaattggattcgatctaacaataattgggcagatgtttgccccaattcgaagattggttgtgcgatcgtcgtcagttttggcttgatatattcgcacatgtctatattatcatagccaataatgctatagtcttctgggatgctttttccagcttcctctaatccgcgatataatccaaaagctaattcatcatttaaagcaaacacaccagttgcagcagaatcaagaagtttggctgtgatttggtagccgccttgttttgagaactgtgtaggcaagaggatcagacggtcgtgagggatttggtaaacatcaagagcagatttaaacccatcaattcgagcgtggacattttctggcagattttcaggatagataagggcgatcgtttgatgtcctagactaagcaggtgcatacctgccagataaccaccgcgaaaatcgtctgttcgtacggcatcactaaatccttcagattttttttgatccaaaacaatgaagggccggccttgttttttcaaattttcgttgattgcatctgtagagacagcagaagtcgcgataatgaatccatccacacctcgacgtgtgagttcggctaggtactcgatttctttttgatgatcagaatcagcattacataatatcgtgacgaagttctgattgtacaagatatcttcaattcctcgcatcaatgtactgaagaatggattcgtgatatcaggaacgagtacgccaatcgttttcgtttccttggtaatcatttgtctagcaaaataatcaggttgataacctaattcttctttagcagctaaaactttctgaacggttttcggactgaatttctccgtatttccatttaatatcaaggagacagttgtgattgaaacgccggaaagtttagcgacttctttgattgtaatcttttttttcaccatgttcatactcctatctaaatcctgtggttattttcccatgaaatcaaaaagaagtaaatgaaaatcatatacgctagtaccctatttactttgttggatcgcttcgattatttgtttcgttgagcgtattcgtgcagttttcggaaatatcttgtttatgaacaattgatgcgattctttgtcgcgatcactacaagcatcttcagcaagtacgacatgatacccgtgttggaaggcatccaatgcagtagcgtatacaccgtttgttgtcgctacaccgcttaaaatgatggtttcaattccacgacgacgaagttgaagatcaagagaagtaccaaaaaaagcacttggattgtattttgtgatagtcaacatattgtctgtatctttcaaagaatccttcaaaagtaaatcagtgaattctggaggtacagaagcagcagtcattccacccatatcagtttgttgactcaaataagggaaagtggagatgtctacattcactaaaactttcaaggcaacggtatgtttcaatgcttttgctaacaaatcattgtttgtcagaatagatgctgcagtgtgtggagagagtgtaccgttatttacgatccctttttgcatgtcgatcgcgacaaaagcagtttttgataaatcaaaaatcatattttcctttaaatcattcatgatgttccttctttcaaataacaatgttttttatgtaagtaaatcataaatcgtttatttgtcaactaaataaagaattcctttctttagtctagagaaattcaatggtaaaataagtgtgagaaaacgtattcgatgcatagataaagcgagaaatatcgtgaaaatggaggaatcagcgtgaagtatgtcgaagtaaaaaatgaatacaaacgatacaagatgggagaaacgaccattacagcaagtgacgatatttctttttcaattgaaaaaggcgaattagtgattatacttggcccaagtggagcgggaaagtcaacgattcttaatattttaggtgggatggacacacctgatgaaggacagatcattattgataacacagatattgcgcaattttcagacaagcagcttactgcttaccgacgaacagatgtagggttcgtcttccaattctacaatctcgttcctaatctaacagcaaaagaaaacgtggaattggcaacggaagtttcccctgatgcgcttgatcctgtagaagtattgacgcaagtgggcctagctcatcgattgaataactttccgtcccaattatcaggaggcgaacagcagagagtttccattgctcgagcattagccaaaaaccctaaactgcttttatgtgatgagccgacaggtgcactggattttgaaacaggaaagcaagtattgaaattattgcaaaatgctagcagacaacatggcaatactgttttgatcattacacataattctgctttagcgcccatcgctgatagagtcatccacatcaatgatgcaaaagtaaggtcagtggaattgaatgagcatccttcatccattgatgagattgtatggtaggaggattttatgaaaacaaaaacatatcttaaagcaggttttcgcgaaatccggcaatctaaagggcggttcattgcaatcatccttattgtcatgctaggaacacttttatttgtaggtgtcaaaactgctggacctgtcatgcaaaaaacgatggaccactatgttggtacagcaggactttctgatttgcaaatcgtttctactggtggtttgacacaaaaagatatcgctcaagcagaaaagatcccagatgcaaaagtagaaacaggaaaacagatctattattccaatactggaaaaaatgaagtgatccaaatcttttcttataacaaaaatagcaggcagaacaagctacaattaattgatggaaaacgcccggaaaaacccaaccaacttttattagatgaaaaagcggagaatgcagggtataaaatcggagatgtctatcagattgattcagatgaattgaaagaaaaagagtataccatcactggctttgtccgttctccattgttcatcaacaatttggagagaggatacgcgaatgtcggaaatggtagcgttgattattttgtctatttgcctgaatccaatttcaagtcggatatttattctgtcttatatcttgattttacgaacgtaaagaatttgaatacgtacagcaaagcttacaaagataaaatggagcaaaatcaagaaaaggcagaaaagtatttacaagatcgacccgaagaacgcttagaagagctgaaaaaatcggcaaacgaagaattagaaccagcacagcaaaaaataacagaaggcaaagcacaaatagcgcagggaagaacacagttagaagatgctaaaaaacaggtagcgcagcagtcagcagctatccagcagcttcctgaagagcaacggacaatcgctgtacaaactttgtctcaacaagaagctcaactcgctgatcaagaaaggcagttagttgagaaagaacgagaactagcttctgcagaggaagaatggaacaaaaatgcagaaaaaattgaaaatttaactaaaccatcatacctatacaatgaacgttcagaaaatgtcgggtttcaagaatttggtgatctggctgaacgtatcgcagcaatcgccaatgtttttcctgttttctttttctttattgccgcattgatcacttttacgacaatgacgcgtatggtagaagaaaaccgtagggaaataggaacattgaaggcgttaggttatacgaaagttgaaatcgcaaaaaaatatgcaatctatgcaagtctagcttcaggaataggcattgttttaggaacgatattaggaacgaatcttttaccaagaatcatttttgaactatctaacgagcgatatgacattgggagtgctcttgttttttatgactggccaccgattttacaagcagctgccgcattcttcattgccgcatttggcgctgcaatgattgttttgttcaaagatctaagagaacggcctgctgcactgcttcagccgaaagcaccgaagccagggaaacgtatttttcttgaatacatcactccgctgtggtcacgccttagctttaatcaaaaaatcagttatcgaaatctcttccgatacaagtcaagaatgcttatggcgattatcggaattgctggctgtgccggtctgatggttgcgggcgtgggattgagagattctctaagttctgtctcagccaaacaatttggaccgatcattgactatcaagcaatcgttacattagattcatccacggaagagagtcgtcaaaaagcagtggatatgttgcagcagcaagaaaaagtaaatgagatcctagctattcatactcaaaccgtagaattgagaaaaaaagggcatgcttcgcaaagtctgacagtgatcgtaccgagtaaaacagctgattttgatcgttttatccatttaacaaatcttgaagagaacccacgttccttacctaaagcaggaatcgctattacgcaaaaagcagcagaactatttgacttatctacaggagatcatatatcgctttatgatgaaaatcaaaaagaatggaaagtcgaagtaaaagaaatcgtgaaaaactatctaggcagctttatttatctgtcccctgaatattacgcttcagtgactgatcaatcgatgacggataatgcatttttggtgcgtacagataagatgacaacgcaagaagaagaaatgctttccgagaaactgcttgctacagacgctgtgacaaatacgtctttcatgtccaaacaaatcgaaacgcaagaagaatcaatggcaaacttagactcggttgtattaatctttgtcgtattgtcaggattgctggcttttatcgtcttgtataatctaactaatatcaatatttccgaacgtgtacgcgaattatctacgataaaagtccttggattttttgataaagaagtcacgatgtatattgttcgagaaaatatcatttttactctcttagggatcattggaggatttggtgtaggatatgtattgactgactttatcttacaacaagcatctatggaaaatgtcatctttccattagtgattacatggtgggcttatgttttatcagcaggattaaccatcgtattcacggttattgtgatgattgttacccatttcaaattaaagcatatcgatatgattgatgcgttgaaatcgaatgaataaaaatcgaggttgtgaaatcagcggtttgacctgagtattagagaaacaaacggcaaaatagttcctcatattttgccgtttgttgagctaataccgaaggtcagctgattgaacaccgtttaagaaagaggttgtgacagaagtggtcagcttcaagaaataagaagaaatttaagaaaacagctcctcatatttttcatttgaaaggacttattgtcgtagatgcaagcttttgaacatcatttatagaagaaaccagaacattttgctattttagacaagagactagacaaatacatgtctgatctcttgttttttattggacaacaccctcttaggaagtataaagataaattttacaaacgctttcggttcagttataataataaatgataacttgtatatataagttgtgataggtaagaaatcagttgaatggaggcaaatatccatgacatttaaagacaaagtcatttatcaaatctatcccaaatcttacaaagacagtaatggtgatggaattggagatttaaaaggaatcaaagaaaaactgccatatttgaatgatttagggatcgatatgatctggctaaatcctatttatccaagtcctcaaaaagacaacggttatgatatctctgattacacagccatcgatcctatctttggtacgatggaagaattcgagcaactaatagctaaagcaaaagaataccaaatagaagtcatgctcgatatggtattgaatcatgtttcgacagaacatgaatggttcaaaaaagcactagcaggggatcagtattatcaggacttcttcattttaagagaagaaccaacggactgggtatcaaaatttggtgggagtgcttggtcgccctttggagatacaggaaaatattatctgcacttatatgatcagacacaagctgatttgaactggcggaaccaagcagtaagagaggaattattcaaagtagttcgtttttggatggaaaaaggggtaaaaggattccgtttcgatgttatcaatgttatcggtaaagacgagcaattgaaaaacaataaagaaaatgatggtaaacctgaatatacggataaaccaatcacccatacgtatctaaaagaattgaaccaagcaacgtttgggacggattccactatcatcacagtcggcgaaatgagctctacgacgatcgaaaattgtatcttgtatacagaacctagtagagaagaattatcaatggtctttaattttcatcacttgaaagtcgactatgaaaatggcaataaatggtcaactcctccatttgatttttcagaattaaagcgactgttccatacttggggagaaaagatgagtgatggtaatggctggaatgctttattttttaataaccatgatcagccacgtgcgctcaatcggtttgtagctatcgatcagtatcgaaaacaaggagcagagatgctagcaaccatgatccatttaaatcgtggaacaccatacatttatatgggagaggaaatcggcatggtcgatccagactattcctcaatttccgactatattgacgtagaaagtttgaatgcttacaagttgctccttgcacaaggattcacagaaaaagaggcgttccgtcgaatcaaagcaaaatctcgtgataactctcgaacacccatgcaatggtccgatgcagaacaagcaggctttactacaggaaaaccttggttaaaagttgcaggtaagctagaagagatcaatgtagagaaagaacgatcttctgaggattctattttgtcctattataagaaattgattcggttgagaaaaacatatccaatcgttgcacaaggcgattatcatgcttatggagcagatcatccgcaagtttatggctatcttcgccaatttgaagggcagcagctgcttgtattaacaaatttctatgataaagatacaaggatcaccattccagaaggattcacagaagccgatattcttatcgataattattccgatactgttcttcatcaaaatctggagctaaaaccatatcaggcaattgctttactaaaaaactaaaaccaaaaagtataaaacgccgatcctacgagtattctcgtgagatcgacgttttttattttatttaaaataatcttcttcagaaaatgaagagtgttcatattctcctttgtcgccataaaatttattgtagcgttgtttgaatttacggaaaataaaagtaacgagtaatttgactaacgtatagataggaataccgaaaataacgcccacaattcccattagatcacccatgacaagcaaaacgattaagatcgtaatcggatggatctgcaaccgatcacccattactcgaggaattaccaagtcaccatggagaagctgtacggcaaaccagacaatgacaaatttgacagccataaaagtagagtcttggaatgcaatgatcaaacccgggaaaaaagcgataaacggtccaatatatggaataatacataataacccagcagaaatagctaaaacactggcaaattctaatccgatcagtaagaaacaaacccagtagactgctccaaggataaatgaagcaatgatctgcccctttagaaatgaacccaattgttgattagcaatctttgtcaaatttttaaaatctgtacgaaaggctggtgggacaatcgctaaaactgactgataaaatttttgaggatttctcaaaagaaaaaaagtgacaatgggcccagtaaataaagtaatgaaaatagctgtaacagttgaaaaaatattgctgatccgttgtgcgccactttcccaataatttccaataaagccagctatatcagacgtcacgtcatcaatagaagtaaaaaattgattaaatgaatcggcaaaaggtgttttctccaaaaattgacggagactctcttggaaatcttgaaataaatctggcaaactgctaatcaatgtttttgtctgttcttcaagaaaaggaacaagccatacgcttccaagccccaataaaaataaaataatcacataaacaataatgactgacaggttcctcgaaaggtgcttgcttaaacgtttgatgactggttccaaaagataatataagatcagcgcaaacaacaatgggggcaagatagtagcgataataatcccaacaggcttgaatataaatgaaatctgatggaaaaaataaatgatcagtgccagcaggatcaccatacctaaaacatagtaagaggttttgcctcccaaaaagcggatcaaacgattcgttgtatctgtttcttttttcactcattttcctcctttgtctataactttattatagacaaaagaggggataaaaggaaaatgatagagttgattgaaaaaatatcgtgaatcatccatacgaaagttctcctcaattaaaataagaaaacgcttgacagctcttttagccctatgataaattaaatcctgttgctaaaacgtaactattacgatttgttagaggcgaatcggaacattcaaatgaaagaatatgagaaggagtgttataaatgaaacgactgataggtatattggctacactggttttaacaggtatgttagctggttgcggggcaagtggagaagcaggggacagtaaggaaaaattgagcgtgatgacgaccttttatcctatgtatgattttacaaaagcaatcgtcggggatgaaggagaagtagaattattgattccagcagggactgattcccacgattatgaaccttctgctaaagacatggcaaagatccaagatacagatatctttgtttataatgatgaaaatatggaaacatgggtccccgcaatccaaaaaacattacaagaaggcaacgtccatacgataaaggcgacagaaggtatgcttttacttccgggaagtgaagaaggacatgatcatgaccatgaacacggggaagaaggtcatacacatgagctagatccgcatgtatggctagcaccaagtttagcaatcaagcaggtagcaagcatacgtgatcagttgattgaagcttacccagaaaaacaggaagtatggacaaaaaatgcagcagcctataccgagaaacttcaagcactccatcagctttatcaagaaacatttaagcaagcaaaacaaagatcttttgtcacacaacatgctgcattcaactatctggcattagaatatggattgaatcaagtatctattgctggtctttcttctagtgaagaaccctctgcggcgagaatcgctgaactgaaacactttgttaaagaacacgggatcaactatatttattttgaagaaaacgccaaagatagtattgccagaacgttagcaaacgaagcaggtgtatctttagaagtattgaatcctttggaggggctgacgaatgaacaaatagaaaatggagaaaactatctttctatcatggaagccaacctcgaagcgttgaaaaaaacgacagagacagaaaacctgttagaagatactttgactcccaaaaaagaaaagagcgtctataacggttatttcgaagacgaggatgtacaagatcgctctctttcagattgggcaggaacttggcagtcagtagatacgtatgtagaagatgggacattcgatcctgtttttgaatataaagaaaaattgaatcaggataagacagcacaagaatataaagaatactatacgaagggctatcaaacagatattgcttcaatcaagatcggtgagaaagagatggcatttacgtttaaggatggaacaacgaaacgttcaaattatcgttatgtagggaaagaaatcttaacctacgaggcaggaaaccgtggtgtaaggtatctattcgaagcagaagataaggaaagtggcgcgtttagatatattcaattcagtgatcacacgattgcaccggctgactccgaacattttcatttatatgcaggaaatgaaagtcaagaggcattgctaaaagaaatggaaaattggccaacattttatccagacacaatggatggccgtgaaattgcacaggaaatgcttttgcactgagaagcaaaaagaaccgaagggtttggatcggctgattatttagtcggtccaaactattcggttctttttatgaaattaacttttttaatccacggatagagacagggatagtctcaccgtttgccaacgtgacttctctggtttttttattaatcgaccgcacgttttgtgtattgataacataagatttatgacaacgaataaaattccgatgcattttctcgatttctttgatcttctcgtagaattgcaattgagcatgagtcaaatgaacttccaatttatgtggtgcgcctaacgaagtagaaaaatattggatttctttgatcggtaaaaatttgatctcatcattgaactctattttgaagatatctttttggatctgggacatttgaaaatcttcaaaaattttgctcaggatctgctcgacattttcttttaaatcataaaggtcttctttcacaatatagtcagtcggctcaatgttgctttttaagattttcatcgacatttccgtatgagaagtcacatagattatttttcctaaaggatctaattcacggatcaatttaccaatcgctacgccatccatttcactgtcttctaattcaatatctaaaaaataaataccaaaagaagaagttctgatcttggccgcattgagaagttcttccggatcagaggtagaaatatgaacataactgtctaagttttcaatcatgatcctgtttttgatcaccgttgataaaacttccaattgttttggatcgtcttcacaaatataaatgggaatcatatcattactcctttattttatttgtatataaatcgtttgagaaaaacgttggttttcaattgatgtttcaaggaaaagataagggtttgtctttgtcaattcatccaagataaacaagccaagtccttcgttttttggatttgtttttgttgagaaacctttttgtttcaactggtttaacggtaatgtattggttgttgtattgattacacgaatcatcacggaatgatttttcttgatgattgtcaattcgatctttttcttctttgcagcactagctccttcaatcgcattgtccaagataataccaagcatacgtacaaggtttaccgtatgtttcgtatccaactcgattggcttaggaaaatgaagctggacgatcaatcctttttcctgtgccatcataagttttaatgacagcaaactgcttatttcaggaactttcatattatccaacatacttagattggccgggaaaaggttcatcatctggcgtgtaggcaatatcgtttgatcgtagtacgaccgtaatccttccaagtcgccttctgcaatatagctgtgaagagaaaagagcagattttggtaatcatgtttgaattctctcaagtcttgatagtttttttccagatctttgatataatcctgctgcatcctgacttgttgctctaacaactgatcagctaatttcttattagagattttccaataataaaccaagatgatcaagccgacacacagatagagaatgaaaaagctagtattcaaagctaagacatcaggtgtttcaccagaaaaacgggtataaaaaataatgatatagtatgtaaataatatcaacgtcccaatcgtaccgatcatacggcggtccactgtgtgaaaccaagtctctaacgattttttaaaacaaaaagctaataaagcagataaaagagcggataaggcaatgtgaaaatactgcaaggaatctcctggttcaacaaccgcagatttcaaaacaaaaaaatcgccgatgcttgttaaatgatctcctaaaagcgacgtcaataatccacaaggaagcgcgtaaactaattgttgacgcgaagtcgaaaagaagaaaaaagtaagcatcagcattcctatagcaattagagcagtaaaaatccctaaaactgagtagacccatccaatcaaaacgcaagaaatcagagtgactcctacaaacagatagttgtatcggatatgatggtcaatcaataagatacaaattgtgtaaatcaaatattgcaacgctatggaccataaaaacataaagtacagctcccattgatttttaccaaattatagcacaattagcgtattatttttttaatttttcagggattttgaattcagaactcataccaaagcagcagccagatacaaaaaagtcagataagttagttaattgtttaatgattgtttttttcatgaaagattcctccaaaattcatcaagtattttgtaataggaagcaacgtagctatttctaaaacaatcccaagtagcaaataggtagaaaagtaagaagctgagaaaaataaagtgatgagagaaaaaattagaaacatgctgattgccttctttaataatggtggacgtttctcgggttcaatgggattgattgctgtacctcttgacccatagcgaagcagtaacaaaaagcagctgattaacaaaaagaccatcattgggaaggagatagtcaattgcagatgtttcatcaccaagggaacgccccataaataaagcagtgtccacagcagacaaacgaattcagagtcggaatgcaatccataagcatatctgcggatgcagatataggaaagaaaggtgattcctgtttccgcccatgagcccgtcaccagagaaaagactagaacgaccgctagttttccaaggttgttcaataaaacttctaaggcaaattttacttggacatacaccatatcttcttccgatttatctccgctgaataaggtttctaataatttgttcacaactttatctttcatctcatacgtacctccaccacaaattctatgctaaaaaaaataaaaaacgtgttttgtttcataaaaagtggttttgacatcaaaaccgtcatgatttccttaaaagaatcttcattttttaaatcctttccaaaaaaggtgacagttttgatacgaaaagtactttttatgacaagtttgtgtttttttgattattttatgttaaaaatttactgaccttagaaaaggtgatggagggattcttatggaaaatgaacaattgtttgaagtcggcgaaacatatgcatttaaatctgatttatttgaatcaccaataaaaggaaaaatagaaaaaatctatgaaaatagcgtgatgatacgtgtcatgaattgcgcagcagaagacaatgataccgctcataatctgcactggcagttagttgtacgcaaatcaagtacaatagaagaataaaaacagataaaatgttgagagcataaaagagtagaagttcatccattctactcttttattttcatgaataggcgtgacttctagctactattggcgaagcagtctttaaggagcagataaagtcaaggcttttatttctataaatgaagtagtaaaatgaagaacagattttattacaggaaggatgccgataattgtgatcattgttgcaggaacgatcggtgcagggaaaagcacactgactgaaatgcttgcccaagatttagaaacaaaacctttttatgagaacgtggaggataatgaagtattgccactgttttattctaatccggaaaagtatacttttttattgcagatattttttctaaacaaacgttttttggcgattaaagatgctttcagccatgatgataatgtactagaccgctctatctacgaagatagtatgttgtttcatctgaatgccgatttagggcgtgtttctgaagtagaagtaaagcagtatgagggccttttagagacgatgctgaaggaattagaagaaatttcgccacaaaagaaaccggatctactggtttatattcgtgtgtcttttgaaactatgttagcaagaatcaaaaaaagaggtcgggaatatgaacagctagagcaagatcctgaactctattcctactataaagaactcaatcgacgttatgaagaatggtatgaacagtttgatatatgtcccaaaatagtaatcgatggggataaatacgatttcgtagccgatccaacatgtggagaacaaatcgtacaagaaatcaagatgcgggcaaagaaaatgacagaagaggcagatgcccaatcgatccgctacactacaaataacccgaaagcaaagggtatctttacaactgaataataaaaaactaagcaaattgctcactcacaaatatttctttgtgaacagcatcctgcttagtttttttgattcaggggaatcaaaaggtgaaacggttcgtatgataaaactgccataactgaaatgtctgagtgagggccatgatcaagaataaaatagaaacaatcaaaatcgaatgggcgccaaacaaatgatgacagaatacaaggacaatagcccctgcgataaaggcaagaacgacagttaaatagtggaaaaatcgatcaaaatctgctttttctttagaaatacaataatcatataaatttgttgctaccccttttaaatttcctgttgtgaataaattggtgtaggcacgcccgttgattttatcaaaagccacccactggatcgaagccgtaaaagcaattaaaatcgttactaatgcgggatgttcatggacaggtgtcaaactaacaaagaaaaaaatcaccgcttcataatatagaacaaataaacgccagaaatgtttttctttttttctaaaataatcaatcaaatactttgttagaagaatccctaagaaaaagaaaagggtagacaatacttttttgccaacgcttagccactctccgtcaaaagcttggatgatcgataggatgatattgccagtttgggcagaggcaaaagcaccatactggatataagtataactgtccattgctcctccgataaatgtcagcaaaagacctattgtacgcccctcgtgaaaggaagtctgcatttttttcatcaccttttatgaatataattttgtcttccttatcttagcataaacgattgaaaaaaaggaaacattttcagaaaaccaaaatcatctcgctccccattttcatttttagaaaggtctgttagtataaagaaaaaaatagacaacgagattttaaataatcaaattggaagaaacaacttcaaagaagaaagatgggaaggaaatcaatcagttggatgaaaaagaaattctccgattacaaaaagaactgaatcgttgggagaacaaatataaaaagcttcaacaagtctttcggctacaagaagaaatcattgctacctatgaagcggcttatggagaagcccctggacttattgaggaagagatgcaggaaaaagaaagcaaaggaaacaactctttctttaaaatgatggagaaacgttcttataatcgcttcaatcaagaacaaaaagcagctatcacatacgacatggagaaacatcttcgaatcatagcgggagctgggagcggcaagacgcaaacaatctgtgcaaaagcggtgtacctgatgacacaaaaacaagtagacgaagaacgcatactgatgatcacttttacacggaatgctgcaaatgaactaaaaaaacgagtagataatttcagccaaaggaaaactgctgtccatatcggaacattccacagtatcttttttaggatatacaatgagatttgtcgaaaattccctgaagtggcaatgcaagggatacaaggagacttttcaaaagatactgcgcaaaaagtaaatgctgttttgcaacagctgatacgtaaatataatctttatctatttgatcaatatggagaaaaaacgattgcttctcgcttagactattggcagaatatgaacctatcaatagaagaaatgattcagttagttaaagaaaaatatgattccattgataagaatacaagacaaccgatatcagaacgactgtatggattgctcacagaactccaagaacaaaaaagaaggcagcaattgttagagttcaatgacgtactccaaaatttgaaaagcgctttggagaatgaagagattcagcactatattggacagaaatatgattatctatttattgatgaatttcaagatactaatccacttcaatgggaaatcgtgaagcggatgacaaaggaaaacgggatcaagttaatcgttgttggagatgatgaccaaagtatctatggattcagaggatcagagccagcgtatatcaagaactttgaaaaagaatatcctactaaaactcttttcttattaactaattaccgctctcgggcagctattgtccaaggagcgaatagattgatcagctataacaaaaatgatcggataccaaaggcgatgattccagcacaaaaagaagcgggtgttatggaggcttatttgttctcagatacaaaagcagaaagccagtggctgataagtcaaattcagtcatttattcaaaaaaatgggaaatataaggaatcgatgatattataccgatcggcttcgcaaacacagcaacttgtccaatctctgctaaaaacgaatattccttttgtactggaagcagatagtccatatgaaggtatctttggtatcaagtctttccaacagttctatcaaaaaatcgttcattggcaaacagctcagaatccgcaaaagaaaaatcaaacctatcagcaattgctgcggcagctgatggtagactgctatctgaaaaaaagtgaatgcgatcaatacttttctcctaaatatcaaaatacagccattacggattatattttgtcggtaagacccaatttaaaatccaaatctgcagaaatccgccagtttgaggaagcgttgcgtaaaacagaccagcatcaagaagtctattcgcttgtacaaagctatcttcatctgccacgtatagctaaggaaatcgatcagagtgatcaagaatggatacgagaagaagtaaagcaacatgctacttttagaagtatccaagccttatcgcaagaaacccaagcaacagctaaagaattaaaaacccgcttgattgcttacagacaaggaaaacttgatgcgctatgtatccagagcattcataaaagtaaaggtcttagttacagaaatgtctttttaattggctgtaacgaaggaagtttgccttataacggagcaacagaaaagaaagtcatcgactctaatgaaataaaagcagaaccagtgacgacgatagaagaagaacgaagactattttatgttgcgatgactagagcaagaaatcgtctgtatctatgtgtacctcaaatgaaaaatacaagaaaattgaaagtatcgagatttgtcaaagaaaccggtagtcgtatgaaaaaaggaaagtgatggaaaagaggttgtgacaggagtggtcagcttcaagaaataagaaggaatttacggaaattgcttctcaaatttttgtaaaatttcggcttatttttgaagaagctacttctggaacaccgtttattcggaaaaaggaggtgtgacaagatttttgtcacacctcccttatttatttttgaaaaatgagaatactattattaaaataggaagtacatagaataattctcattatttaaacgtaaataatcgatttttttcgactttttttattttttattagctaataattggtattttaaaagaaattgctgtagaattggattataattaaaaaggagtgagaaaatgataaaagtatatacttcgcctagctgtacttcctgtagaaaagcaagagcatggttgcaagcgaatcaacttgaatttgaagagaaaaatatttttgccgaaccgttaacagaaagtgagatcaaaaagattttagcagcgactgaaggaggagttcaagatattatttccactcggtcgaaaatttacgagaagttgggaatagattttaacgaattaactttaaagcaaatgatcgtcctattcaaagaatatccttcattattgagacgacctattttgattgatgaaaaaagaatactaatcggattcaatgaagatgaaatccgttcatttgtccctcgtgaaattcggtgtgttgctagaaacctaatctatttacaaaacaataacatcttaaattcatagggagggagtcttcgtggaagtgaaagtctacggatcggcgcactgtgtaaccagtctgaaggcgaaacaatggttagaataccatcaattgccttatcaatttgttgacttagaagaacgcgatctaagtacagaagaagcagaagaattatgcagttttgaagaagtgcaagcagaacagctatttgtgacttggtctgaggctttccataacattgcgatagacctttcttgtgtaggtaagaaacaactgatttctttatgtacacaacatacaaaactcctcagacgtccgttgatcattatcgatgaagttctatttattggatacaatgagcagttgatggagcaacttatcctaaataaatagtctttacctattttaatcaaatttctgagcgcttcgtacagttagagcagttgaacacttaacatcaagtgtgttatgtgttctttttttgtctttatttttctactataaaagatataatcgatttatgtggtcaaaattcaaatgtacgagggaaaataggctgagaaatatattgacatgtgtaaatttacatgatatattcatttttgttgttttaagtaatatgcaaataaaatagcattaaaaaaacttgaaaaacagttattgacatgttgctaatgacatgataagataactgagtcgttaaaaaagaacagcttgcgaaggttgattctattgaaaaaaacttcaaaaaagttcttgacaaataacaaacgataagttatgataaatgagttgctgaaagatttcaaaaaaacgaaatcgaaaaaaacttttaaaaaagagttgacaatcacttgccgctctggtatgatataaaagttgctacggcagccaaaacaaatcggggcaatcgacattggtactctctcctttcatcgaaataaccctatgaaaaatatagctgcaatcatcttgaatagtagactcacaagggctaacacaaagcgccaaaagatcaaacaaaatatcagtattcctaagaatactacgaagtttaaatgtacagctgcactatgacgcataagtatctcgccaatacacagtacgaacaacagaggaatgattttattcatatggatctccttctttctcttaggttatcgggctttgcccgcttatttcgcaccacctaagcggcgggggcggttggagcgattggtgcgaaataagaaccattcccttaatttcaaggttttttgttcttatttcacacattctcacttttcggtataaatggttattgaccttttttcctttcaaatcgttgatatggcattcgtttacggtcaagttcattttggatttcttctgtatcgtcgtaagtgtaggtgtctaaaaaatcagttaaagtcgtgtaccagtcgtcgcctggattatctacttcttctacatattccctcaaaaatgcttcgggtacagcgagttcataatccattcccattaacacgatagattccgtcccacacgtcaaaaatctagtaaatacaagataataatcgtctaccgttgcatctttgctgtttagctcttccatttcttcttccattaattccatgctctcaaaaattgaataatattctgattctgagtaatagtgtttcctacaaatcgtgtagctgacaaagttttcgaccagctcactcctttctaggtacacattcatgatgtatttttctgtttctagtcgtagaagctctgttcctttttttaccgtttcaggacgacgtttatacacgtctaaatgattatggctgactgtgaccttcgtttgactcgtttcgctttccatatacaactgttcttccactctttgaataaagtacttcatttcttccatacaactaaagtctttttgaatccgtctgactacttcattcaaatgttctttgtttgttaaaaagtgagaaacatcttccattgttagttgataagccacattactcattttcctcctttttcatgatgtaacatgcgccatacttgttgacattttcaaagtagtccaaccattcacttgaaacagtcttggcttttttcgtttcgacaaatttcgcatacgttagttctaaagcttgatattcagaatgtttaatagtgcttggtttgacacctacttccaagcatagtaaggctttgaaaaaccattttccattttgttttttcagttcttccaatgttcgatagtacgtcgcaatgagattcatttcgacacctgattcaatcatttcttccactgcgactgacaatttttccttgtaatgttttttaggtacacgtgtttcatggtataggaacgtcatatcctccattttttgtgccattttatccaaaggtaatttgacaaattcgtcatagtaattttgagccatatttttttctcctttttagttctctaatttggttaaccaatattcgttttcataagtttccaagttttcttgataatgcagttcatatcctgcaatcttcactaggtcttcaaatagcatagtcggtgcatcctctactaaaggggtttctatcgtccagtaccgcggaataagtaaagcttctgctactttttcagaaatgacttctttgtccaccaaaatttgaacgacttcttttacagtcaataatttatgttgtgttttcatcagcgtttctttcctttctcatcaatcaaaatataatcgccataagacaaggtgtatttttttccgcatgttggacattgatacaaacgatagcttttgatacatttcgctctttgtccacaatcgcattcgacagtatgtggtgcatgatagtttgggaataattcgctgaagggaacaccccaataatcaaatttctttcgcatgattgattctgcctcctcttaggaaagggtttacttcctttcgttagttctttctttattgatttgttggccagaatgaatcaacgaaaagcgacaaggacaagggcgcgcagcgtgccatttacccttgtccttgtcgctttttggtgataaaaggcaacttgttgccggtctggcaaatcaataaagagataacgaacaggaacgaaccttttggtgagaggaagttttttctattttgtcttgctttgcaagaccctttatcttagtgaacgtgcaacgttcacttcctttcttctcgaacggcggtggcggttggagtgagagaggtttttcaattgagaaggcgctcgcgccttcctaaaaaggccttttcatttttcttgtttctatgtaaaacaaaaagagctgcagtcctacattaggattgcaactcttctttttttatatgcccatcgatcgtgtaaaatgatcgggatttctaacatacatgctagcaataactagctgatttcgtttattgaagtgacctgtgacggcaatattgtattttccatcatccataactagcaatttatcgataatttcaatatctgcaactacacaattaatcgattcatgaatcgtttgtaaagtaaagcgaaccaataacggttgcgtttttattactcggattttatcaagcaaaccaacatatttgttcatcacaatcacctcgctaaaattatagcaaaaatccaatcatttggatatttcaattatgctataatagtcttgctgtctgctaccccggcctaatctggcaaggggaggaggttataggtttgaaaattctttttgattttgtttttgcaatcatggcagaagtagccgcgcactatatctgcaaatggcttgattgtaaatttgccaagaaagacagtaagcctacccgttaattcttataatagaaacgtaaaagaaaaccactagcccgccagctagtggtttttggttatagattgaaaattctttttgttgactaaattataacataaaccgtagcaaatgcaaccaatagaaaatgctacttaaaacggtagatcatcatcgctaatatcgattgattgtccaccaaatggattctgtgaagcgttcaatccattgttgttaggcgtcgctgtatcccgttgttcaaaagtggtggtgcttggactcgtggacgattgatcagcgtgcgcacggctctctgtcgctgctttgctttctaatagttggaagttatcagctacaacttctgtcacatacacacgttgtccttgctggttgtcataagtccgtgtttgaatccgtccgacaacgccgatcaagctgccttttttagctaatgtcgccatcgtttctgctggtttgcgccaaatcacgcaattgataaaatcagcttctcgattgccgttttgattcgtgaaattacgattaactgctagggtaaaagtagccactgctgtgccacttgcggtataacgtaaatctggatctttggttaaccgtcctactaaagttacattattgatcatttttatctctccatttctctgttcatctgttggtgtctttgataagctatttttcgctctttttcttcgacgtgaatcactttttccatcaaattactaatcgaatccattgtctcttcgtacgtgatcgacgcagcataaggattgcttttttgatatttcttccaggtatcttttagctcatgactatttttcagtacatccatatccttttcgtaataaatctttaacggatcagtttttcctcgacgtgtaaatgtatttctcacactatctttcaaggtcttctcatcgatcttttccattttaggaatagtatagagatcataaaaatcttttcctctcgaattatctgttaaaaaatcaaaggttgcacttaatttttcggcaataatttgttctgtaggataagattccaaaggaatcgttcgatcttcaaacatcaatttatgactgtgagtgatcgttgcaggatagatcgagtcacctgtagtcacatctaccttaaaatctggccgcatattttccaaatgtgccagcacacgtaagctaaatcctggatagtaatcggcttctctcgtttctttcattccttgaatctcaaattgaatgccttctttcgtcggcgttgaaaaaatatcgtttagaaccgttgttaatgtttctttggttactttcatttcccgtaaagtcgtatcaatgtctttggttgtacgattttcaatgccatactttgagccaattaagaagccgccttttaacacaaaattttcacgataaggagactctgagattttttccaagaatttttccatcataaaatgtcttaaaacaagctgcggatcaacttctttttctctagaaatattcttcacttttgcttttaattgcgtaggtgtcatgtgtcttctcctttaatttaaagccataatataagagcgcatcgttttatctgtaggcaaaattcgtcgatactcattcaattttctaagattttttctgtccgactccatgtagtttttgattgcttttactttgatttcatcctcaacgttataccagggattccaaatgtcacacaaggttctttctggatcataagctataacaggattcccatagcgactctttatttcgatcttgcctaattcataccattccgcttttgaatagtgtaactcaaccgcgaattccttcaaccccttttcagaaacgtgataaccgtaaggtacggttagatcgatctgtctagggatcatatccgttaaatcatataaatccaacgcggtgatatgcgaaataatgccgcgttcatattttttttgcgccataaacaattcatcaggaaattgaccaggtaaggtgaaaaagcctggatactctcgatccagctcccctcgatctaccatacgtttgatcgtaacaggagaaatgcccgcttttttagcatccttcaaagccaaagttccattaaattcttctagtagcttatataccattgcttttgtcattttctccctcctttgtatacgtataaacttataaatatagtataacataagtttatacgtatacaataatcaggaagattttatcgatctaattcgatttctttttgaatccgttgctggttctttaattgctgcagtcttcgtttgctggcacgcattttttcctgttctgaacgaattttggctttttgattttcgatttcttgttgtttgtgtgttgtattacgcataagattaaccctccattattttgtagtgcgtcgtgttcttttcttgaagttcgtttttttcttttcagaaaattcaaagcctgtagtgaagtcttcttttaaaacaatcgttgcttcaaacgaacccttctgaccttttaaccctttcactggttggcttgttcggctgttttgaataatctccttcagctgtgtcgctgtgagtttctttttggcaatcgttgtccataatttaaaatcacagacttcagacgtacatgctgccaccttttgataaagtatgacttcttgttcctggcattttggacaaattcctaaatgacgcgcggcttcttgcttttcactggctgctttcacttcttgtaacgtcgatccaaaatcagtggattggatttgccctggtacgacttccaataagtgagagacaaatttttggatattagctagaaaagtggtttgtgttccttttcgttctccaatctttaataagtagctttcccatttggcggtcatttcggcgctcgtaagcagcggctctttttccacggcttggcaaagcaaaatccctttattcgtcaccacgagcttatttttctctaccttgatatattccttttgtttcaagatttcaataatatttgcccgtgtcgcttctgtaccgattccttctacttctttcaatatggattgcgcttcttcactatccacggttttcccagctgttttcatcgcagtgatcaacgtaccttcggtataaggttgtggtggcttggtttctttttcaaggacttgtagatctaccgtcaccatttctccttttgtcactttaggaagtagcggatcttcttccttctcttttccgtcgctctcttttccaaataacttcttccaacctagatctaccggcacttttccgattgcttttaactgaagctgctgaacttgcgtcaagatcgttgtttcttcataggtatatttttccgcaaacatggccaccgttgtttttaacacttgttcataaatggcctgctgcagtggacttaattgttcaaaagccgctgccgtcatgaccgtttttgtaggaatgatcgcgtaatgttcctggactttcttattattcacatatcgactattcggtgtatgaataggagtaggaatggcttcggcctttaaaaagtgtttgtattcgtctaagtgatccaacagatacgcatattccccttctgtaatataaggggtatctgttcgtgggtagcttagatatttcccttcatacaacccttgcatggattccaaagtatctttggcactagctttcatgagctgattcattttagactgaaggctggatagagaaaaaagacgtggacttgccgcactttttttctcggtttcaacttggtggatcgtacctggctgttttcccaattgaacccccttttcttttaaataatcttcaaatgcttcttgcgtcgcttgggtttcattcggatcaagcttcgcatcaaatgcgccattttgagcgattacttgggcttttccttcaaaataaggctctttttggaagtttctaatcttttcctgcagctgataaatcatgtaaagcgttggggtttggactctgcctaaggaaaaacttcctggtatgcctttttgctgcaagagtaaactatacagtgggctgccgttcatgccgatcaaccaatcagcgatctggcgtgcttgtgcttcttcaaatttgggataggtctcttctgcgtctcgtaattgctggaatccctgataaatggcttctttttctaaggagttgatccaaagtcttttaaatatctttccatgatcggcgcctgcttgttgaatgatcgtccaagctatcagttccccttcacgatcgctatctgtcgcaataataatggtgtcggccgattgaagttgctgtttcaccaccttgaattgctttttcttatctttaggaacatgatagtgataatgtgtagggaaaataggcaaatgccctaatgaccattgtttccaattttcatcgtacatatcgggcgaatctaactcgactaaatgaccaaaaccatacgtgatcacagtttcaccaggaaacaatctatcttggatttcaaaatacccgtcttttcgggtggctttagagaagctatcggcataagctttcgcttgtgacggcttttctgctaaaataacggttttcatcatgacgatttcactccctttcttgttgtttgccttgttgaaacaacatcgcacgtttttgctttctgatctcttgttggtggatttcatgcttcaattgatcattccaatccttttttacttcaggtacaaattcatgttcatgatttttatagcctttgtagtattgttctgctttataagagaaaagaatctgagcattaatatcccctttttcttgataaaaacgatcaaaatcgtacgtaccatccacgcgttcacaaccttttaattcttttgcgacttctctacaaatatctttcaaattaatagcttctattgaatcgttaacagaaagctgctgaccaaaagacgtatttactttgtgagcggaaaccagctggtttgttaattgcagattgttctctgtcttgtgtatggccataatagcttctggtgtgaccttttcttcttttgcgacttcttcataaatgattttgtattcttttggcacttgccaatcattagcgattcctcgttcacaacgtactttctgattcgtaaatggatcgactgcgcccattaattgttctttttcgtagaaaatatgtcctgcacggtcattatccacacaaatctcgatggattgaggaaaggcttgtttctttctcaattcagatactgcctcaccaaaataatgactgatcacatggtgttttaacccttccatagagactaaccacgtatcgtttaactgatcacgattcagtgcagcatagctaagtaaatcaatactactctcaaaaaattttaactgcttagggtcaccgatctttaggttaaagccatgattcgctgtcgaatttttatctatatgcttatatgtgcctctctcaccaaaacgttcataatcaatgaacgttccttgataactcgcccctactgtctcttttgtctgtggatctttccataaaaaggcaaccgcatgatctaaacgatcgtctcgaactaagaaattttgccgttcatgttttggctttagttcggcaatcaacccttctttttctgcataatcaatcagccactctggtagttttcgtccttccttcagataattccttcctttttctgtgagtggttgataatcaacggggtgatctttgtacttttctgtctcaaaatgaagattttccactcgttctgttttgtcttcattctttagaataaaatcagtggctgctttaaattgttgcttagtgtcttggatctctttgtctatgaaaaaaagtttagctaattcaataatgtcgccactaatattttgactattccaataaaaacgttgttttcttcgatcaaaaacaaaagaatcatggtcttctaagcgatagtctcgtcctttattgactacagccattccattgtttcgagcaaaatccactatatcgatctgtttacatcgatcaataagactcatttttttctctgtcattttcaaacctcccaaaagaaaaaagactatccgtttttcagatagtcttttttacttgttttatacgcgttctttttgtgacaattgttgttcataatagatttcattttttcgtttggccacttctgacactgtttcaagtgaaaatcggaatggatttcctagcgcaaattcttctgaaggtaacgccgtttgaatctcttttccataactttttccttttaaaatcacttgattatgctgcggatcttcaataaacgccgcatccttcaaatgtaacgttcggcccgtgtcttcttccaggactttcccgtctttcttgtcgatccaaagtgagccaacgggcacaatattcttttgttctgctgtttctacaacatttttctcatcctgcttcacttctgctggctggatctctggttctctttctctgtattgattgatttcattagaaatggtttgaatgaattcatttgcgacacgactgacatcattcatgattttcccacgttccgcagcttccttatcatccaacgtctgaccattcttcgtccatgtcgcaatataaggaatagctttctccgaggtgtccatcccaaaatgcttgcacacaatataggaggtcatttctgcctgtagttcttttgttgcagtatctaattctgaaaatttgtgcattctagcatgggctaattcgtgaatacttgtggctaaatgctgcgtaggagtatttcgagtattcatgacgatttcttcttcgccagtaaattcgttacgaacgtacgccccacgtgcttgtcctaattctctttgatagacttcactttctgtcatatctcgaatttgaattccaatatttttggctaccgcttgaatcccaacttgaagttctgtatgccctgtttgatccaattgaaaatcaaagacgcggttcgggaagattttcggatagtcttcaggcttcaattgtgtttgtgtgatatcaaacactttttcaatcgtgtagtaaggttttttgatcacttcgatttgaccactttcgattcgttttttatcttctggtgtagcctctgtttctcgaacaaagccacgtcctttctcataaaatcctttgaccgtttttctgacaaagatcttgttcccttgttccccttttttgatataaattccttcttttttcaacgcggcacgacctaaacaagccgttgcgcctggaaattgttcctcgatcaataattgatttctaaaggatcgttctggaaaacgagacataaaattcaaaagttctttgacgtcttcaggtgaatgagtatgctttttcaccgcatcaagcgcctgttgggaaagtgatttgacttcttgcttaatctcttctgccgttcgtttttgataacccttttgttttgtttttgtctctttaatctcattttgtacttttgaaataggttcatttttgactgtttgtttttgttccttctcaggtacttgttcgcacaatctagctaactctaaatagatggggtgattactattgacgccatcccctagatccattcgtatctgatctactacttctccattcttcacttcttcaaaatagaatttataatagcctgcttctgcggcgaattggttatccagtgttttgagttgatcgatcaattctagtgttacgatctccccaccataacttttcaaccctttttctggatcattttcgttgaattctactcgataaaaatgatcgttttctttctccttcaaagaatcagttggtacagcctcttcaagtaattcacgaacagctgctttttcctcttccgacgtggcttggtattttttagattcctcaaattccccgttttcattcagttctaaagcgacttttcgatagcctttcagaaaataaatggtcggattttttttccattgcgtcactcgtccgctgtcaatgattgcttgtacttcaggaagaaggttttcttttcctttttccgatctttctttcagctgttctaatgtttccaatttccgttggtattttcggatcgtagcggctgaaaaagtcgattcacctttttcaaagcgttcgatttcttctttgattcttggaatattctcgatcgtcatatccagtccgccgtacttgttatagcccatttcctttatctcttcttgtctttcaagtttttctacttgtttttcttgttgcttgatctcttctctcagactatgcactttattttcgattcgctcttgttgcctaaaccaagaatgcccatttctcttatcgttcattggttgaccgttggtctttctctggtgttcaaacatcttttcaatttgttcgtttaattcattttgcaatcgtactaattttcttttggattttcccaaacgactattgtctagtggttctttttcttctgccatgtccgtttcctcctaaacaaatggataatcttctgtcgcatcgacgaacgtcttcgtagtcagatttaacgttaaaatatcgccactttgataagcttttgccgctttgtctgtgacgacaaaagatctgcctgtttgaatttctgtcacaaaaacgagattgtctctgcttttttcaacaacaactccaatagttgaataagccatttcttcttcctcctttcttttgatataatgtagtcggaaatcgcaccactcaataaattggcggaaaacaattcattgaaaaaaagagtcctggacaatcacgttcaggactcttttacttcttttattcacttaacaactaacactctgtgagtgaaatggactcttcaatgcttttacatggaaagttattgattccctcttcattcatttcccaagtagtataataaggtgctaacttgccctcatattcttgaatgataaaatatttttcaccattcacatgattacaacaatacacaccagtagctgggtactcaacgactaaaaattgatttggatcaaactgttcgtttctcaacatttctcttatctggaacaaatgctctttttccaaacaatcgggaagttgttcgattcgttctttttttagtgatccttctatgactttccattgattcaaatatcgtttcatttctcttcctcctactgtctttcttgttccatttgaattcttcgttgttgctcttcgtatgctttacttgcgtggtatttttcttcatgggcattaatcgttcgatttaattgacgtaaactccgctgtgtgacaactctttgttggaattgtttcctgcgcttcatgaattcttcgtaactatatttgtattcattcgttggcaattgtttaagcgttcgaaaggatcgttcattgtaaatagattgcatctgatcaacactttctattaatggttttatttgactatcctgtctcttcagctctgttaggatggcatttcctgtgtgcttttttaaatcaaagagagcatttttctctgcatcctttgattctctcttgctttccccataaagactttctgcttcttctttcaatgcttttgaaatctgtatatattcttgatattcaggttcttttgttaacacatattgggttaactcgtcgagtttctctcttgtgtatggtgaaagtttagttcgattttcatccccataattccattccgaacgtttttcaggtaaggttctatatacttcatttaataagttcattgcgtgtcgatcataacgtactggctcttttaccacttttgttaagctgttacgcaaatcactttttcgtgtcaataaatttcgtttctccataccaatcattcgatccttttcataagaaaaacgttctaactcatgtacataattggtcttcattgcgtctaatgttgcttgtcttctcttacctttcggtacgatataactcacaccattttcaacctcagtgtaaggtttacgcgtattttctttttcaacaactgcaaaatgaatatggatatgtttagtattgcggtgaatcgttgccatccagtagcctgtttcattcagttgctctttctcgaataatgtctccatcatttttcttccagctgcttttaatccttcttcatctaaagtatctgttttgggatcgtacaatcctattttttcaagatacgaattatcatgagagacaacatcttgataaatgattgagcctttttgttgtcctctttggaagatttgcttaatctccttcagatcacttcctttcacttcgtctgaagccatagaaaaaactccaggaaggtttcctgaagcttttttgtgtggctctgtttgatatttttttattgcttggttcaagcgttggtattctttttgttcactttgcgtcagttctttcttttgttctaacgcatagtgacgggtcatataagaaagatatttggtaaaatcttgttcctctaacttgtcaaagttgattccatttcccatcaaagattgagcttcattcgacgtttcgctgaattctttatccgtcttactctccgaaaaagtttctccttcaggaatataaaaatcctctaaagcattcttgattcgttgcagttcctgttcttcttcaggcgtacgtcgttccatttcttccagcgctttttctcttgtcatataatcaatgtatgttgaaaaagattttttattgggcaaggtaaattgacaagtgagaatgactgcaggcgatttattcatcatgttccccttctacttttatctttttagaatcttcgttggatcaaatggatctactctggcataaacagattcattcacaggtttcttcaactgaggggaatattttttggtttgattagatttaatttttccttccacacgttcttttgcttcttggtaaaccgttgaatttgtaccaattagtattcctgtatctttcaaatgaagatctgcaaactctgaaaccatttcggttaaaatagaaatttctttactcattccattcaactttgcttgattggaatttacttttttctccatttctggatcataattcatacatagaaaccgaacggcttcactatagtttttaacttctgcatgagtagaaataatctcatccaacacatcgatatgtgtttggtgaaagtaaatgtgtttgtctataacctttgccatatcaaagttcacttcctctattttgctcgatcaagatttctaaaatacgattgttttggctaacatattcttctaatatctttgtgttatagctttgaatttctgaaaacttttctaataactgatcaaacttttcttttttatattccatcaaaggacgatcaaaatcattttctattagtaattttaaataatcgttacgactccatttattacccgtacggttacttagttcgtcacatcttcgatcaatttctcttacgattttctcatccacatttcttattcttacttccatattaattcctccaatttaaaaaggatagcgaaaaggagcctatcctttttgctatcctactaccctccttttactatccttcactatcctttcactatcctttcactatcctatttttaaatattttgttcccacatttatttttgagaaacgtaataggcacagcctattggaacactttttttaaaaagtgttcccacgtttccttatgctctttaaaaattaaggttatttgtgtatttagacaataaaaaatccttctaactttgtcgattagaaggaaatattttgtcatatgaaaaatgaatttaagaaaaagtgtatgctataattgatacgctgtcttcctgtttggttgaaatcttcagccagaaaggaggagtgttaaatgttttatgtgcttgatgtttgtgttagaatcgtggttaatgttttctcccacctctttaacagctatacctaaggtgatatagctgatccataaacatttttgatatacttttttcacataaaatcctcctgtttttattttctttcagccgtaaaatattttttagcagctaaatacaaagcttcaaatgatctgaattttaaggtatctaaactctttctaccattcttcaactcagatattgttgtgttagataaatgcacttcttgacatatttctttagcttttacaactttgagataggctttaatcaatactttctgctcagcgaaagtatctttgccgaccaagttcgctcgcttcatttcttttactccacctattcttctaaatattttcttttgtcatacgatcaattttttcttgaagtttttgaatgatctcttcttgatctttcatttgcgttttcgatgtttcaatttcttgctggtaactattaatcttattttcagtattttcctgatcgtctgcaacttgataaggcaattgatcttttagtttcttcactaattcttcattcaaatcaatggttgcttggaaggattcaatttgtttttgtgctgctttttgttctttcttgtatcctttcactttgtaattgatcgcatgttgttcataatcttcatctttcacttgatctttaaccttatcttcgtgaacgtaataaatcagattttgtggttcttgcatatccactttaggatcaattttttcaggaataatggttaaacgcatggcgatatattcttctggtacatgtgctaacttcactacaaaataatcatcagacaccttgatcactttggcttttattgcttgataatcccctttagctgtctttacttctacgcgataattaagattagccagttcttttaatgagctttgatcttcatcgtcgatcgcaaattcaaaaactaattgctggttcgctcctttttcttttgaaaccatcgtcagttccttcgtgtttaaaaatgcgttcgtgcttacttcatctggtatgtctacctttttatgtgtgtaaatcggactagcaagaatcaaaaagccgagaatcataaagattcccagccatctaagataacttttccgttttttgaaacgttgtcttgctccttttttcttactcattttcttcctcctaacgagtgaaataactaaagtcagtgactttccattgaccatctacctgtttttcagtgacagttaatccaccttttattttttgtggtttgacatctttgaattgaggatttccaattgtataatcaacaaataccacaaagttttgttcctcttttacactgcttgtttgagcataagtttgcacgtcacctaatgtaaaagagtaacttccgtaatcatcatgttggtgatcatcgtctgcaggacttaatttgtcgatcacttcttgggttgcgacatcttttagtttttccgttaattcatttctgcttaatgatttatcaatggccaattgaccgaactcttctgccgtctttctttgtgcttcagtgacttcctcttttgcttttgtgccatcttgttgcttcagctgatcgatttcttggtttttctcattgatggtttgatttaacttgtcgatcttcgcctgtgcctcagaggaattttttttgagcttctcagacgcgtttttagccacttcttcaattttaaaggtatttgtctcttgttcttctttcagctgccaaaacaacgcgatattgccgattaaactaacgctaattgcagctgttaagacgatttttaaagttttattttccatattttttctcctgatctattttttgctgctattcaaaaatggtaatggatcaatccatgtaccatcatctgtgaatgcgtgtccttgtgcttgacgccaatccattcgagtgaaacctaaatgcaagtgtgctgtatctcgtatcccgattacttgaccaactttcacttgatctccaaccttcacacgagaatttcctgtactattcgcaaattcttgatataccatattcaaaccgtcgtaattaatcacgatcacacaagcacctaaacctgaaataccaggattgccaacgtacacgacttttcctccatgcaccgcgtgaatttcacttcctggatgatcaactgaaccaaaatctaatccatcatggaagccattcggacggaattcaccgcctggatttgttccaaataattgaccaccgctgaaggaacttttatctaaactgctgccagggaatggattcgtccattcaccagtaattgtgccattatcattaccaccttcaccccaatgtttcatcgcgaattcatcatattcggttaatttattagaagtgataattgacatacaacctgtataatacggactatcttcagtaattcctgcagcggcataaccacctcgtcctaagatcaataagcttgcgccagggcttttatttcctacacatgcattaaaatttgattgtgtggctaccataaatccgtaataggataatgcagcttttgagttgggaaacttcatgtaccagccaccttcaataccaccaattcctcgtgcagttcctttaggaaacaaacagccatcgaaccacgtaatcccaaaatagttgagatcatttcttgcggacgccgacgtaccaaacgctgattcgtaaccgtattgcgaaaggatcacacttggtaataatttatatttcactgctgcacctacagcatattgcgcaatttcatctgaaaatgggcctctccctttgatttctttataaatcggtaatccttccgaatattctcctgtaaaagcttcgccaccactgcttgaatctgaatccgaattatcaatcgaacccgccgcaagtattagaaaaagggtcacgaacacagtgatcaaaatagtcatcaaacctgcagaagtaccaaacaaccacaaaaataagcgtcgctttgcacgacgcttaacatactgcttgattaaactttcattttggttttccattattttcctccatcaaacaattttaattgacgtttgttcggactaaaatgaacacgaatggtttcttttgagccaaaattgatcacagcgtctccttgattttgttgaggaatggattctaattctgagttcgtcattgatttaccaactaatccttctatatgacgtaaaatagattcatccatacgcataaagatcttcgtagaagaaaattcaaaaactttcttcagtttcgagaagttatcagaagacatattttctggcaccatttcttgtggggattgtgtcgctaaaacagtcattgcttctactttacgcatttctcgttggaagtttgtgacataatttaccgtttcaatgaaatctggattaatcgcattatggcactcatcaatcatcgccaagaagcgtttgaaatcttgttcttccatttgtttttctttaattaaacgtcgttgtcttcttccttgaatcaatgcctgattccaaatcaacgtcatcgccatgtacatttgacattgttgcaccccacgatccaatccagtgattgaatcaatatcaaaaaagaccaactgttgttggtcaaggtgtcgaattgtactatgcccatcaaaaatcatgccatacgtctcacataaggattctacgatggattccatttcttcttttcgattctttttctcttgggaagcacctggtaattccagttgtcctaagaagtctaaaaattctttgaatgtcggataagcttctggatctttccctgtgacttgcgtatcagtatttgaacgcgagtttgaggaagtaaagccgcgtggtactgttccatactcttcataaaaacgatttaaataggtcttaaattctgctttcatcgttccttttagctgaggactcactaactgtacctgatagaccactttgtctaagtgtgtttgataggacgctgcttcattgatcttcaaatctttgactgatccatcgtcatataaactggatgcttcatcatacgtccgtgtggcaaatatttctaaaggattgatcatcccgtcagatccgtctaagcgcaccataataccgttatattcctttaagaaaggaataaagtcttttcccttttcaaagccccaaataaagtctcctgcagctaaatgggcttccgcgatcattttaagaacggtcgatttaccagctcccatcattcctagaagcaaggtattagtagacaaccgtacactatttttatacgtcgcattccagacaaatgggccgcctgtcatggtttccccatattgtgtccctcctggatcttttagcgtttggtggtggaacgggaaacctccgccaatgtttaacgatggtagtgattgccctttgatatttccgaaccattcagcttgttcatcgaacatggtaaacatcgattgccaatctcgtttggttttatgcagataggtcaccgcacgataatccatccctttgagattttcaatcagttcctgcgctcgttcatctacttcttgaatcgtgtttccgtaaacatgtactctcactttgacttgtttagaaatttcaccattagaagtcaattttcgggcatattccgctagttccaggtattcttctgcgcttttatttcggtcagtcgcttttcgttcgttatctgatcgatcatttaattcatctaaggcacgattgatttgatcaatcactttttgcttttcatctgtgctaacatcgagtgtggccactgtatgaggattgttcatgagattggccaaccaaaaaagcgttggattttttgtgtagtgataaactgtcacacaccgtgaataaccatttccataggtcacatactcttcatcgaaatttaatccaccttgtggcatcacttgttttaaaaaatctaaatcataccctttggattttaaaatttcgatttcccgatttcctagttgctttaatggatcaagtactttttgatcattttgtggtgaaaaagctgttttaatcgcttctaacatgtacagtcacctcttcttgtttgattctttacttggtgaaaagattgcccttttcccaacttactcaggcttaaagtgtgaggaaattttctagtggtctcttccttcggaacatctttttctaaccatatcaacggatatttcattctctcttctccattcctactcatcattcatattattcattcgataaagaatcttgatcaattcttttttgtagagtggttttaaccctaaaatgccactagatcgcattaactgacggtttctggtttgtaaatccttgattgtctttccttcaatgatgaaaaagaagcttaagtcaggacgttcttgttctgctcgtttcaattcctggatttcctctactaatttcttttcatattttcttaatcgctgtagatttcttcctaaggattgttccatacgatttttatctaataactgccgcttttgcacgatttgttccgttagatccgtctctgtggtcaaattaactaacttaattgttggcacatacgtacgcatgacggtggtcaactgattcattcgttctagtttctcttgttcatttaatccttccacgtctgtagaaactacacgataataacgttgaaaatgatcttctttagtaactaagactccctcttctgtacaggatttataaggaaataaatccaagatcgatcgttcttctggttttccaaactgaaaaatggatttcttatcaactgaattttgtcctttgactcgcatttattcatcctccttatacgtgccatgataatttcggttaggatctaacgcatgatagtggttcttatccgtaaagaaaatagattcgataatcgcaaaaatctggcgttgaccagggttattataggggcgccaaacaatcactaaagctatcgcaatccataagccataattcaagagtgcaaaaaagagtggtaagtggacaagattattgactattttcgcccaaaaaaagcaaccaccaagcgttaatagatctaaaaagaaaaatgcgaaaaacttccattccccactaaatcttggaggatttttcatgttaatatatttatccataaatgatttccccttttcatacatagaaaaaaggcctaactcgtaggccttttatgatttgatatccttcaataattgttctttcaattcattgttcctgtttttagtttctcttgttacatttatttttgttggtgcagtaaatgccacatttgctggtttgtaacctgtgtgaactttttgaataggttgtggtgcagcttctcttgtcacaacattttgaacggacgcattccctgtctcaccactttcagataaattgtaagaaacagttgtcagatttccattttcaggcaaacgacttggtttcatttgaacagtacctgcagttgattgatgaacaaaactttgatcattctccttgaattgattcaaacgactatctttcattggtaaattttgtgccttaggtaaaccaattttcgttgatttttcagttccaacttcgactccattatcatttggcagatcgatggaatcatcatccgtttgtacttcttgatttcgttttggtaaatctgaaatgcgcttttcattttcagaattaatgttagatttataacgatattgttctggatctgtttttggtaattgaccattttgtccttcttctgaattttcgttagaatccaactcatcttggtaatctttggctgaaggaatcgctgcaccttcttgattttctttttcggttgttgtatttgccttcactgctgcattgacttgtccttcaccatacgcatcttttagtccttctttgacttctgaagctttttctttttgtttttctagtgcttcggatggattcttcacagcttcagccaattctttagctctcgtgccgtctaatttctcttctaaggtgtctttggctttttctgtaagatcttcagctgttccttttaacccacgttcattgacgtaaccaagaccttctgcggctttagaaacaccatttttcgctttcccgaacatttcggaaactgttttcttactattaggtacaattgtagctttatcgtctggttgttcttccccgttatcaggaataacatcttttcgattgccaaatccatttttacgaatatcatttaaattgcttaaaccactcttaccagcacttgcaaggtttttagccccactacccacatttttcgcaatatttcctaaggcaaacatgctaagaagagaattgctgccgtttttcagacttgtatcaacaccgaaaatcttcgtaacagattgagagcctttgaatagcgcaatggttagtacaattaaagcgacaacatacaaaaatccgttgatcttgcctgctgcgtgcaaatcaccgatacctgacagcattaatgtatagattcgtaattctaaaatcgtaaacgccaataacaagaaggattgagaaatatcttctatagcacttttcatccgttgtcctgtctcaaagtccgttgacgcggcaattactaaatagaattttttaaataccagctcaataatgcaagttacaatcgtaaacaagataaataaataggcaaccgacaaagaagattcaccagctaaaataatccctggactactaatgtatcggcgatagcctgaagtatacacatattttgctaacccctcatcactaatctctacagggatttcttttccattatcatccagttccagtcggtattgtaacgctcttagccgatccttttgtatatctgatagaccgctcttatcttcatccgccatcttagcggcttccttaggaataatcactgaattaatatttgctgtcttaaagtttttcgccgtgagagcatttcttttatctgttggtagggattctactttattcggatcagtttctagtagcgtactcacatcgatcacattattttgaataatttgaaaagcaggtgatccagttttatctgctttatttgctgcagtcacgtctccgtaaaagtttttactaatatttagcccttcatcgattaaagaactaccaccaaaaatcaaaatcatggccataaatagattaaccaagatatttttgatttttggtggatgtttactcataaaaaattttaagcctaaataaattaatgtgacgacacaaaaaagagccaataccttactaatcaaactttgaaacagttcattaacaccagcagcgttcaataagtcttttaaatcaaagctttgataaattgttttttctagtaaagtattgagattatataaccctttaatcaaaccccataaaaaagtattacaaatccaactgaatacatcttgatactgcagataattaccataatcttgtaagactttcgttacggttttgggatctgcatccccatccccaaataagcctgaccaccagttggcaatgccggaaaatattcctccaatgatcattctttcaccgccttttcagcttctagcaaaagtcgtttccttataacctctgtaatttcttcattttgatgcaatttttcaaggtattcttgcaaacgatctatttgcttctcttcataaaattgaataagtaacttttgtgccgttgagttgtctaaagattgaacgattttaataaaaatgttttctttagcttcctcttctatttgatcgtgcatattgtgataaagtcgacgtgcatagatatcaggtagaaaataatcgtaatcaatttgtaaagccttaagatccaagtccgcatgtgtacaatgtatgtctatatcattgatatcccacgatggattgaaatcttcaatatattgataagcataaggaagattcgtttccccatgattaaaaataggatacggccgtattttatgacctttcaaatcttgtcgttttaaaggagcgagtacaatcgtttcaccttctaaaaaagtagaaattctttcaggagttaagatacgatctgaatcaacattgcgattgatatgagtattcatacctaatgaattggtggtactgttctcttgttcaaccgtcttattccccacttttttggaaaattcttcgatggtattatcgtctgtcgacataatataaatatgtgtctgacaattttctttgataatcgctgcgttttgttccccatacttcgcataaagttgctgataggattgaataaacagatcccacaacatgtttctaccagctgtgactgtcatgattccttccatattatccattggtggcatattcccaaattcatctaaaataaaatgaatcctacggtgacatttatctcctttagtcttaacacattgcgtagataattctttatacaactgactaagaaaaatactaacaatgatatggttagatggatcataatcaggtgtgagcataaaaatagccattggtttatcggtatagtgcatccgaatagactctactaataagttacttttatcctcatctaatgttagaacagcttctttttctaattctggtaaatgggtttctcctcgtttttttcgataaacgatatttccctcttcgtctttcaatactctttgagaaaactcataccaagcaacatattcttttccttgatgatcgtattttaagcaaacatgatctccctgctctaaatgacaatcaaagttgatttcacaaaaacctctataacctactttgacacgttcctcatgaaattttttcccttgatgataaaactctacaacaattcgctgatttaacagactctcgtgtagtttgagatccaaatacttcggaaaaccaatggacttataatcaatggttgattgagaagtcattttcgcaattttcgtcagtgtaaatggatttagtcctgtgattgccgtcgataaaatattcccttttgctttatcagaaccaatttttgttgccccatattgtttttttgctatgtttccaggtggtaactgattcatgaattcatctaaggcattgagttgtttgtaatcattctcaggatcttgataattaaaaccgccaatttcagaaagaagctcaacaagattattgggtgttaatttggagtaatcccctgtttgatcggcttgttctaacaacgcaaaaataagcgcatttacagctttctgcgcattttcgttaaagtatttattgtctgaagcgttggcatcataataaatcgtattcgtaaaagtattggttaactgcgttgcagtatctatgtctcctcgcttccagtatttcacgatgagtgccaatggattatcactcattgattgcagtggatcggtgatattaaatgcatacacatcataccctctagcttctagttcatctttactagcaacatataattctgtttttggatcattaacaaccattgaactttgtctttctgcacgcgacaaattgtcaatggttgctaaaacttctatctggcctttccctgaacgggaagtaccaacaatacaagtatttactgtatccgtctgaatataccagtattttttataatgagtaattggtattccgccataaccaggaaaacttccctttgattctggtatttgcggataaatttgttggatttcctttaacgtttttaatcggttatctcctttttgcccatctgctagaggacgaaaccacatgtccattttcaatcccataagtatagctggaacaacacaaatcgtagaaacaactaaacgtgtgcctaaacttgttgttggggtcaaaggattccaaaaaccagttgaatcaaaatggaataactgcggcatttcttgtaactgaaaaatattcactccttgtaaacttcctggaataatctcaaatcgatgaaatgcttctggtattcttgtaacaacatagtttaaaggaagataagctaagccactataaaaaatcttttgagaaatacgtttgtcatgtttttctggtagctcttctcctgaaggagtatagcgatagaaatgagaaagatacctattcttttctaaattgaatcgtttgtcttttcgtctcgttgtttctctaacacgcattatttcacctcatttgattctgaactttcggaagtgtttgattgtacagttgaatcgcttgatccttctttagccttactaggatcactctctttgctattttccatacttgactctgttgttgactgattggtacgattcaataattcttctaattgttgttcatactcttttcttgcttgttcttgggcttcttccttgattgacgtcgttgtggccacagaatcagcctgtgaagattgattgatatgattaaaagcaaatactgttcctccacctagaagcaagcttaaacttgcaatacatcccaccatccatccgttaaaggaacgctgtggtgaaggagttaaattttcttggttgttcactggcgtttgaacagcagctactggttgaggttgtgctagataatttaactgtgcttgtcgcaatgtatccatttgttcttgacgttccttacgagcagctgcttctttttccttttcttgctctaaccgttgtttttctatcgccatttgttgttccgcaagatcctgttcacgtttttttagttctaattgttcgcgctctttttctttttgccgttgtttttcttcttgttctttcaattcttgttgttgaatttcatactcttttttccattttggaatttgtacttgtaattcttgctggatctgttcgtgtttttccataagaacttcagtcgttgtttgatatagcttattcagttgttcatttaattctttgctaatctttagcttatctgtacgcaaaccttgataaaattcttcttttcgttctttaatacgttcttttaacaagttttctttttctttcgataacgcttcttgattcgtctgagtaaaattattgatctttgctacacacaaggaatacgcattgtcgcgtttcttttcgtatcgctctttaattttttgtacttcttcttcaatcactcgctgttcttctttatttagttcctcttttgctttctcccaattagacgactgttccgtcgcatactcattaatttcttgatctgtttcttgttgacgttcttcaaaggtggctaataaatcttcttgtgcaagctcatgccaatttgttgattggacagactctaactgttctaaaagtgtgcctttaccctgtgaaattaattcttctttactctctaaaaatgcttgataggtttggggtaattgatatttcgaataaagctcatttaaaaataatttgtttttttctttcatccattcatgctctggcggatattgatccaaaatataatcaaatacagttgccttttgtatctctatttcgtttttttctacttcttcactgataagtggttcaatatattcctgagaatccccttcagtccatgttgactcttcattagcttcaactggatcaacttctacttcggccgtctcttcatcctccattgtttcttcaaagggatctacctccaattgacccatcacatcgttctcttcctcaaatatcgatttctgagtcggaatatcagcttgttcgtcaacatagactgtctctttttcttttgactccttctttggaaagattggtcgttcccatggtacttcttcatttacttcgacttcactcccttgattcacttttctctggtcgctctctaactcttcttctaaaacttgtaaaagtttttcgtttcgataagactcttccacactcatagtttcatccgtttctttaaacacatcaaggcggattaaatccatcaatgtaggatagaaaccttctgaaatttgataatccagtgggccaaaaacgtattctgtaccagctttctctatttttccttctgtgtcatgtaacgtgagagtcaacttaacagaagatcgactttcgtgttccagtactttccctaacacatgtagctgttcttccgtttcaatgacagaatatttaattgttttcggtaaaaaagaagtccgctttcctacttccttcgttgctttttttattaactctttatctgttttggtattgcctgcaatcgtaaagtacatgagtattctcctttcataaaaaaggagtaaaaagtatcgactacttcttactcctacttttttactttcttataatccttgaggtgtttgtccaaacaatccaaataacgaaaccacaatagaagctgctgctaaaataactcctacccccatcaatacatagcctacgtgcatcttcccattttcagctcctcttcgtccaaataggaagaaaagacccccaataacaatggaagcaacggccgcagcagcagcaaaaatcatcagattgttttttaaactagttgcggcagtttgtaatgctctaaaaatatcaaccgcagctactactttcggttgtgttaaaaaattcattgtaattgattcaaacataaaattgttcgctccttttagtgtttaataatttcatcgaaaacaagcttttcacgttcacgttgatagatatatccttctaagtccttgtcttttccccgtaataggtcaaattgtgctttttcaaggacttcttgtttccactgtgtttcagatacaccgcggcgttctaagattttagacgcggctttttcaaatggcgttttagcttttgccactgtgattcctccttcaggacaaataaaaagactagcaatcactcgctagtcttttgtaacttatatttattggattgtgatccatcgtgaatcaatttctctttcgttcgcttttcatccttgctagatccaagaaaaattattttttttacgccattcttctcatagggaacaacaataaataaagaatcagatttgtttataaattccctaacaccagctgaatctactattttgtatctttctaaacctttatagtctttttgcctcttgactgttatttgtacaggatctggatgccatacactctcagagtattcccaggtagtctcgtctataattttcaaattataaacaagaccacctacttcttctttccacatagttcctgatttcaatacgccattatcttgattagtttgtttatttttttcattactacatccgactaaaataacaatcatggcaatcaaggaagtaactacgattattaactttttcattttattcattctttcgtttttttattttaaatgtatctcagaaccgcataactaaaagttgctaacacaagtaatagcaagctgaccgctgaaatcgttactaaatgtgtagaacctgttttaggaacaatgacctgtggcaagttaggatcaaccccaattgtcacaacatttgttttattagaaacattatctactgctactacggcttggttatcaatatttttttctgattgtaatggagttttagctgtaaatatcagctgaatttctcgtccatctaaaagattgttacttaagaagtcagcggaagcttcccacttcagcgttcttgaattgctatcataagttagtgtgccttcagaagtaatatcttttcctttactcttatctattacttgcgcagaaacttctttatatgtcaaacgagcttcaattggatcttgaatactaaattgtttgtagtgatctgacgcagcgtctacgccttttgtgtgccatttttgtgtgactagatattgtacttcagatcctgcgtttaaaggagctgtcggcgtacccttcttaccgtcatttcgtccgtttacatcttttccattttgttgtacttctttcactggaattttagggaaataaacggtaatgatatttgtatccttttctactttattaatgatcgacgttccctgatttttggctacactattttgattggccaattcattgacttttacattgatcactaattcgtaagtttcgccgttatacttcattcgattttttaatgtatcagctttcgctgcatattttacctggtgttttgttttgtcataggtcacttcaccagatacatcgaattttttatttgtaccactttcaacgtgtgcatcgacgtaatttacttcttttggtaaattatcgattaactcaaatcgatcgtaaaccgctagtaaatccactcctaatcgattcaccttctgtttgattcgatattgaatcgtgtctcctacttgcaacattttatcgttcacgttatttccatttttatcaacccctgttttttcaggttgatcaggaacaacactaaagattgtcgcagaagataaagtaaaccaggtttgaacattagaagaaccaatcacaaacgtcggatttgcttcagatattttaaaggacacagtaccttgaccaaacttcggatctcctaatttatcatgcaaattattgaaatcattatccgcttgtgtcagcttagagcttcctcctgggtggccacctaccacgttcagattgttgtagaaagatttaaattctgaaagaaccgtatcttttctgacataccaatctgtcgtattcattttgtcatagtgggcatattctcctttaagatccgtgctttttcctcctgcagggttcaaagagttaaaactgataaatgtatctcctgaaaattgaacggggctaccgtcctcatatgtggctactagctgcacattcatttgtgttgaatggtaaacaattcctgagaaaagattgtctgagatccaaagtactgttctttttttagatttactcattgcaccattcgtatttttatagccatcgtctcgaaaatgagtttttgtatagttgttatctagtagattccacggcaacgtatccgagtataagtgaatattagatagaactagcttgatattgacttttttcccgttatacgtaccgatttttccatagtcaatattgactttggtgttggttgttacgccttctaaaacaaggtttgtttcaccgtattctttttggaaagaaggatagcgtatatttttgtttccctccactaatcctacgtagtcgtctgtaaaaccacctttgttggcatcaacatgatatttgtaaacttttgacgctccgtttacagtaatatttgtttttgcattaggaacatcttttggaataataaaattattctttacgttctggattggatttgacggatcgacaataactttttcagcaaagacattggctgtttttaacccaaacaatgtacctaacatcatcattatgggaaaaacatattttaaccgtctggtccacgagtgtttaaaattcatcccttcatcccctcttttttataaatgactagtgaaattccgacaataacgatcaaattgatcgtagtaaataatggattcctaatgagcttttccataatatctagcggcatggaagcagctggtatgtttaaaatcctcattaggtatagttggtagcttgacaaaatagataattgagaaaataataaaccgcagtacaaaaagactgcggttaaacaagaaagattgaataataataatttgatcagtttcatcttatttcttccttaatctctagaaaacaagtgagtaacaaaatcccaacaattctcaaagaagtttttctttacaccagtagaaacgattttttttacttcttctttaggttgcgaagcttctgatttaggataaatccacacatcctttaagaattcaccgtttttatcagaaacaggtgttaatagcaaaatatcctcgctattagaaatgttttcaggacttgactcattgacaatataataagcttgtttctgatttgcctgtacttctatcgagaattcaaagacacctgtttgttgatcaattgtctttgtttctccattagaaactagcttcaattgatcactggatagttttttcactcgatctttcaattgggattcaatttgatcagtagtgagattcttaacatccatcttttgtaaaatgtccgatacatcataaacagaaaacttcgcgccatttactccttcttgtttttcaagcttttgcccctggttgtctaattgttcggaagaaataatcttttgaacgtgaatggtctgtttgactatttgatcgtcttcagcaattttcggttcttctgaagaatccactgttgacgaatcgacggtttcatcgctgctttgaatcgtgctgctatctgacgtttggattgtttgttctgtgctatccgtgctttcttgactgtctgcaaacgttaactgtgtgtaggcagtgaaagaaaaaagagcgactgcacaaacaaatagccattttctatttctcatgttggttaccctcctttattttttctttttataaacaaatagcgaaccaatgatcatgactgaaagaaaaacagtacttcctaaaagccatttccaagataatttttgtttcctattttcttcatcttttaattctgattttgtaaaggttactcgtttcccatacactaggaaacggtgtgtgttgattcctttaggcgtacatgtcattagcgttactcgatcttcattgggatttggttctaagtaagtgacaaagtttctttgtagttcgtctttttgcacttcctcaatccgatcgatttgataagcgtgttgctcaccatcaactttgatataaaacttttctcctttttttactgaaggtaaatcatcaaaaagattatctttataaagtccactatgacctgcgattaaaggatttttaccgtttcctcctgtaatatcaccagttccttccgtaatacctacaccattttctaaaattttgtcggacgttccgtcataaattggtagttttaaagaaatacttggaattgtaagaataccaacaggatcgcctaactcaatcttagcaacatccaaagaagaatccgtttctgctgccgttcctgttcgatcgattgcggcaatctgctgattttgttggtatttcgccacgctcgcttcagcaggcatcaaaagtaagacacctacagctgaaagtaaccagaaagcaatgatccatttacccatgattcgctttttcttaggcttcctgataatcattggttttgatccttctaggctttcttcttaaagtaaacaactgcagaaagtgcccctgctcctagcaacaagcaagagattaatacatacgtttgaaaaccgttgctaccagtcattggtacggaagctttttgattgtttttgatcgtgattcggttttcttctttgtatgaatctttgtctactttgaaagagatctctttcgttaatttttgatagttttcaggcgcttttgtttcttccaatgaatattcaccttcagttaaaccagtgatttcaaattgaccttctttatctgattttaggatcgctgcatttgctacatcgtctacccatactgcttctttgacaccgtttttatccgtatcaactaatccaccataatattttccttctgcgtttttagcagcaaattctgcgctttcaagcggtgttgctttgattcctgttccaaatagtccgctatcgacttttaagaattttgcaccataagtcacaacgtcagctttcgttttttcgtggtgttcttcctgattaaatggattgttgttataaacgaaatccacgctatttgttaatggattggcaacagctgcgctgtcatttacatacatgttataagtcatttgaagatcttgtccgtgtaaacttgctacagtatcacttacttggccattattcacgataaaatcgatcacaaagccattttctgaattttggattttataatctgtattttcttttaataccacagatccatctttatttgttactttgatatttgctttagcagcgacataagaaagtccttgtcctgctgtatccccccatttaaatacactgtaaggagaagtttcgcttttcactccgtttactgtgataccgtctgctccgcctgcaatgtctgttgggatatgaatcgttccttgataatttactgcgtcaccaatttggaaagaatgttcttgtcctgttccatttgttactgttttatcgatcactggtgctttatagtttacgtatgaagcttttaagtcacttgtcacgccatcattcgtaattttaaaggttaatttattgtgcgcatcgttgcgagcgtctgcgcctaataaatattgatctgctgttggttctttatctgatcccactacaacttctgaaggaacttccacaaaatagtattttcctaacgtcaaatcagtagcagtcagctttccttgatcatccgatacaagatttcctaattttgttccttttccaggttcgcccttgtataactcaaattttgccccttttaaaggtgtttgtttgctttgagctgtgccatcgtcaccaaatttcgttaattcaaaactcaacttagaaacaatatttttaggatataagtgaatgtcttttaaaaaacctgaacctgtattatcagtcattggcgcaatcacaaccattggttttgctttttgtgtgactaatccagcagcggatttactttcataaaccacatatacattccctttggaattgacataggctggttgatcagcaaaagtaatctcaccattttcatctacagctgaagtaattttgtttgttgcattcttgacgtactcactgttagatcccttgtcttctacatctttaacgatttcgtccactttcgcgttggttagatcagaatcttcagtcggtaatacttgatccgtaatatttcctaacgtaaactcaacatcaccataatctgccttgttgtatttcgttacacctgtaggatattgatcgtgcgtataaccatcgtttttgatcccgtcaatatcaacattcaattgcgttccttgatcgtacattaatttatgaaccgtgatattgaccttctctggtggcgttttttgcgtgatatcttctgcatatgctcgatatccctgaaagcagcctgcaatgattcctaacattccaataagcattccagctttttttacataccgatttattgccattttttactctcctcatttcatatttcaacgactcgcgttgattaaaaccttgttattgtagctctccctgtaccacgtatctttcttttccttgtgacgtatagacacaagtaaacaacgttaataagggtttctctcctttctttggcaaagacaagaaagagttctcttcaggaacgccatcgattaatttaaagtactcaggtacgataaatttacgcgttaccttgtaacgatagacgccatcgttactaactaagtccatcacctcccctaatgacaacttctgaatatcagaaaataaaacacctggcatttccatgttatgacctgctaggacatagtttcctttgcccatttcggcatcttcataaaaataagtagccgctccaagactcaaagtgtattgatttgcccctttaaaaattggcaatgctaaaccaagtgcaggaatctgaatttgtgcaaatacttgtttattgacgcccatttcgattgcttctttttgtatggacaacatttgccccaaagacatatcattattgacgttcgttgcatcctccttataactctttgcatgtgcattgatttgatctacgggcatctttttttctatattttgcttaaacacctctccttcatgtttttggtagctaacatagccaaacacactgcaaaagacgattaaagtgactcctaaaaaaccaaataaccattttttcatccatctgcctcctttcagacaaaacaaaaaaactttttctcatttccatagaaaaagttttaaaaatgaattctataagttcgtctcaactgttcaaagtttttcattgaacctaacaaacaagctttctcttttcctgttaactgcatatcattgatatattgcgcgacagataatcttttaaggtatttttgcttcatcgtttttagtaacttttcttccatttctttcgacactttttttctgttttcgatttcttcataattcatgagttttcctaccttccttgttttttgcaaaaataaaaaagcctatgatcacatacgctctacacttcagtcttgggttatctttttctttcgtttaattactggccgtgctggtttcaaatccttgattccattatgggttctccaataatcgaattcttttcgcaatctttctttttccatatctgttcctttagataaggctttgaatacttctttaggtgaataaccacgagctaacagctgtacataccttccttttgtcaaagtatccatatccatcgcctctaaaactggtcgcgccatctactattcctcctaaataaattccttactcaatgcctaaggtaatactacctttttattaatcgtcgtgactccttctaagcctttatctgtaaaatttattcctccagtttttattcttctttatccgctacaaattcaatgatttcaaagctgacaatataatcactcaaatatgaccaagtatcttcaacagataattcgtctccattatcattcataagcgtcattttaaaccattcattaccttcatcatcttcaggtagcaagccgaatccaattggattatcagtcaatgtttgatcgtataaatcatcctcgtctaatgctaaaacatctaatcctttacaatttccgccccttctaaacgtcacaaatcctttgtaatcccaacgttggaaagaaaccttaatagtatgtgtgcccaatcgtatattcggatcataatttttcatttgtcattcctccattacgtaaatttcattttctctatgttttatatcaattttttcactttattcaggacttgttcatattttatcgtttttcgtttacttaaaaatacataaaaaatttcgactcgtttatggcgtccgaaacgagaaaccctagtagacagcggtaaatgcttgattgatccaataatcaacgtcctcgcaagtatctacatgtactgcagcacacgacacaatttcttgtgcgtcctccccattacgagaagacctactccttattccatgagtttgcgtcaaagtctagatcccttagtagctgctcatgattaatctagacgctattctaacttgtctaacttctaaattccctcttgtttactctgcgcttattatttacacaaattcatttcaccactattcaaacaagcgcatttactcgattgaccaattttttacgttaccaatcgttaaaacctaccccgtcactccccgaagggaattgttgatagatcaagtctactccttatttttctagtgactctaagttcctttagaagtctcgacaatattttcaagcaagcgaaaaacgataaaatacaagttatgagaatgatcaattcagccgatcaaacgccccatcccttttgcggtacaacgcaagactccattttttcttcgaccaatcagtacaccgttttggtcataaacatgtttgattgttggatatagctcttttaaggggataggatcttttaaaattatttgcttttgtttcccaatgtaataaatcatttcctctgagactttgtctttctggattatatatttcttacactgcacaacggttttactttggccagttgatagtttcttcgtgattttctctgtagcggtacaccgtttaccgtagtgacaaatatctttgagactcaaaattcctgtatatgacataaaataaaccacccaatttctttaaatatttttaacaagtttttcttgttatttttcaaaaatagagaattgattttcgttcatgacaaacaaaaaagagggaacgcatccaaacatgcgttccctctaatttcagcgttcgtcatacggcaaagagccacacggacatttttataacattatgcttaggcatagattcatcgtaatatcacgtatttttaaccttaacacagccaaaaaaagtggtatcacttttgaatatctgttatactaaatccattgcgggtaataccgtaacactgaaaggttaacgcattaagggccaaatcttaatgccgtgtatgaacgctgacgaaggttaccagccttccgagttcataccgcctttcttttttttgtattttcaattgtccaaatttatcatccaaaagtgcagaacgaaaatcaattcatcacaagcatagcagacaattaaatttatacaaaaaatgtaagcgaataatattcgtattgcctgaaaagaagtaatatcaagatttttagcttgtttaaataatgaaattatctctcttcgcgtattattataactcaaaaaaaaggagtatgcaaacatacgttcccttttctatatttgaaattaattatttcttttaacacttatgacgtaaaaggctacgtttgtgatttttatcataatattttaacttataaattctattaaaatagctattattttgtaatattcgtaatataattagaataataaaaaatttttaattttaatgttactccatgaagcaacaatcactttgtcagtaaagtttcactctaaccagtctttcgtaatagtgcttggggagctttcataattcaaacgtttttcacttgatactttagcagctattggtttttcgataaaccaattttttacatagacaaaaatcaggttctggatattttcgaccttttcggtttttaatttttgataggcttttaacagtgtcgtgtataattcttgttctgcattgacataataactatcgagttcttcaaaaactatcgaaataccactttctatttcagcttttttctttgcattatgaatagtctggacggttttttgagcttcactgtaacttgaagaaaatgtttttatcaaatttaatactcgttcagggacaaacgtagcaatgctgtcgtttgtcataattgtctcaaaattgtctaacaacaattgatcttgtaggcggtctttttcagtgtctatattgtgtctattagtgtctaatatattattattaagttctggtatgattttcataccctctgatttatcaacgttttggcacggtatgattttcataccctcttgagccccaagggattcagcgtctgatttttcgtcgagggtgggtatgattttcataccctctgatttatcaacgttttccctattctctctatcaaatttttcgagtaagtagatatcattttctgagacttttaattctgctagatatagtctattaggattatttttccctaactgtttgttaaatcccatctgcttttgtaataataaaccaaaggattccaactcttttttgattgctatcgctttttgtttttggcagtttaatactctacatagttcatttgtcgtataagtaaaataaacattaccttcttcatcgatttgccgtttgctgattgcgatctctaatcttgcttttaaaagcatataggcaatcttagttgaatctttcatttttttgtattcgtcagaaacaataaagacttttggaaattgataaaataattcgttgtaaactctatccgccttaaaaaatttaaaatcagtcattgtagatcctctactttcacgttgttttatttatgtaaaattacctactcttttcgaaaatagcaaagataaataaaaaatgcaaacgcattaaaactgttttttaattaaatactacctaaaatcagaaataaaatgaattatgtactacctttaaagtcattaagaactactttaaataaatattatttataattaaatactaccagaaaaacgtatgaataaaatttagttttaaaattaaagataattaagtactaccagtgtcaaaacaaaaaataaattaagaactaccttatgcatataaaacatactaccattactagtaatatatactaccttatttcagtagtatatattatattattcttataagacaaggctttaggctagaaaacaatagattatatactactaaaaaatacaataagtactaccaatgtcagatatatataataattatgtactaccattaaaattaacttatttaataagatactactgtgttaatctgaaaaaaattactttaaagtagttacatactacctgttaatttagatactaccattaatacttaaattagatactacctatatttatattaagtactaccgttctaagaataagataataaaaaaatactaccaaattgcaattaaatactacttaaaatgtaaaaaataagaactacccaaattaggtagttcttaataagagaatatcagataaatttgtacaagtcataaaaaaattaatcttaaatttttaaatatatatacttgctaattataaactactttatttaggtagtacataattaacagataaaactacatgcttgtagtttgtctagctaatgagttgcatatgatttatataaaggtgtgcagcataacttagttgaagttaagagaatagaataaatattttttgttttgctaataattaaacactacctaaatatggtagtgtttaattatataatattcattttgttacaaataatcgtattataaaagcataacaattgggataactattttttagattgtttaagtactacttaaattaggtagtacttaaattttggtttaaggtagtaggtaattaagaaatgatatatatcttcttttataatagaaggggagaggcctagttaaaagcagcgacaattaataacaatgtatttaatgcttcacaaaatccatttggtggacaatgcattgttattagcgatgatctaccgttctaagtagttttttctattggttgcattcgtgactaattatggtataattatgagtaacaaagaggtatttcattatatcaccaaaccccatcagcgtgcaggctgatggggttttttttacgtttctatattatagaattaacgggtaggcttactgtcttttttggcaattttgcaatcaagccatttgcagaggtaactgcacactacatctgcaagtggcttgattgcaaaaacaaaatcaaaaaggtatttcattatatctcctcctccccttgccagattaggccggggtagcagacagcaaaactattataacataactgaaatacctaaatgacatatacagatatgataatttatgtattgatttttctaacaaaagcacatattttaatatatactacctattttaggtagtatatatttttagatacaatatcgatcagttttgaggaaatgaaattctagatattttttgctacatagagttactttcaatattttttaacgtaattaggcagaagtcactcatcctctataggtttgtgatgaaattgccattgatccatttaagtaagagcaaaaaactggaggtttatcaggtaattggtctaatggatttaagtatgcggtcaccgtgtatagagttgcttatgagattcaagaaaataaagttattccagtattgctatatggaacacataacaatttttatgaattagccgagaacactcgcaactttattcgtgtagatgaatcggcttcggttgagttataactttagctatatcaatcaaccgaccgacatatgttaaatctatatataataaaaatacctacttaaatggatgttaacggaagtgtatggtgagtagttcactcgtattttgatatcgtttgtatatgttttcagcgttctaagtggcttattttgtccaataataatatggagtggaatcccttaagaaacaccgttggcaattgttgttataacatgttataatttattcatcaaaaactaaaaggagtgtgataacatgggaaaagaactaaaggttagaaagatcggcaatagcgtgggagtgatccttccaagctctcttggattaaaaagcggagacactatccaagccaaacaagaaggcaacttattcatattagatactactcaaatagcaaaagaacacgatcgcaaattgattgaagaaagtttccaagactttgagaaaggtttaacagtttcagaaattgaaatggtaaaagctttcggaaaatacggctggagtgaatagatgaaagagtacacgctagtttattctaaaagtttccagaccagccttgaaacgataatagaagaatgggaaaatgagcttgctctttctccagccagcataaaaagatttgtaggtgcgatccagaaggctttagaactaaccaaaaattttccaactatgcatgaggaagtttccgaaatctatggaatggatatcccaacatatcggatcgtgatcggcaaaagctatgccttattttatcggatcgaccatgaaaaaaaagagatacttgtaggacgtattttccaatctaaacaaatgaaactaggcttttaacaataattaggcaaaagtcgctcatcctctacaggtgggtgattaatgccgctcgatatggttgttaaccgtcggttactcgaagattgatatataagacttagtacctttttattttgctccatgttatggccgaaggtctaaagatacaatcattagtctagagaaaaattaagaaccgtaggaactacggggatcgcttggtgaataagagacactgctattagtgaaaaaataagatatcaagtacgctctattcccaaaaatttcgtgactttactcatgagaggttcaagtagtatatttttaatcaaaattgacgtaacttttaataaatactacctaaataaggtagtatttatttttgtgttttaaaagaggaagtccaatatatctatggtaaacttcttaaatattatgttggtacatgaaaatataggttctgttgcaaagttttaaatctactatcataaaaatattttattaatgagaagcttggtagcacggttattcatatgctaatttatttcactttatagtaaggggagttcttagtatattgttcaaacttagatttcatataatttaattatgtaaattagctattctaagaacttctacggataactgcccgtctaaaatttaaataagagcttagaatcttcatataagtaaggttaatttttttgtacaaaaaagtcggaatattctgaattactgaaatgatataaaatcataaactaaatcccttgattttattgactttcaaaagtttatatatataagttaatgattatggtaaaatatatacataatcattaactcagaatatttttaagaagggaaacaatagtgagctataatgtacaaccgttaaggacaaatgaagagatacaagattttcagttttggctaagaagaacaagtaatccggaaagagatagttttttatttttgtttggaatcaataatgggttacgtatgtcagatattataggattaaaagttggagatatacgaggcaaaagtaagcctattattgttgaacataaaacaggtaagcgaaaaccgatttttatagataatttgagagaagaaattttattatatactgaaggtaaagaagaaaatgattggttatttccgagtcggcaacaaggtcgacatataacaagggatcgtgtctatcagatatatgcagatatagcagaaaaattaggacgagatgatataggaacacatacattaagaaaaacttttgggtatcactactacaagaaaactagagacattgctaccttaatgtttatttttaatcatagctcgcaagcaattacaaaaaggtacattggtataactgaagatgaaataggagcatcacttcgtggatttaaactaggtgtataatttaaaaatttttataaacagtaaagacaaagattaaaagctatttttatctagaacgattttatttcataaagttcgcggaataaaagctggggttactggtacttggtataggttcgtgttatataaactaagtaattaaataacatttttaggttggaaaaggatgaaattaaaaaagagaatcaatacggtctcaaaaacgcaaacgctgcggaataagaaaaatactgataactcaacgtttagcagactatctaatagggatagtctgcttttttcgtttttgaccatacttttgaccttctgcaaacttccttgcttttcctctgtagaactcatgaaatctgcaaaacgaattgccgtttcctctgtctgctttttcgcgatatgggtgtatatatcatccatagtggttttaatatctgtatgtccaagtcgaacgtacacttctttgacagacgcaccagattcaaagagcagactacaatgggtatgacgaaaaccatgaagtgtgatatgttttaagttattctctttaatgatgattttcaaattgtgatttacatagtctaaataaaggggcttattttcttctgatgaaaacaaaagttgttcaccatcttttataggtttgattctcatttttagatattatgcccgcacgtattcatcacatttctattgtgaatcgctttattcgaccgacatttgacttttatcataatatactcggtttaaaattactaatgaaaacaattaatcaagacgatcataccatgtatcacctgtttttttcagataatcaccaccgtgtgggaactgaactgactttttttgaagtacaagaagggaacaaccagttttttggaaccaatacgattgaacgaacgatactaaaagttccttccgaagcatcattgcatttttgggaaatatattttgaaatacaaggcgtttgccattatggaatcgaatcattttctggacgacctatcttacgttttgaagggccagatgcaacacaattagctttagttcccttacgcgaatttgaagatattgatgattatttcccgtatgtcacagaccagatccctacagagcatgccattttaggaattgatgccattcaactacgcgtacaatattccgatgcgactgaacgagagttattgtcggtaggctggcagcacaaagaatacgtcagtttcttttcgggtcatcaacgagtgacaatcttagaaaatcaagacactcagttctatcaagaagttcagattattcaagatcgtgagaatccagttgccattgaagggattggtagcgtccatcatgttgcgtttggcgtagaaaataaatctgatttacaacgcatcgacaaacaattacaagagcgcaattttataaattcaggaataaaagatcgtgaattttttgtatcactttattatcgtgacccaaatcaattattgattgaaattgctacaggggaaggaaacctagatgcaaaagcgtatgaaaatcaaagtccacgctttgaagaaattcctttgtttttaccgcagtacttaaatttcattcgtgaacaagtggagcaataattagctaatcaaatccatgacgaagagtaagaggttgactcataagtcaaaaaataaagaaaaacgcatcaaatccattctaaagaatgttgatttgatgcggttcctatttttataaactatcattttcgactaataaaactacttatgagtcagcctctctttttttcttgatttttatacctctttctaggtaaactaaacatctgccaaaaataccgtgtctcattgaaacattctcaactatttcaaaataaaggggagtaccaaatgaacgagtatattgaaattatccacgcaagagaaacaacttaaaaatgtcagtctcaaaattcccaaaaataaaattagtatttttaccagcgtatctggttcaggaaaatcatcgattttttttgatactattacccaagaagctggtcgtcaactgaatgacacctatgatagttttacccgtttatttttacctaaatacagtcgtccagaggttgatgagattgataatctttctacggcgattgtggtcaatcaaaagaagattggtggcagtgcgcgctcaacgttagggacgattactaacatcaatgcgttatttcgtgtgttgttttcatgttttgcaacacctagtttaggatatgcaaatgcttattcatttaatgatcctagtggaatgtgttctgtctgtcagggaatcggtaagacgattgcatttttaataggattgctttatttttcggctattgataatgctgattttgtattttctgatccatttaccgcagaagctttgtctggaattgaggaacaggcaaagaatcatggttattttgtattggtgcataatgttaattcagcagaagatgttaaaactattcagagaaattgcgttttgaggggttcattgttgttggtgtacgtgtaaaagaatttttggaattaaataacgtttttgatggtcctgttgtttatattgatacgcatctttcaaaagagacattaagagaacttgaacaacaaatgaatcgtttatttgtaaatacaaatgattaccaagctagtacattggcagtggaacatttgattcattatggtcatgagaaaatagcgtttctttcttttgactacattgtaggtgaaccaagtgttattcaagaacgacatcaagcttatatcgatacattaaagaaatatcatttaacctttaaatcgcattggatatataacaactctgaatttgagcgaatttatcaagaattagctgaatttactgcaattgttgttactggagattatttagcggctaaattagtaaaatttttaaaaaataagaataaacgagtgatggaacaattatcgattattggatttgatgatattacttttgcagaattaatggatcctgcgttgacaacaatacgactaaatccaggtaacaagggggcgattgcttttcaccaactgattggactggccaaacaagaagaaataaaaaatcaagtactactattagagggagaattgatttctcgagactctgttcacaaaatcaaataaaaaagctctgtgaaataagtatagttaacaataaaatatccgaacgatagagagaatgaactgtgatctagcagttcctcgtcgcaaattcactagaattagcattatttactctaaattgttcggatattttttcttgtttttaattatgattacagtgcctatttttaacgaaatttgcttattttcaaaatgtatgattatattttagtaaacactttcaaatatgaaaagaggagctattatggtaggaattagggatgttgcaaaacgggcgggtgtgtccattgcaacagtatcgcgcgtgctaaatgaggatccgacactttcagtaaccgatgaaaccaaacgaaagattgcagaatcggttaatttttatcattatgtcaaaaaaagtcccgttgcaaaaaatttaacaaatattgcattaataacgacagtttctgaagtagatgagttggaagatccctattttcgaacgattcgcagagggattcaagtcgaagcagaacaaagcaaagtcaatttgaagaaaattattcgtttgtcagaaacaccgttggagcaagacgatttgctaaaatgtcaaggtgtgttgattattgggcaggtgctatcttctgtgattgaagaagtatcagcaattaattcgaatgtcgtagtgattgatgaccctagtattgaagctgaagtagatgcagtttatactgatttaacaaaagcaacgaatcagcatttagatcgattgtataaaaaaggacaccgaaacattgcgtttatcggaggaggacgtgttcgtttagatagccaaggaaataaacacgtgtcagatgatgattatcgaaaaatagcctatgagacgtggatgaaacaaaaaggattagaaaaatatagtcaaatttatttagaaggctggaccacacttgacggaatgcaggcagcagatttacttttgaaaaaacatgctaaagataagttgccgactgctatcatggtaggaaacgatcctattgctgtgggggtttatcgttcacttcaaaaaaatggtctacgtattccagaagatatttcgattgtgagttttgataatattgaagttgctgaatttttaacacctgcattaaatacggtgaatgtgaatacagaagaaattggaaaactagcagttcgcatggttaatgaacgaataaaagaagttagaaatgtttcgatcaaagtgattgtttctaataatattattgttagagaaagtgaaaaaaatatcgattaaaaaagtaaacatccaaaaaaggatgtttacttttttgtttactaatatttttagtaaaaaatctcgacaaaacattaagtaaacagttatggtgttgttaacaaaaagaaaacgcattcaaaacaggaggaattaagatgaaacatttcaaaaaaatagctttaacagggatagctgttttaactgggacattactcgcagcatgtggtgggggagatagtaaatctaaagacgggcaagtaactttaagctatgcgagttgggatactgaccaagctccaggactaagaaaaatgttagatgaatttgaaaaacaaaatcctgatatcaaagtagaaatggagacaacgccttgggatcaatattgggttaaattagaagctgcaacaacgggaggtaatatgccagatgtagtaaccatgcactctagcgaatcctataaatatatgtcacagaatgctttgatgggacttgatgatgttatcaaagaaaatgatattgacatgggaaactttactgaaggaattgctgatttctatacgcttgaagacgaactatacgcaatccctaaagatgcttctgtagtggggctatggtacaacaaagaattatttgataatgcaggtgtcgattatccagatgaaacatggacatgggaaacactcagacaagctgcaattgatttaacagatgaatcaaaaggcatctatggttttgcatcacatattggaacagagactggctactggccatttatttatcaaaatgggggagaagtatttgccgatgacaatacaaaatcaggtttgaataccccagaagcacaagaagctttagctttttatcgagatattgcacttgttgatcatgcttcaccaacaattacagaattacaagatcctgataagttaagtcgttttcaatcaggtagattagcaatgatgattgaaggaaactggtttgcaccgggatttttgaaaaatgactatctagttgaaaatgttgcttctgccgtgttacctaagggaaaagttaatgcaacaattacaaatggacttggttgggctgccagtgcgaatacaaaatacccagaagaagtgaaaaaactaatggcatttttagctagtgaggacgccaataaaatccaagcggaaacgggggcatcaatcccagcactaaaaggctttgaagacgagtgggctgcttcttcagatacaattgatttgagtgcttttggaaaaatgttggagtatggagtccctcgtccatacaataaagatggattacgagctgaacaagcagaagttcaaattattaaccgtattctgtctggtgaagtaactgttgaagatggaaccactcaaattgaaaaagaagtcaatgcgatattgagcggaaattaaattagttaattatacaatatacaggcgaaaggattctatttcgtctgtatattaatggatgaataccaaaaagggggatattatgaaaaatcgaatttttggaaaatatcgtaaagatcaagtgatatggggctatatttttatttttccaacggcattaggattaattttattaaatatatggccagcaattcaaacagcaattttaagttttcaaaaaacggtagggttcggtgatactgaatgggtcggattaagaaattaccaaaaaatgtttgcagacggtgaagtttttcagtctttattaaacacattaatttatgcagtggtttcgatacctagtattgttgtattatccttgttggtggcagttttaatgaatagaaaagttaaaggattgtcgatttatcggacaatttattttctaccagtcgttgctgcaccatccgcagtcgcaatgatttggcgctggatgttcaataatgattatggactgattaataacatgttggctaaaataggtctcgatggaccagcatggttaacggatccatcgattgcgatttattctattatcattgtaggagtttggagtgctattggttataacatggtgttattactagccggcttataagaaattcctaaagattattatgaagcagcggaaattgatggtgctagtccaatccagcagtttttcaacattacgttaccattagttacaccaacattattttttgtagttgtaacaacagttatcaatgctttccaagtatttgatgttatttttatgatgattactcctaatagtaccgccatgtttaaatcacaatcattagcctatttattctataaacattcatttattttaaatgacaagggatatggttcggcaatcgttatgttccttttagtgattatattaattattactgcaattcaaatgaagttgcagaaaaagtgggtaaactattaaggaggctatcaaattatgaaaaataaatttttttcaaatgcgccaatccatatcatgcttattttaggtggtattgcaatggcattaccttttatttggatgattttaacttcagggaaaacgttggttgaatctacccaaattccacctttccctgagaaatttcagctaagtaactatcaacaagtacttgatttattaccattcatggctttttatatcaatacatttttaatggttgttggacgagtgattggctcggttttattttcagcaatggctgcatatgcttgtgcgcgtctaagttttccagggaaaaatatccttttcagcttagtacttattcaaatgatgattcccggttccatttttattactccacagtatttattagcacaaaaattgggtattttaaatacaattccagcattaatattaccaggggtagttagtgcgtttggtacgtttttattaagacaatttttcttaggtttacctgatgaattggaggaagcggcctatttagaaggtgccaatatttggacgatctttttcaaaattatgttgccgcttgctaaatcaggattggttgcacttggaatattcacagcgttgtttgcatttaaagatttaatgtggccattgattgtcaatacttcaattgataagatgcctttagctccgggattagcaaacttacaaggacaatatgccacgaacttcccacaattaatggcaggttcgttattagcaatttggccaatagttgtgatattcatcgttttccaaagaaaattcattgaaggaattgctacaacaggtggtaaattataaaactattaattagtgattggagagtaagtacatgacaaaaattacatttattggtgcaggaagtactatttttgcaaaaaacgtattaggcgatgcgatgttaactccaagtctacaagatgcacatattgcattgtacgatattgatgaaaaacgactaaaagaatcaaatttaatgcttaaaaatattaataaaaattcgaatgaaaatcgtgctgatattgtttcttattatgatcgcaaagaagcgttaagagaggctgattttgttatcaatgctattcaagtgggtggttataaaccttcaacagtgattgattttgatattcctaaaaaatatgggttgcgacaaactattggtgacaccatggggattggtgggatttttagaaccctacggacactaccagtaatgttagactttgctaaagaaatggaagaagtttgtccaaatgcttggttattgaactatacaaatccgatggcgatgttaaccatgggtgttttaaaagcgacgagtattaagactgttggtttatgtcatagcgttcaagtatgcgtaccagaattgtttgagcatttaggaatagccgaccaatatgacttaaatgactttcaatggaaaattgcaggcattaatcatatggcattcttgttggaaattacaaaaaatggggaagatttctatccaacaattcgtcagttagctgcagaaaaaccaaatccacatccagattctgtacgttttgaattgttgaaacgttttggttactatattacagaatcaagtgaacacaatgcagaataccatccatactttattaaatcaaaatacccagaattgattgacgaattagggattccgttggatgaatacttacgtcgttgtgaacaacaaattaatgattgggaaagcatgcgagaggacattgtaaataatggggagttaacacatacgagaagccgtgaatatgcttcatatatcatggattctattacgacaggaactccgtcagtgattgcaggaaatgtcttaaataaaggcttaatcacaaacttaccgacagatgtttgtgtggaagtaccttgtttagtcgataaaaatggcgtgcaaccaacctatgtcggtgaattgccaacacaattagctgctttaaatcggacgaatatcaatgttcaagaactgacagtagaagccgctttaacactagataaatcaaaaatttatcaagcagcgtatttagatccacatctatcatctgaattgtctttaacagatatcaaaaatttagtggatgatttaatcgaagcacatggggactatttacctgaatataattaaaaagaagctgaaagagtaaggaattttcaattccttactcttttcttagttaaatttagtaaaaatattgacaaaacacttagtaaacagttacattagtgttaacaaaaaagaaaacgcattcaaattgtataaggaggagcataaaatgaagtggtctaaaaaaatcattttagcttgtatagcactaggagcaacgatctctttgactgcttgtggaaaaaatcaggaagatgcaagcggtaaggtagaaatagagttttttaatcaaaaaaaagaaatgactcaaacgattcaggagattgctaaagattttgaagcaaaaaaccctgatattcatgtaaaagttgtggatgtaccgaatgctggtgaagtaattaaaacacgtatgcttgcaggcgatgtaccagatgtcattaatctttatcctcaaagtatagaattgaaagaatgggcgaaagctggttatttagaggacttaaccgaagaaccgtatttagagaatatcaaaaatggatatgcacaacgttttgctattgaggatcgtgtatatagcataccattaaccgctaatgtctatggtttttactataacaaaactgcttttgaggaaatggggattcaagcaccagaaacttgggcagaatttgaaaaaatagtagctgagattaaagatcaaaacaaagtaccgtttgcgattgcaggagcagaaggctggactttaaatggttatcaccaactagctatagcgactgctgctggtggtgaagaggaagcgaacaatgtttggcgtttctcagaagttaatggaattaatgctgaaagcaaagaaatgcaaaaagattttaatcgattagatttgttaagagaaccaaaagctttgcaaaacaactggcaaggtgccggttataacgatacagtagttacttttacaaaaggtgatgcgttgattatgccgaatggttcatgggcaatgccgatgattcattcacaaaatccagattttgaagtaggaacttttccttttccagcagatgaagcaggtcaaagtctaacgattggcgcaggagacctagccttatcagtttctgcaacttctcaacataaagaagaagccaaacgttttgtagaatatatgacaacacctgaagcgatgcagaaatattatgatgtagatggtgcaccgtgtgctgttgagggcgttatcgagaatactcaggattcaccattaagtggtttaactgaacttgcttttactgatcgtcatttagtttggttagccaaagattggaatagtgaaaatgatttttataccttaacaacaaattatttacacaatggcaatcaaaaagccatgattaacgcattaaatgctttctttaatccaatgaaagctgacggaaggtaggaaaataaaatgaaaataaaagaaattttaaatcgttactgggcaatcatttttgtagcaattccaattattttgcagatgatttttttctactttccaatggttcaaggtgctttttacagtttaactaattggactggtctgacttataattttgattttgtgggtttgaacaattataagattcttttttctgatccgaagtttatcaaatcgattggcttcactttaattgtgacgctttgcatgattgctggacaaattggttttggtattttgattgcgcgggcgttgaacgcaaatattaaagggaaaacattctttagagcatggttcttttttccagcggtcttatcgggcgtggttgtttctttagtatttaaacaaatttttaactatggtttaccaaaaattggtagtatgttaggcattgaatttttacaaaccagtcttttaggaacaacatggggagcgatttttgcagtaatttttgttttactttggcaaggaattgccatgccagtcatcattttcttagcgggttttcaaagtattccacaagaaattattgaagctgctagaatggatggggcgaatgataagcaaattttttggaatattgaaatcacctacttattaccaagtatttcaatggtatttattatggcattaaaaggtggcttaacagcatttgatcaaatttttgctttaactggtggtggaccaagcgatgccacaacatctttggggttacttgtttataattatgcttttaaaaacaatcagtttggttatgcgaatgctattgctttagtcttatttatcttaattgggattgtttcactggcacaattaaaattatcgaaaaaatttgaaatctaggaggtttcccaatgaaaacatcaaaagaaaaaaatatttctaaatacttgcttttattattagggggcttcatgattttagttcccttagtttcaacgctattcggttcatttaaaacaacacccgatattatgaataatttctttcgttttcctaatccagcgactttggaaaatttccgaagattgttagcggatggaattggtcattacttttggaattcggcaatcatcacaatcattgcagtagttgctgtgacagcaattattcctatggctgcttattcactagcaagaaaaatgactcgtgggaaagcatacggattgatgtatttatttttaattttaggaatttttgttcctttccaagtaattatgattccgattaccgttatgatgagtaaaattggtttagcaaatatgtggggattaatcttactctatctcacttatgccgtaccacagacactatttttatatgttggttttattaaactaaatgtgcctatcagtctggatgaggctgctgaaattgatggggctagtcactttacaacttatttcaaaattgttttcccaatgttaaaaccaatgcatgcgacgactattattcttaatgctctatggttttggaatgatttcatgctaccattattaattttaaatcgtgattctaatatgtggacactaccattgtttcaatataattatacgggacaatattttaacgactatggtccaagttttgcttcctatacagtaggaattgtcacgattacactagtttatcttgctttccaaagaagtattatagctggaatgagcaatggagcagtgaaataaccaataaattattctcattataaaggagttcataaacttatgattatatttgacaatcacacacaaacatttcatttacaaaataaaaaaattagctatctattaggaatcgaagaaaataattatttaacgcatctttattttggaaaaaagattacgcactattctggtgggtatcgctacccccgaacagatcgttccttctcacccaacaatgcaaatgcgcaagatcgtttattatctttagatacattaccattagaatttccaggatatggacatggtgattttagagaaccggcgcataatattaaattaggaaacggtagtcgtgtaaatgattttcgttatgatagctacgaaattcaaaaaggaaagcccagcttagcgggattgccagccttatatacggaagatgatgatgaagctgaaacgctgattattcaattgaaagacgcgattagtggattgactttacagttgttctacacaatttatcaaaatcacagtgtaattattcgttctacgcaattagtaaataatagtgatgaaacagtggagattaaccgcttagctagtcaatcaattgattttccaaatcgtccactcgagttaattcatttaaatggtacctgggcaagagaacgtcaaatgactagagaaaaaattcatacagggataaaagtattagatagtaaacgcggatcaagcagccatcaacaaaatccgtttgttgctttagtagatgccaaaacagatgaatttcaaggagaggcatatggatttaatttagtttatagcggtaatcacgaaacggtgattcaaaaagatccatttgaccaaacacgggtcattatgggaattaattcatttaattttggttggcaactaaaaactggcgactcatttcaaacgccagaagtcgtgatggtttatagtaatgaaggtctgaatacgttatcacagacgtatcatgaattgtataatcaccgtttaattcgtggaaactatcgtttacaagaacgtcccacgttaatcaacaactgggaagcaacgtattttgattttaacgaagaaaaaatcatgaatattgtcgatgatgcgaagaacttgggcattgaaatgtttgttttagatgatggttggtttggcggtcgtgaaaatgacttcacttcattaggtgattgggttgaaacagaaggcaaacttgcttgtggtttggaaaatttagccaagcaagtgcatgataacgggatgaaatttgggatttggtttgaaccggaaatgatttctgaagatagtgaactatttcgagcacatccagattgggcattgggtattccaggtcgtgaccgctcaattagtcgaaatcaatatgttcttgatttttcaagacaagatgttcgtgataatatctatcaacaaatgacggcgatttttgatcgtgtaccgattgattatgtgaagtgggatatgaatcgaaatatgacagaagtctattctgtcttgttggactcaacgatgcaaggtgaagtggctcatcgttatatgttagggttatatgaatttttagaaaagttaacaacgaattatccaactattttatttgaaagttgttcgggtggaggcggtcgttttgatgcaggtttcttgtattacatgccacaaacttggacgagcgacaataccgatgccgtggctcgtctgaaaattcaatatggaaccagcttagtgtatccaatttcaagtatgggtgcgcatgtttcagcagtcccaaatcatcaaacaggaagagaaacgagtttaactattcgtggcaatgctgcgatggctggtgtttttggttatgagctagatctaacgcaattaacttctgaagaaaaagcagaaattaaagaacaagttgccttttataaaaagcatcgccaacttttgcaatatggaactttttatcgcttggaaagtccgtttgaaggcaatgatactgcatggatgtttgtctcaaaagaccaaacagaagccatggtcttttatttccgagtattagcagaagctgcgcatccattagtcacattgaaattagcaggattagcagaagaagcaacttatcaaatggaagatgtaacatttgctggcgatgaattgatgaatctcggtttttatattgactcagaactacatggtgattatgcgacacaacgcttttatttgaaacagatatagtagcttgaatttacaatataagtgcaacaccaaaagagactcattccaaacgaagaaaatatgttttatttacacgcatttactaaaaagcagcctgacttgaattgggaaaatgaagaagtacgtgaagaaatctatgcaatgattaactattggttagataaaggactaggcggatttagaatcgatgcgatattaaacatcaaaaaaaaactagagtatggcatctttgaatctgatggagaagatgggttagccttcattgggccctggattcttaatcagtcgggcattgaagtgtggttaaaagaaatgagagagcggacatttaaaccacataatagtatgacggtagcagaagccgatgttcctaatgaacgtttagatgaatatattggtgaagatggctattattcgatggtttttgattttagttatacggatattgatgtacctgaaactggtgaatggtttaaagatagccaatggacatggacggatatgcgtaccaatatttttacgaatcaattagttacgcaagataaaggttggggcgccttatatttagaaaaccacgatcaaccacgttcaattaataaatatattccagaagaatggatcaatgattatagtaaaaaaatgttggcgacgctttttatgttactaagaggtaccccttttatttatcaaggacaaaaactaggaatgaccaacatagaaatggcatcattagaagattttgatgatgtagctacgcattctcagtataaacgggcattagaatatggattggcaccagagcaagcattgaaagctgtcaataaacgaagtcgggataattctcgcacacctatgcaatggaatacgcaaaaaaatgccagattctcaacttctgataatgtatggttaaaagtaaatcctaattatccagaactcaatgcagaagctcagttaaccaatcaacagtcggtattcaattattatcatcaattaattaaattaagaaaaaatagtgtatacaaagacgtgctaatctacggacaatttctaccagtgaaagataaaaatgaacatattttgctttttgaacgccaattagaagataaaatcgtattagttatcttaaacgttacagcaacagaacaagaatattatgtagatgaacagtaccaacaagtattaatcaataattatgaagatgttttattagatcaaagtcgaaaattgcgtttacgaccgtttgaaagtattgtattagctaattatggaggacaattatgaaaattaaaaacgaagcaatgctcatcacctatgcagatagtttaggaaaaaacatgggcgaattaaaacaagtcttagacaaacatttacaaggtgttattggtggtgtacatctgttgcctttttttccatcgacaggtgatcgaggctttgcgccgagtgattatacgacagttgatccagctcttggaacatgggaagatgtggaagcattaggtgaagattattatttgatgtttgattttatgattaatcacatttctcgtgaatcaaaatttttccaagatttcaaaaaaaaccatgagcagtcaccatacaaagaaatgtttatccgtattcatgaatttttcccagaaaatcgaccaacacaagaagatattgatttaatctacaagcgtaaagacaaagcgccgtttcaaacggtagaatttgcggatggtacgacagaagaggtttggaatacctttggggaagaacaaattgatttagatgtgaccaaagaagttgtgaaagaatttattcgagaaaccatcaaagatatggcgaaccatggctgttctttaattcgattagatgcgtttgcttatgcgattaaaaaattagataccaatgatttcttcgtggaaccagatatttgggaacttttagacgaagtgcgtcaagaagcagcgaaatatgacgtcgaattattaccagaaatccatgagcattattccattcaaatgaaaattgccaatcatgattattatatctatgacttcgccttgccaatggtcactctgtattcactttatagtggaaaatcagaacgtttagccaattggttgaaaatgagtccgatgaagcagtttacaacattggatacgcatgatggaattggtgttgtggacgctcgtgatttattaacagatgaagaattggattacacctctgaggaattgtataaagtcggggcgaatgtgaagaaggtctattcaagtgccaattacaataatttagatatttatcaaattaacagcacctattatagtgcattaggcgataatgaccgtagctatctgttagcacgtgcgattcaagtatttgcgccagggattccacaaatttattacgttgggttattagcaggaaaaaatgatattgaactgttggaagcaacgaaagaagggcgtaatattaatcgtcattactatgatttagccgaaattgaagaagaagtgcaacggccagtgattcaacaattatttgcacttttaaaatttagaaatgaatctgcggcgtttgatttggatggaacgattgaagtagcaacgccatcagaatcagaaatagtgattacacgtaaaaataaaaacggtagtgatagtgcaacattaacggctaacttggatacgaaagaatttatcattgagtctaaagatataaaaattttcactagtgttgcattaaaattttaacctattccatagaacaaaaaatcctttatactagcacttggatgacttatccaagaccaataaaaaggactcatacatggataagtataaaacaaatacagcatttaataaatggttttctgccataaaattaggaaaactttctgtcaactcccaaaaatgtatttttgattacaattcgtatcgtaaaaaactgtcttttgaagctgtgctcaagctctttctctacgcagttaatgaagaaaaagaaagtttgcgtgatttgagtacagctcttatcgaccgatcgctccaactagaaaccgatgtgtcatcgattagtcatacccaattgtctcgagcatttaatgcacttgaacctaaagtgttagaagaaatttttcaacaactgttagaaaaagttcaacatcaaatcaaaccaaccaagcgaaatcatctgtatctgattgattccagtacgttttcgcttagtttaaaacgtcataagtgggcgactttccgtcaaacaaaatcaggtgtcaagttacacttaaactattgttatatggacgatactacgatgtatccaactgattttaccttaacaaatgcccatgaacatgatctcaatcaactaccagtattggtgaatcaaccagaggcaacttacgtgtttgatcgtgggtattaggactttgaaaagatggatcagatgcattgggatggctatttcttcgtcactcggattaaaaaaaacaccaaagttcacgtgatagatactctggaaacatcgccagaaacagaaattctacgagacgagctggttcgtttaggatctaaaacctatctaaccgccaatttccgactagtcactgttcaagataagaacggacgtgtgtttcaatttatcaccaatcgaatggacgtctcttcaaaagaaatctctgatatgtatcacgctcgttggcaaatcgaattgtttttcaagcacatcaaacaacacatgaccattaaaaccttcttttctcaaagtgaaaaaggcgtgcagaatcaattgattttaacgatgatttccgctctcctcacgtttctcatcaaattggagacgaaaacggaaaaatcagtgttccaaatcaaacgattctttcgttatttactgtttcagccctttgaatgttgtctagaaaaattaattcccacatgagaaaaaagaaatttggctcgttacttttggttttcagttgaataacagataaaaaattttctggaaaaagtcatcctctgcgtcagcacagttttttttgacttattttcagaggaaatagttttcagaatattctaaaatgttttatgcaacactagtgatattttttagaattagatttctaatgtgcattttttgagtattaaggagcaagtatacaaagatttataaagctgattaaatttgaataaaaatatgcaggaacgctactatttttagtagtgttcttttttatatttgaataaaaaatgtggtggttaaatggtggttataacaaaaaatgaattaatgaaattaggttatgggaagtatcagtctgagagaatcatacgacaggcaaaagcaattatggtttcaaaaagctatacctattacggaaatagaagattaggactagtacctgttgaatctgtagaagaagttttaggtatgaagatagaggtagaggaggattttcagaatcatggttaattttaaaaaagataaaaatgggaaatatcattttactgctagtttgggattcgacaaacgaacagggaaaagagtacaaaaaaacgtagaggggttaaaacagttaaagaagaaaaaaagcgtataccgaacttgtttctaattatggaaaagaagcagaaacttctcaaagtactatgttgtttgaggagtttttttataaattattcctaccttattatcaagggaaagtagaagaaagaacatataaaaatcggttatctacaatcaaaaaaacttttcttatttctttaaaatggagttaagagaaatacgtccaattgacattcaaaagtggcaaaataatttattgagcaaatataaaaattcttatgtaagaaacatgtatgggatttttcagatgtcattagatcgagcagttgttttgggactacttgaaaaaaatcctgcaaaagttattggaaatgtgaagaaaaggaaaactacagttgatttttggacaaaagaagaatttacaaaagttatttcaactttttatattgatgatttgtaccaacattttggttttatttgtatgtggttactttttatgaccgttatgcgtttgggagaagccactgcattaacttggaaagatattgattttgaaaataaaaacttgcgtgtgaataaaacactctattataagagagccaaaacctatgagtttgtagaacccgaaacggcttctagtattcgtacaatcgaactagacgacaatacaattacctttttaaaagcttggaaggagcgtcaagtttcaataggaggcatgtcgtttgtactttcttataatggaacacctactcagaaatatacaatccgtcatattatgagaagacatgcaacgatcgttggtgttcatataatccgcatacacggattaaggcatagtcatgcttctttgcttatatcacaataaaaagatgcacttcgaattaaagaaaggttaaaacatgctgatgtacaaacgactttaggaacttatggtcatttgtatctaaattcattgagagagataacaaatgatcccacagattatatccaaactaatttttctaaaatcaaaccgacacctatttacgataataaaaaataaatgataaacaaaagtaggatcacaccaaaagaaacacactagaaaaactataatacaggcttttctagcgtgttgtttcttatttccgcctatttatacattatactcataaagcatttaatgcatcgatcgtagccgcattgtctatatgggtatataaagttgttgtattggtacttgaatgtcccaattgttgggcagttaataccaatgaatttgtctgttggtagagtctagtagctaatgtatgacgcagtttgtgagggctgacttgaattctaaagccttttgaatattttgctaccatccgttcgattgcaataccggatatacgcttggcttctccttggtaaattgctagaaataaagctttttcgttttctgttactttatatcgttctttccgaatagctagataattagctaaatattccattgcgaatgctgctatattgacagcatctcttttatttccttttctagttactaccacattattcttatctaaagataggtcatctaaattaatatttataacctcggagagtctcaatccagatcctaaaatcagtgcattgatcgccaggtctctttctacatctcgttgataatagatcaaagctcgtttactcaaagtatttttatattcattggcaatataatctagataattttgtgtatccttatctagaaataattttttctcaatggcattggcacgtgcagctaacgtagttttatctgtgatggttgctacttgatccataggattattgtctaagtatggttttcctagaggattattggaacttttcgaaagatatttaaatagaacctttaatgccgtgatatttctattgatagtagaagtagatagacctaagttattattatctttgagcttagtttttgttgtctctttttttacattttcttttgtgcgacgtttcaaatgagatttgtacaagtttaggtcataggcagttaactgtcttatcgaggtgatagaagtatcaggaacgatagactcactcagaagccattcataaaagagcttataattttttagatattctaaagtggttcgaggtgattgatctttatcctcacgatcttgaacaaaatcttttatataatcgggcatatgaagtatgattgtatctattttttgatatatttctgtatttttcatgtcattcatcctttcaataagtaggggagaagagtatctctataattggactataccaattatagaatgttttgtcaattggtatgctctaaaatttattaatttgttccaaaaaaagcatataaacaggtatacgtttaataatttaaaataaatggtatacataaatagggaaggaaatagaagggagcaatctaaattttttgaattttcttaattaattatatagaaagaacaatctttctatagagttagacatgagagggactatgcttgatttaaaatcaacaagcgtatatactgtatatacaaagaaaaaggagggagaagactatggcaattaaagaaagaaaatttagggaagtggggaactcagtagtattaactatttcaaaggagtttcttaaagaaaatgggttaaatcccggagatacggtttttttagatgaagaaaaacttcgagcggcaattacaaaaaaacaagccttatctgatgaaattgatttagcaatatctcaagcattaactgaatatgatactacttttagagagcttgtcgataaatgagtattcattacctagaagccaaagatattataaaaatgaatgtaatccaaataaaaaaatactctcctaatgaaccccttggtgtaaaggatgcgaatgctttagaaatgtgtgtagggcaacttcgagcctcagcttttggtgaagaggtttatccttcgatttatgaaaaagcagctatcctacttatacaattgataaagaaacatccttttcacaatgcaaataaacgtactgctttcttagctacttttgtctttttgaaaatcaatggacagcttttagctattgatcaaaaagatgctgtaaatttagcggtatatattgctacgtatgataaggatttcgatcaactaaaatatgaagtgatcaacactataaagacacatacgcagcccatttaaggagttactgtatgtgtctttatagtgttattagctgctatagcgaaataattgaagtaaattacaaatagctataattcaaatccaactatatagaaaacgtaaattttctatatacttggatatgctggaatgtttaagagaataattacatttctagaaaatacaataaaaattacaggataattagccatatactacctcctctagcagttgctcaaaagttagcactaagtaacttcttttttgttgctggtaacaatttatcaatactaaaatagcttttaagtatctaataaatattaattttaaagctcttaattattatgaaacacgatataacaatattgctatatcgtgctattgtaatattatacatttgaagacagcgtattcttgttctaatatcaggaattttttataaatatcagtcatattaagactcaaaatttattggtatgttcctctgtatagagtttgaccgtctaccattatatagcaattattatcattgttgtcttgcaccaatataccgttaagggtagcactaggagtagtaacaatcactggaaactcgtgagaaagctcggtcatttttcctgttctgctagaatcgtgttctattgtcaagccatttactataaacgtgaatactttacttcctattgttatagtagctttttgagaaacagtttctgtagctggagctgtgcttctttccgaatttgttagggtttcactggattcattgctataaacaattgtagaggattctacggcttcttgagtgtccacgttggtgctgctagcttcatctagcttccttttgtattgttcgttactgattgctaagctttcccgttggtcatcaagcttattcatttctgtaatggtataaaataatcctcctgctagtgctatattaacaactaaactaaccgcaaataataccttttttattcttccttctcttccttctcttctttctctttttgtaattccttacttttggctcaaaaagtcacttattaagtttataccaaccgaagctaaatatttgtatataactatacatgttatatactttagctcatattgctggataatgttcattctagtcgactccacttattatcctggtaaaattcaatgtgccgtatttcgtcgtagtgaattttgtcttttccaacgtagattcccagctcatcactacctaagatctttccaacaatatcgtatggatagtatccttcagcgtttcgttcttctttttggatacatactgatctattttttatgactgcagcgttcaatactttcacaatatcttcagtcgtcatttgttcttttgccaaattatgattggtacgttgctcattgtccgcatcgatctcttcagtatgatcagataaataaaaccctgcccactttaaacgaccacgatcattgtaatcaatcatttttaattcccccatttccgcccgcatgaccaccaacaagtgtgcttctagtaatgcttctagcgccttctaacattgaagaagcatgtacaatcgacgtaaaaccatatttttgccgaatcttgtcaataattttatctaaattttcttcgtcaatttgcttttgtggatcactaaataaatccagctgaagcgaatcagtataaaatagcttgctgtaagtgattccgacgtggcggacttcttgtccttcataatacttatcaaacaagaaaagacaataattctgcaattcctttgtattgtctgtgatagggattttcatctggtgtgagaaccctggtctcgtttctaagatcgatgtaccaatgtttaaatggacacatcctgttttacaattatgctgtctgatacgaatggctacttgttccgccatttcttttacaaccagctcgatttcatttcttctagtataatcacgtggcaacacttgtgaattaccataggacttttcttttgtcggttctggtgggattgctatatctgttcgatcgatcccattagcatggaagtacagctgtaagccaatcacacctagtctattcttaatcgtataaggattccagttagcaagatctctaatgctcataatccccatctgattgagtcttttcttcattcgagagccaataccccaaaaatccgtcatttcaggaatattccatactttttcaggaacgttttcgtacgtccattccgcaacaaatccttcattatgctttgcttcattgtctaaggctagtttagccaaaaggggattatcgccgacgcctaccgtagcaatcaatcctagctcttctttaatattctcctggatcatttgagccagcttctttctccgttgacttcgtgttccttcagtcgtaaaaaggttcagtgatctggtcacttttaagatcgattcatcgatcgaatagatcaataaatcttcgtctgctacatattttctaaatatattgtttacctgcatgtttcgcttaatatagagattcatgcgtggtgagacgacatgtaacgttttaggaaatggctgaggtagatctcttggcctactgacattagagatcccatattttttctttgtagctggtgaagaagctaaaatcaaccctgatcctgtattatccgctcgactcatgacgactaattcagtcgttaatggatctaaattcctttctatacattcgacacttgcgtaaaagcttttcatatcgatcaaaaagtaatcatttactggctcttttgaataatccatcataaataacactccattcgttacaattatacaaacatatgttctcgtttgtaaagaaggaatgtttaaatgaacaaaaaaagattcaaattgttattacaagcagtttaaacggataactaaccacttatcagattttaaatgcgttagagtcttcatatatcaataaatacagaccaaagctacttgattcactataaaaaaacccgaacttcctttttaaaagttgttcgggttttataactttcatgacgaactactaacaagtagactttttaatttttgccagtcttcaggatacaatccatgcatttcatacttattcgccaattccgttatttctgcagaagacctcgtataaagcttttttagtcctcgatattcataatatttttcttttggatagaaggcttgaaatgtgccatcaaaacaatagtcctgatccttaaattctatccaagcatgaaaaaattcacttttttgaaattggccaatgcaataaatagcttctttgacatctcgtgcaaattttatactttctacgaagcatttatttggttgtagtcttttttttattttgtcctgataacctacaggaacggcaatctcgatttttttcaaccgaattttctcttgcttcaatgcctggtaccttgtggaatatggtagttttaaaacgtctttttctttctgttcgtacgctactttattcataatattcacctgtcaaaattaatatccatactctactgtgttgattttccaaattgaatcttctttatttaaagttacaaccaaagcaggttttccactcatattagataactgtaacgaattaattgcaggattgctgaaaatgacagacatattttggtacttgtgatcatttaattgtaatgattcagctattggatcactttctttgttttttatttgactctctaagatagaagagtcaaatgtatacgaattgtttgttggacgaatattatcgtttgtaacttctattttagcaacgttctctccttcagaatctatgcgatttatcttccaactttgaccatcaaaaactatagtatttctatcaatataagcattcacgtaaccattgtcttcagtctttacttctccccaataatgtccagtgtattgagctaagaaaaagaagtctatcggatattgaaaaggtgtgtgttgattcattctttcaaattcttccttgatatgtttcaatgctgtttttgtataataattttccaaccctatttctttatctaagtttttgaaaataagttctttattcttattaatttgatcacttagtttataaggttcattcaaattctcttcaatagcaaattgatagccaaatttttccgaagtatttgctattatcgtgtctttattaactgcattaaatagttcattcatcctctcagtaacattcatttctttttcttgttcagttatttctatattttttgatacaacaaattttccttctgcagcactcttggtgttttcacttttgccgcttgttgaatttgcacaggcccccaacattaaaatcaccgatactccaaacaacccacttaacaatttcttcatctattcttctcctttttgtctatgtatatatattatttaatccaagaacgattataacacatgggatgctgacattttcctacatttcataaggagtgatcgttacatactcttacacactatatattgtattttaatagcaaagggtcatcttggtaaggtttcatttgtggtataatagagataggttagatatacgtcaagcttctttgaattgcattacagaagaaataaaaataccgtgcatttatgtacggaataaatgcagaaggagctggtacttatgaaaattgcatatgtatttttcaaaatatattctccttctaatccaataggagaaatatcgtgaacagcaatttttggccgttaatgcttaagattcttcccttaatcgcgcctgcattaagagattttcttgcattgcctgtgcttaacatgttggtcgcaacattatgcctcgtggttataatagttataatcatgatttgtgcaatttgttggaaattgatcaacagaaaaaacccattctcttaagagaatgagtttttcatcgtaaccgacagttaaacgggggggcgcaaaaccaattttctttgttatcatgccattttttatgactaggtagccagtattttagtaaatatttttagaatatttttctatttaaacttttcaaaaatattatcttgattttctttatcctcagcgtttagatagccgtactcctaatctttttcttcattcaaattccttatacaaatgaattcccttaaatctggtgctgctcgtaattttttatttttattttatgaaccatagcttttaaatttgttaagtctttatccgttttgtaatttaatatccatctagtattactgctaaatgcattatttaaaagattaaagtatggccaatcataatgattgtaactgtgtccaatcacttttacttcgcaaacatctgcaagtttttcaaaaaatacagtgctctcaaaattttttatttgcaatggaacatttttgtttaatgaatgatgaagattaccaacaattcttgcagcttctgattctctgacatcggcgtcctcatcatatggatctcctataaagttgtcaaaattctcggagtggccgattattatatcgtcataactgccatgaatatgatatatgttttctttcggttgcttgtatagaatttccaaaacatctgtataattgaatgtaaagaatagtacatcggacgaaaattggtattttggaattttatgttctattgtcggctgtatttctttgcgtatccattccttgaaaagttgttgtaattcttctagagaaacaacataatcataaaccatattttgaaaatcatgatgggcagaatctgacaatcttcatgtccataacctatgagataatccttagactcttctacataatcttcaaagactggactttgaattaactcatgcaaactactttcaaaattaaaccaacctatcttatcatcagctgtacttctcacctcattattttcatttatcattgtgactattttatcgaatatttcactatgacttttttcaacccattttgaaaaatcagtgtatctagtttttaaaccatgacttaaatcaaaaccgtttcctataatatataatgtactcattctttcctcccaacactcaatctactaatttaaaactatccatgtttaaacttaacttttatattataaatctaagctttttacagctgtatctttgtcttcttgtgtaataccaatataccgcaatgtttcgcgctgagaagaatggttcaacaaggactgaatgatttctgttttggtcccctgtttatagagaaagtaaccgaacgtttttcgcatggaatgtgggccaatgtctttcaatccgattgccgtgccagcatcatgaatgattcgccacagactttggcggttgagcggttcattcgtcccttttcgactagggaacaaataaccgtcaaaatcttgctgaaggagttgatcaggaaattcctgttgaacgtactccaaaatcgtttttcgcaatttgttggaaatatagaccgaattatgtttagctgttttttgttccttcatcgctaatcgatctttgaccaccacgcgaccgcgtgaaatttccagcacgtcggccagcttcaattgacgcaaatcagaaatgcgataggcggtgttgatcccaatcgaaaaaagaaccaaatttcgttggccatattttcccgaagccaagattgccttcatcgcatcgatcttttttttgtctcgaataggttctaccgtcttcattttcttcgccctctccaatgatacttaattgcattataacatataataagtctcattcaaaatcaatataaggaaaaagccccaagcaaaaattcaattctgcctagagccacgtgggattgagtgattccctcgaatgagacacaactaggttgtgtctcttttatattgtaagaaaagggggcgtgacataagttaactagttacgctctaaaaaaaatatggagcactcgaaaaatcacatgattttcgagtgctccttgtttttctattcatttttggtagatcaagtccctattttggtcaatttcatcatattgatcgccgtaatgagtaagcccgtctgttttctgactttctctaagcttcgaactgtgtatcgagtgaaacctaaacaagccttcagaaatccgaagactgttttcacgtcgatttttctccgcccatatattttttgaatttcaggcgttgataaacgttctttttgtttttctttatgatactcccaagacggatttacagtgatctttctgagattctcctttggggttaaggcttcagaaatgagcatttggttcgcatccattttttctacttggtattctttaaaatatcgaacaaagccatccgcatctgccaatatttttgtgccgtcgataaacaacgcatcatcaatcagattacgcgcacgcagatactctgtcagctgatctaagcctttattgatcaattcctgtacatcgttggatacagatacacaaaaacggacgatgactcgataggagaaaacctatccttgcatcaaccagcgagcatacaaattttcttcagctaagcgttcaatcttgcaacatgtaaaggtttctcgcgtatacgcaaaaagaaccaacttcatcatgacacctaaatcatattctcttggtcgactaaaaagatagacaaactatattaagtcaagcacactcctactcagataaaatttacgatgtgctccacttactctttgcctatgtaaccttgtgatcaatcaagcgtcacgaacaaatgtcatgcgctaacaaacttattaacaatttgacaaagagctgttgctagagcctatctttaatagtatcccaaaggagtctggtgagttcagtactagtccacaacgcctaactcaattatagataaaataacagctaaataaaacagaatagctgattaattgagtaatctaaatatacaagggttcattgatctgaagagcttcgaccagttcattgataaaaacgacgacatgattttcttttggagaaaatgaagtagatagatccaaagtgagttgattcatgttataattagtgtacatcttgtttagtcctttcaagattaaatggtggggcactggcggcaatcggtgctcctgttattttaaccaaaaaaccgaaagaaatgaacgttttctcgtcatttctttcggttttcttctatggacttatgttacagtcccgttctcggctaattcataaaattgtatctaattgttggatttcaaaaactttagccatataatcaccgtttaaaaaaggaaaaagataaaaaccacacctagctaattcatcccctccatatattaccttatcatcaattagatatttagcatttggatttaatcctgggattttaactacatctaatttaggagctgcttgagccattttttgaaaataaaataacaatgcctttcgttgatctcttgaaacaaataaccaaatcgtctcgttattttcaaacggactacgtaatcgataaaaaattccttcctgaattaattgttgatattttttataaaaagcaatttgtgttctaatctcttctttttcttcattagaaagctcagtagggttcaactcatatcccagcataccagaagatgcaactgctccacgtattgccagattagttatacgatgcgtttggtgatttggcacagctgaaacatgcgctcccattgtggaaattggatacacaagacttgttccatactgtattttcaatctagctatcgcatcagtattatcacttgtccaaatttgtggcatataacaaagaactcctaaatcaaagcgacccccaccacctgaacaaccttcaaataaaatttctggatatttttttgtgaaatattccattaactcatataaacctaatacatatcgatgataaacttctccttgtttataagtaggcagtaaatcagagtaaacttctgttaaatatcgattcatatcccattttatataatcaatcgagacattttccaaagtctggtccattatttgttttatatattctcttacatcttgacgactcaaatctaaaacccattgattacgactaaatgtttttccataaccaggtgctgatagtacccattcaggatggttacgatataaatcactgttttcagaaatcatttctggttcgaaccacaaaccaaacatcatatttttagacttagcatattgactgattccattcaaacccatttttaatttcttcttattttcaaaccaatcacctaaagcttgacgatcattggaacgttgtccaaaccaaccatcatctagaacaaataattctatacctaattcagcagatgaatcaatgatttccttgattttctcatcatcaaaatcaaaatacgtagcttcccaattattaatcaatattgggcgtaatttcgattgatactttcctctaacaatatgttgattaacaaaatcatgaaatgtatgactcatttcattcaaaccctttctggaataaaccatcactgattctggtgtttgaaaaacattatctggttccaatatccaagaaaaaccataactagcaatcccacatcctaaacgaagttgtccatattgatcttgttcaataaattcttcgtgatttccactataaactagagccattccgtagacttgtccttgattttccgtagtcgacttttctactaaagcaataaaagggttttgttgatgactacttgttcctcgtgtactgctgaaaattttaatccctggtgaaatagaatgtctactaatttgtcgctccgccccccacgaaccatttaaatcaacaacttcaaattcagtatgaggcatatctaaacaggcactcattgctcgatttaaacgaatattactttgaccataattcttaacaatgacagatcgacagataacagctaaatctctaaaaatagtatagtttaggcctacttccacttttgcacaatcgtcttttagataaataaccaaagtcttcgcttgatcatcatttgtcaaatatgaagagggtaatccatttagagcaggttttccatctaaaatttcataacgttcataacgcaaatctaatagcgctacaccattttcttgttcaacttcaattgcagggatacgaaaatctccattcccaattgttggatattcatgtaaaagagtatctcttgaataattccgatgtgaaatttcagaaaaattagtagaaaaagaacgttcaaatcggggatacttgagtccacctgaataatttgaaattctctccccaaaataaacatgcgctaagatatttaactcttctacacataaaatataactaatttcattattccttaaatgaaaaactttacttttttcatcaaaaataatctcactcatgatttctattctcctcgcatgctccatatttttccagatagtttctggagttgactatcaaactggataaatctttgcttactatcagtaaagaatcgagctgatgcactgctcactccttgatttataaatatttcaattgaactggtatctagtaaaattctaagagaaactatctcgtcaagattttcataaatacaacgttgcgtgccatattctggagcaatggactgtttcaacatacttcgatctaaatataattgattctttaattggtcaaatcttatgataaggttttctttaaaatgtgtatcgaatccaatcattaatttccaattagaaatattggctttttctatcagtaactccatatcactttgcatagaaattgagcaaatattattattatcaacaaccattaattcatcacgcaacgctgttaactcatctactggatattgacaaatccgatcattacgataagttatttctctaggaacacttaaacaaccacaatatccatatttttcagttggataattaatttctggtagtcccatccatccaaataaaacccgacgtccatctggtaactgactagattgtggagcataaaaatcaaatcctcgatccaattcaacaaactgagctgtttcattaaaatttaacttttcttgagaaattggccgccctacaatataaccagtttgataaatgttttgatatttttcaccctcatgagctattccttgaggcgaaaacactaaaatagctacatcttctatttcaaaataatctggacactcccacatatatccaaaagaatctaagccggtttctatctcccccacaatttgccaatcactcacattatcacttactaaaacaagcgcagcacctgttttattctcacgctgaacacctactatcgcgtaaaacttcccatcttttatccacaatttaggatcacgaaaatgatcagtatagcctttgggctggccttgaatcgctggaggtaattctttttttatttgattatttttatccatttttgcgatgatttgatatggttttctctgccaattttcatctcgtgtattccctgtataaaaaactaacaattcctctcctaaatctaatgaactacccgaatagactccatgactttcataaatagaatctggctcaattcctggacctaaactctgccaatttactaaatcattggatattaaatgatgccaaccttgataccatatattttcttcagcatatttcaagggagaccattgataaaacaaatgatacttcccgttaaaatagctaaaaccattcggatcatttaaatatccaaactcggattcaatatgaaatttttgtctatacggactttgagcagatcgattcgacaaaagcttaattaaagattgagggacttcatgataatgaaaatattgataagtttctttattcatatttacctccttcataatcaaaaatctattttctcattcaaattaagcaacattcttaacttcaataattacttatccattacaatttttctttcgtatattttaccaataaagtaacttaaaacaattcctaaaacaaccgcaatcaaatgtgcaataacaaaatttaaatagccaccattagctggatcgacaatagtgaatccgggtaatccagtagttccgtaacctactgcagttaaccgacttaaataaacgtaagcaccagctacagcccctgcaagacaaccagcaatcaatgggaatttatattttaatgttactccaaatagagctggttcggaaattccaaacaagacagatataaatgctgaaattgaaatttcacgaatttttctatttttccaatgtaataacatataccctaaaacagccccaccttgaccgagaagagctacagacattaaggggtttaagaaatcacgccctgtattagcaagtagttgtgcttctattgccccaaaagtatgatgcaatcctgtaataactataatttgttgaacacctgcgaaaatcatgaacccaaatatccctaaatgttcagtcatccagagcaaactattcgttaacccatttcccaactctcgaccaaacggtccaataattgaaaatagtaaaaatgacgaaatcaaaatagtcaacattggtgaaaggacaaatttaataatatctggcagcactttattaaaaatttgatctagccaagcaacaacaaagccaatgattaaagcaacaataattccgccttgaaaaccaactaacccaatattaaagcccaaaacatctaccatttcagctttagcgctaccacttgcaactgcgaatgcatccgataaatttggatgaatcataactgcgccaattgctaaaccaagtactgggcgcccaccaaaccgtttagtcgatgaataagcaacaatcatcggtaacaaagaaaaaatacctgatgaagcaatcgaaataattcgattaattccataaatcgcaggaaacatctcaacaactgatttctcactaaacaaccccttagtagaaagcaaagaagttaaacccatcaataaagctgcagctaagatacaaggcataatttcaataaatacatctgaaatggatttaataaatctttggaatgggttttgtttttttgtagattctaaattcaaggatcctgtcttattttgagattgatcaagatccatttcttctataagctctttataaatttcattaactaatcccgcaccaaaaattatttgtaattgatccccaactacaaatgctcctttagcaagtcttaaattttctactttatccatatctaccttttcgtcatctacaagcaccaaacgcaaacgagtggcacagtgagttacatgttgaatattttcttttccacctacagcaaccaataaatcttttaaaatatccgtatactttttaaccatttatttccctcctcactatcaatatagtcatcttaaagtttattatccttaaaaaaaatggtaaaatgtagacaaattttgtatatatgtttggagattttattatgcgatatttttttaacaaccataaagaatgtaaagaaatatttttatatactgttggttacgagaaaactcaagttagtcatcaatacggtccaacaattcgaagtggctatatgctacattacgtccattctggtaaaggaatattttgctgtcagggacaaacttaccaattaaaagctggtgatttctttttcattgaaccaaattcactcattaaatatcaagcggataaacaacacccatggatttattattggattgggtttcgcggagtattagttgaagaatatttaaaacgtacgactattaacaaatataatcccatcttctcgattgataatggtggaagaatcattaaagataaaatgagcgaaatattagaaatctcatttatagaagaagataatgatttattattaaatgcacgcttatttgaaattttatattatctcagtttaaattatcctcttgaaaaaattcaccaagataaaaataaacaaaatacattattaacaaaagcaatccaactaatgcgcaacaacattgatttgaatttacaaattcaagaaattgcccaaatattatcaattgatcgcacttatttgcatcgaatctttaaagaaaatattggaacatctcccaaacaatatctcatcaatttaaaaatgactcgtgcaaaagaactgcttattaataccgattctcctttaaatgttatttctttatctgttggaatagatgatgtcgctaatttttccaaacttttcaaaaaaaatgaaaatatgtcaccaaaacaatatcgtcaaaaatatcaacttcaaaaaaaacacaagtaatcttttaggaaatactattaaattacttattttttctatttcattcaaagtattgaacctctaataactaaagtcttaggtgttctcatctaattcataagaataggtactgtttgttaatgaagttacagacagtacctaaacatctactgggaagacgttaaaaatatcaaaggcgaccattttcgtaacattcttctgaataaacatgtcgcactattttccccctctcgatcgatatctgttgcaattatgatcgtatcggctttctttaacagtccggaaacgatcttaaattgttttttcttatcagctacgacctaaaaatcgtattgttgcggaaagataggcaatgcatccaatgcccaattcttccatttgtcatcataatatcctggttctactaattcgaccaaatgaccgaagccaaaggtgataaaggtctcatctcaaaaaattggatcttggatctcaaaaaagccatcctttttcacgctatgctttaacgcaccagcataggaagctgcttgacttggtttttctgctaatatcacggtagtcattaattccaccccattcattatttttcatctcaaatagaaataggatagatatcaatccatctatcctatcaacacttctatttcataataagtggctaaatcgtaaaggtttcattgtcgattattttttgttgattacttgctaatctatgagtatatagattcttgtagaaacgatttcgttttttgaaatctttcagcaactcatttatcataactcatcgtttgttatttgtcaacaacttttttgaagtttttttcgatagaatcaagcttcgcaagctgttttttttaacgactcagttatcttatcatgccgttagcaacatgtcaacaacttttttgttatgtttttgaagaaatatttccttctgtcttttggacaagtaataatataccaactaaatttatcttggtcaacgaattttttgtattttttcaagtttttttcaataagcgattattcattacttttctttctttatcgttcgctttcggctccattaatgtctgcaatatttgataacagcttttgaacattcgttattgtttgttgctttctacatagcaaaagctgcctaaggagtcccctagacagcttttatttgattatctcattgttgggaatagtagaacgtcccgaatggattgagcgtcagttagcagcatcactaatctgtcaatcccgatacctagaccacctgttggcggcataccgtattctaatgcttccaagaagtcttcgtctacaccgtgagcttcatcgttccctagttcacgttctttttcttgtgcttcaaatcgttctctttgatcaattggatcgtttagttctgtaaaggcattagcaaattcgcgtcctacgataaacagttcgaatcggtctgtgaatcgaggatcttctggatttttcttcgctaaaggcgaaacttcgactggatgtccgtaaacaaatgtcggttgtgtcaacgtttcttcaacaaacgtttcaaagaattcattgataacatgtccgactcccatcgcttctgttacttctacgttatgcttttcagctaaggctaatgcttcttccaatgtcatttctttccagaaatctacaccagtttgttctttgatcgcatctaccatatggatacgtttaaagtcgctttctaagtcaacagcttgtccatcatatgtgattttcgctgtccctagtactttttcagctgcgttacggataataccttctgtcagattcattacatcattgaaatcagtatatgctgtgtatgcttctaacatcgtaaattctggattatgcgtagtgtcaatcccttcattacggaaaacacgaccgatttcataaactttttccattccgccgacaattagtcgtttcaaatgaagttccaacgcaatacgcaaatataaatcaatatccagtgcattatggtgtgtgatgaatggacgagcagcggctccacctgcctcattatgcaatactggcgtttctacttcaatatagccattgccatctaaataacgacggatctcgctgataatttggcttcgtttcataaatcggtcaaagctttcgcgattactgatcaaatccaagtagcgttgtctgtagcgttgttcaatattcgtcaagccatggtatttatctggcagtggacgaagtgcttttgacaaaatcgtgatttctgaagctttgatagaaacttcgcctgtgtctgttttcatgatttgtccagttacaccaaagaaatctccaaggtctgcatgtttaaatacttcataggcttcatcacctacttggtcttttcttacataaatttgaatttggccttctcgatcttgtagatgcgcaaatccagcttttccttttcctcggcgagtcatcatacgaccagctacactagcggtcaatcccatctctgctagttcttcttttgttcttggatcaaatagttcatgcaattcttctgagttatgtgtgcgttcaaatctttttccaaatggatcgattccatcttcacgcaattgttccattttttgacgacgtacaagcatttgatcatttaaatcttctacttgatgttgttgttcctgtgtcacaaaagttcctccattctcatgttaatctctttcctataatgccaatgaaacacaaaaaaagcaagccgaacttggaatttcagcttgaaaattcacgaaaaacttagaaatcacaacgtttgtttcaatagtactttttctgctttttctacaaattgatccagcagaccattgatttcttgctgattttctgtctgattgattgctactttcacttttgctgctcgaggaatcccttttaaataataagccgcatgtgttctgaattctctacatgctactttttctcctttaagatctgctaagcgttgtaaatgaagtttagctgtagcaatcttttcggctggtgttggctcaggaatcagttctcctgtttctagataatgctgtgtacgatgaatcatccatgggtttcccaaagctgcccggccaatcatcacaccgtctgcaccaacataatcaagcatccgttttgcatcttcgggtgttttgacatccccgttccccataaatgggatggtgagatgtttttttacttcttttaatatttcccaatctgcttttccctcatacatctgaacccgtgtacgcccgtgcatagcgatggcacttgctccagctgattgtgctgctaatgcattttctacagcaaagacgtgttcttcatcccaaccgatacgcatcttgaccgttacagggatatccactgctgaagaaacagcttggaccatttcgtatactttctcaggatctaaaagccactttgcccctgcttctgctttgatcactttgtttactggacagcccatattgatgtctattatatctgcagctgtgttttcttcgacaaattgagcagcttcaactaggctgtctttgttcccgccaaatatctgtaaacttaatggatgttctgtttcttcaatgtggagcatctctaaagtttttttgtttctgaaatggataccttggtcactgatcatttcacatacgactaagcctgcaccaaattctttgacagtgactcgaaatgctgaatttgttattccagccatcggcgcaacaacgacgcgattagggatttcaacattgccgattttccatttgtgttccacttaaattcctcctaaggcttctttcttcaatccagctaattcttcttcactatacttgtatttattgttacagaaagagcataccgcttctgctccatgatcttcatctatcattgcttggatttcttctgcacctagcgcaataattgcttctgcaaatttttctttcgaacagtcacatttgaattgaacaggcattttttctaaaacgttcagctcttctgtatcaagcaatcccttcaatatttcttctggtgtctgtccttcatctaagagagtagagattcttggtgttgtttttaattgttcctcaatcttgctgattgtttcttcatcggcacctggcatgatttgaatcatgaatccacctgctgtcttgatactgtcatcagtattgaccagtacacttagtccaacagctgaaggaatttgttctgagatagcgagatagtaagtaaaatcttcagcgatttctccagaaacaattggcgtttgtccagaaaaaggctcttttaatcctaaatcttttgtgacagtaaacatcccttgtgtcccaactgctcctcgcacatcgattttaccttcactattcaaaggaaggctgagatgcggatttttgatgtagcctttcacatctcccttcccatttgcatctactacgattcctgctgctggaccatcgccttggattcgaacagttagtttatcttctcctttaagtgttgcaccaagcagcagactgcccactaatgttcgtcctaaagcagctgaggacgtatgccaagtatcatgacgtctttgtgcctccgctacggtatttgttgcttgaacggcgtatgctcgtacgaatccgtcgtgagcaagtgccttaaccagataatctttcatttgttatgtactcctttttccgtttttaaactcatagtgaatcatactagcaactcctgcttttttcaactttggaatgcttcttttaaaaataattcagaatcatctagataacaggacatcatcctatttacatcttaaataaagaaatctcccgaaaaccggtttttgttccggttttcgggagtcctatcagatcaattgacctatatttttttatttgtattgatcgtctgaatgattatcttctgatcgttgagaatctgaatcatgttctgctttattttcctcatgcagctcatgttttgcttcttcaaaatcacgtttttcttctgcttgtttttcagcgtctttttcttccaaagcacgttttgcttcttcaaaagttttcgcttctttttcgcttggataatcatttgactcagtaccttcaggcatcacaccgtgttcgaataacgatttgattgctttggcatccaatgtttcgaattccagaagtttttcagcaatcaatttatgctgtgcacgatgagcttcgatgatttcatgagctttggcatgagcttccatcaaaatcttgcgtacttcttgatcaatttcgaaagcaacttgttcagagtaagcttttgtttgaccgtagtcgcggccaacgaacacttgatgatttccttcatattgaacgggacctaaacgatcgctcattccatattctgttaccatgcttcgtgctaaagctgtcgcttgttcaaagtcattggaagccccagttgattggacattgaagatgatttcttcagctgtacgtccaccaagcaagcctacgatttgttcaaacatatcttcttttgtcatcaagaactgatcttcttttggtaaagcgatcatatatccaccggcgcgtccgcgagggataatcgttactttgtggacgacccgagcgcgacttaacactaatccgacaatcgtatgaccagcttcgtgataagcaaccatttcgcgttcttttttgctgattacacggtcttttttagctggacctgcaatcacgcgatcttccgcttcatcgatatcagaagcatcgattttctttttatttcttctagcagctactagcgccgcttcattcaagacgttttccaaatctgctccggcaaaccctggagtctgttgagcaacaactttcaagtcaacatcatcggccatcggtttattccgtgcatggacgcgcaagattgcttcacgtccttttacatctggacggccaactaaaatttgacggtcaaaacggccgggacgtagtaacgctggatctagtacgtcagaacggttagttgcagcaatgacgattactccttcatttccgtcgaaaccatccatttctacaagcaattggttcaatgtttgttcgcgttcatcatgtccgccgcccataccggcaccacgttgacgacctactgcatcaatttcatcgatgaaaatgatagccggtgcgtttttcttcgctgtttcaaacaaatcacgaacacggcttgctccgacgccgacaaacatttctacgaaatcagaacctgagatcgaataaaatggtacgccagcttctccggcaacagcttttgctaacaaggttttacctgttcctggaggtccttctaaaagtacacctgccgggatacgggcacctaattcaacaaatcggcgaggatctttcagaaattcaacaacttcaactagttcttgtttttcttcttccgcacccgctacatcagaaaaacgtacgcgattagcttttttgtctgcttctttggcttttgatttaccaaagttcatgacacggccgccaccgccaccaccgccgccttgttgtcccatcatcatgtagaagaaaaagatgatgatcacgatcggcaagaagctaagcaataacgaaacccatacgccgctgcttgattcttcttttactgttgtagcaactttgttttcttttgccagttctgttacttggctcaatgttgtatcatttggcaaaatgattgttgtgaaatgggtagtagtcgtatctgttgaacccaagatagctaacccgccgctgttagcgactgtctgctgttccttgtattcaccagtgatcttatatacaccatttgcaggctgcacttcaaactctttgattttgcctgcttgtagttgttctgtgaattttgagtactcgatatctgacgatcgctggccgttattaccaaaaatgaaataaacgaccattaccatcgctaagattacgaggacataatacaaggcatttttcatcatgccattgttctttttgttcatagttgccctccctaagcgtcaatttaatttaacagttttttatcaatcctgaccattctattgtaccataatttaattgagatacagcattaatttgattgataaacagtaggtttcaatacaccgatgtacggaaggttacgatatgcttctgcataatccaagccataaccgacaacaaattcatttggtacgttgaacccaacataatctgcttcgatgtttactactcttccttcgggtttgtcaagcagtgtaacgattttgactgattttgctttgcggtatttgaaaagatccactaaataagcaagtgttcttccgctgtcaatgatatcttcaacgatcaacagatcgcgaccttctacatttgtatccaagtctttgacgatttttacttcccctgacgagactgttgcattcccgtagcttgaaacatccatgaaatccaattccaaatacgtatcgatagaacgaacgatatctgccatgaatggtaccgctccttttaagacacctactactaggggattggtgttttggtaaatttctgttaactctttgcctagttctttgcaacgaacttgtatctcttcttgtgagatcaaaattctctcaatatccttttccaacatcaggttctccttccaattgcttctttttgatatttgtaaagaagtatgtagtgtattttatcagtttcttcacgaatactcaaatatgaaaaggcaaaaggtatcaggctatatatatttcttttggcatctgtaatgatccaagcatgctgcctttgtgaattaggtactttctgatcgataaaatatctagatactttttttgtaagtttctccgttaattgaatacggtctcctgcttttcttttttcgacatatagttgcacatcggcgggaacccaaatgtcatgagaaaacagagaccatgaatctgttgttttgatgtcctctgaatgttcaggtttgaccagaccaatccattctgtttcgttcaactgtatcccttgttctggaataagcaacaagcgctgatcttctgtctgagcagtggcttgtttttcttttttagcgagtataacaaaatgatactctcttttcagtacccagttgttgccgatgctaagctgccattgactttttttctgttgccactgatctaaaatcgatgtcatttgctgctctttcaaaatgacccctgtttctgagaatactttgtcgaagaaggagtggaaaaaatagtatcgttccgcttcttccattttttctatcatttctgctgaaaattgaaatcgatcctttaactgttcgacttccttttcgattaactgccccatacatttttgaatgacttggtctgcccattgaatctgttgcgaaaactgttgaaaatgtctcatcacctgggtgttttcttgttttaattgaggaacaaccaaatggcgaagccgatttctttggacatctaataattggttcgtctgatcctcaaagtaaacaagctgtgattctgctgcataagcatataattcttctttactgaaactcagcaatggacgaacaagtctgcccgtagcaaatggttgtactcctttgattccagaaaaagtacttaactgtcctccacgaatgattttcatcaacaccgtctcgatttgatcatctccatgatgagcagtcatcaacgtatcatattgtccttcttccatcactcgagtgaattcttgataacgaaagttacgagctgctgtttctatggccgttttggccggattttcccaaacacttacatataaaggtagattcttcttttcacaatatgagcgaagataagcagcttcttctgctgattcttctctcaattggtgattgatatggacgacgcccaaagaaaaaccgatttggcgttgcgcttgcaaaagcaaatggagcaaaaccatcgaatcaaccccacctgataccgctgctaaaatccttgattctttttgccagaatccttgttcatttccgtgccgaataaatgactgctgcaatagcggtacttttttaccgtctttttcaacgttcattctttccacaccctttcttcctaaaaaaagagagcgggaaaacgtctaaaacgacaattaacctgccctctgttgatactttgactaaaatagtcgcatcatcattattttcagctttattagctgcggcgtccgccacggccaccgcgttttccttctgtgtttcgcttcaatgaagataagcggtcatcgctatctttcaaaaatgaactcatcaatgaatcgaagtcttctttttgagctgaaggctgactgcgagaaaaagattttttctgtgctggacgattgcggttgtcacgggaatctttttgttgaaattttttatgacggctttcttctccagattctacaggttgttcctgcgctttgcggatagatagtccgattttcccatcatcatttactgaaataactttgactgttacttcatctcctacacttaaaacatcatggatgtcttttacatatccatttgacacttcgctaatatgaactagacccgtttttccagcacctagatcaataaacgcaccaaaatttgtaattcctgatacttttccttgcagttttgctcctacctcgattgacataaaaaaaatgttcctcctaattatttcccttttttatattcctgcttattttgcagttgtagaactagttgattgatctgtttcatttgtcgagctgtctgtgtttgattctaatataggataaactttttcaccgtcttttgagtaaaagaatttgcttctggcaagtttagctacatattcatcatctttcagcaatgaaacatcttggtgcagctgatcaacgtctgcgttgacttctttcatttcagtatttgcttcgactctcaattcgttcaattgatgcatcctttgcatatcatggaaaatctgcacacctattatcgcgaaaatgaccaaagcaccaacaaaaattgcagccagtctgcgtcttcgaaaaatcagttgtcgttgttgttgctgaaattcagcatactttttctttgcatattccgtatctagcgcagcgattttattgctttttttcgtcacttggattcgctccaatcttttttgattgtctttctcattataccaatatcatgaaagcttgtctaatctatttctctagtgtttctgtgcgattttcagaaataatttcgtacattttttgtgcatcttcttttttggtcgattcatgtaattccgtaatttttacttccaacgttttattgccgaactggactttcaaaatgtcgcctactttgacgtcactggaagatttcgccaattttccgttgatttggatccttcctttatcagccacttcttttgctactgatcgtcttttgatgattcgggatatttttaaaaatttgtctaatcgcatatcttattcctcactttttgatttttttgtttaatcgtagaattttcttaccaaatggcaacatgagccactctcttactgtaaacagacggagacgaatcactgcataaatgaacacagatgcgccaatcccaacgcctatcacactgacaaaaaaagcagtggaacgatgagttacaggaccaaacactatattcaacacaccataatacagaagcaagactgctgtcatacaaagaaggctgataatcaacttccgcccaaaatgtcgttctttccaaaaagcatttagctcttttgtttcgattcggacaaaataccaaagcgtcacacctaatcctaaaagggtagacaggcttgctccggctgttcctaataaaccagttagaaaagaagtagtcaatccttttaccaagagcccccatcctgctccttttaaagaagggcgaaaagagttcttgctttgagcaatactttgataggcttggatgactgcagtaaaagcaatggaaaaaacaaacaatacaagcgctgcatttcctgcataatctttaaacaacgcataattgatataaggaagcagtaaggctaatcccaaagatgcagctaatgccaaagcggtcgtcaatctaagatagattttggctgtctgtaaaaactgacgatagatccggttggtcaaatgacgggtcaatgcaggcagaaatgtcgcacttaatgcggtggcgatcactaaacctaattgaaccaaaggctgccctcgatcatagaccccttttgctatcttcgcaccatattccgatagaccgtaaacttccaaagcattttttacaaagaaagagtcgatcagctgaaaaaagatgagtaatccgctataaatcgaaaccagaccgccttctactagaaagcgccggatcaaagattttggtggctgtttgaataatgggaaccggcggaagcttaatactcctccatgaatcttttgttcatagtagtgaaggatcccatatgcgcataacccgccaaaaacggctccactcatcgctgccgtccccgtttggtacaccgtccatccgagctttctaaaagcaaacgcactacagacgattacagaaacacgaacgagctgttcaacaacttgagaaactgccgttggttccatcaaaaatcttccttgaaaattccctcgataaaaagataaaccaggcatcagcaaaaaggtaaaagaaactacttggatcagtggtttcaattgtatatcccccatcatccaagcaatccaactgctaaatgaaaagacaaacaaccacagaaagacacctgtccaaaacaccaagggataaagactttgcaaagcttgctttcgctcgaaaggattctttctttctgcaacgtactttgatatgaactgcggaagacctgataaagctaaagtcattgctatcccataaattggataaacttgctgataaacataaaaaccttcgtcgccgactaagttttggagaggaattcggtaaagggcacttaatacttttgctatgaaagaagcaatcgtcagtacaaatgctccttgcatgacgcgccgcatttctttatgatccaaatcgttgctccttcctacgctgacagatatttttgctcacgcaatgctttgacaaacttttggatttcctgaagccacactgcttcttccatttggtttggaatcgtcaagcgtattaccatctgttctttttcaacgcctagactggcttttagtttcgtcgccgttagtgcttcgaataattgttccacgctgtagcgtttcgttccaactttgcttagagtaaagacgatatgcggctcctgtttccttatcgtttccaagagcgctcgatcgccatccattttaatctgtccgattgtcaggaggtgtgctacttcttctgggtattctccaaaacggtcgagcagatcatcttccagttcatctagcatttcttgcgaatcaagttcacgaattcgtttatagatctcgattttctgccgctgatctgccacgtatgtttcaggtagatacgcgtcaacaccgaggtcgatctcaacagtggtcttctccacttgactattctttccttgtttacgagacactgcttcgctcagcatttgagaatacatatcaaaaccgactgcatcaataaatccatgttgctgagcacctaagagattacctgcaccgcgaatggaaagatcacgcatcgcaattttgaatccagatcccagttctgtaaaatctttgattgcctgaagacgcttttcactgacttcattaaggatcttctgctgctcatacataaagtaagcatatgcgacgcggctacttcttcctacccgtccgcgtaattgatataacgtggataaacccatataatcagcgttctcaacaaacaatgtatttgcgttcgggatatctactcctgtttcaatgatggtcgtagtgacaagaacatcatactgaccttcaataaattcaaagagcgtattttctaattgcgcctctgtcatttgtccatgagcatagccgatccgcgcttccggaacgagttcttggatttcttctactttttgttcgatcgtttctactcgattatataaatagaatacttgtccaccacgtcccatttctcgatggattgcttcgcggatagccccaggatttttttccataacatatgtttggatcggataacgattcgcaggcggtgtttcgattactgaaagatcccgcacgcctagcatcgacatatgcaaagttctcggaatcggtgttgctgtcagagtcaaaacatccacttgtgcacgtaactgtttcaatcgttctttatgttttacaccaaaacgttgttcttcgtcaataatcaataaacccaaatcgctaaattcaatatcttttgacaagattcgatgggttcccacaacaatatcaacttgacctgtgcgcagttgttcgatggtttctttttgttgctttcttgttctgaaacgacttaatagcccgatatttacggggaaaccttcaaatctttccagcatcgtttcatagtgctgctgtgccaagatcgttgttggaactaaaaaggctacttgtttgctttcctttatcgctttaaaggccgctcgaagcgctacttctgttttcccataaccaacatcacctacgagtagtcgatccattggtttttctttttccatatcccgcttgatctccgctgcacttctcaactggtcgtctgtttcagaataagggaaagcattttcgaattctttttggtaggcgtcatcaggaccaaaagcatatcctttttctgattctcttgctgcgtataatttgattaaatcgtcagcgatatcttcgattttcgaagatacttttcgtttagttttcgtccattcacttccgcctagcttattgatgcgaggtgctttggcttccgaggcgacatatttttggatcagattcagttgagtaacaggaataaacagtttgtcgtcgttttgatacaaaatagtcatatagtcttggtgaacgccatctacttctagcgtttccatcccaatgtatttcccgataccatgattggcatggacaacgtaatctcctgcttttaactcattgtagcttttcaatcgctctgcgtttgttactgtttgacgtctcgtttgttttttcgtcgttttttggaaaatttctttttctgtgatagctactattttttcttgaggaagttcaaaaccagcctgcaaagctccttcaactaattgtacctgtcctctgatcaatgcatttttttctgtttctactactaatatatcttcatctcgaagcatttgttctgctttacgtattctgtcctttgtcggaataaagatcacaacagtctgtttttgcttgcgccaacgatccatttctgttttcagcaatggcatttgtccgaagaactgttgcatcgtccgatattgaaaattatggattgcttggaaacgaagatttcccatccctttttggaagagtgagaaaaaggttgtagtaaatttttccttttgaacgattctttgtacatctgctgaaaatgactgctcagaaaaaacccgcaattcgctgattttttgagtatgccattctgccgcttccctttcgatttcccgatttgtttccatgatccgctggtaatcatcaacgactagtaaactatttgaaggaaaataatccaagatcgttacaaattcttggtaaagaagatctgagtagaattttgcttcttctgtcgggatacctacttgccagcttgaagtcatctgaccgaagtaatcttgtaaaaactcgcggtctgcttcttctgtggtcgcagcaagccgtttttctagcattttttgcatttgctctattccatgttccagatcctctggtccatagacttgttcactcgttggagaaacccagatttcttccgttttttcgattgaacgttgtgtttctgcttcaaaataccgcatagaatctatctctacatcaaataattctacacgaataggatagtttgttgttaatgggtaaatatcgacgatgcttcctcgaatactgaattctccgggttttgcgaccatttcttctcgtacatagcccatcaaagtcaattggcgaggaagattttccacatctatctcatcaccaacatgccaattcaattgcgcctgtagccaagttttcttattcggcagtcgcttgtgcaaagctgcgactggcaacaaatagatacctgcttttttttcttgaagtgcgttgagcgttgcgactctctcgcctcgcgcttctggagaagaaaaggccatttcagcagaaagcacttcatccactggaaataaatggatctgatcctgcggaatcacatgttgcagatcttctgctaactgattggcataatacaaatttggcatcagaatgatcatatttttatttgttttcttaaatgctcgagcaaatagaagcgtcttcgctgagccagctaatcctgtgattagttgtctaggcattttttcttctaaattgctgatccattcttttacttgcggatcttttccgactaattgaatgatatccattccttttcctcctttctcaattgaattgattcatcgcatccacgaacgaatgcccttctatgagatattcgactgctttaacagattgaaatatgctttcttctatcaaaggctggttttctttgctgaaaggactaagcacatgttggaccactgttttttttccttctggtctgccgattcccaccttgattcgatcaaagacattcgtattcaaatgggaaatgatacttttgataccattatgcccgccggcactccccttttgacggagccggatctttcctactgccagatccaaatcatcgtagatgacgactaattcttctggataaatcccaaaataagtcattaacggtccgactgcacgaccagattcattcataaatgtctgtggtttgactagaaggatcttttctccattatgaaaaaattcggcaacttctgcttcgaatggattttttttgaaagcagcttgatgttcgcgtgcaatttgatccacgaccataaagccgatattgtgtttagtatattggtatttggtacctgggtttcctaacccgacaatcattttcatttttgtttttccacctaattctaaaaacagcacaaaaggctggactgctaattagcggtccagtccatcgagctttttttcttttttatactgtcaatgtatagtataacacaaaacaaagcgtttcggctaaaagagaatcgttaataaatgataaagaaattaaaaatttcttcaaagtttaatgaaataattgaattataaaaatagtgaaataacacacatgtaagcttttacatatgatacaaccttgttatctgttatattttatagccaaatagcgtgacatggggcttgagaaatgttagcataagcatgggaaaaaacaaatcaatggaaggattgatactaaatgactgcagctgcagaaaaaaaagatcatcaaaaagttattcttgttggagacggcgccgtaggttctagctatgcctttgctctagttactcaaaatattgctcaagaagtaggtatcgtggatatcaatactgctaaaactgaaggagacgcaattgacttgtctcacgctttggcatttacttcacctaaaaaaatctactctgctacttacgcagacgcacatgatgctgacttagttgttattacagctggcgcaccacaaaaaccaggtgaaactcgtttagacttagtaaacaaaaacctaaaaatcaaccgcgatgttgtcacacaaatcgttgaatcaggatttaacggtatctttttagttgccgctaacccagtagatattttgacttactcaacttggaaattctcaggtttccctaaagaacgcgttatcggttcaggtacgtctcttgactctgctcgtttccgtcaagcacttgcggaattagttgacgttgatgcgcgtaacgtccatgcttacatcttaggtgaacacggagattcagaattcccagtttggtcacatgcaaatgttgccggcttgcaaatctatgaatgggtgaaaaacaacccagaaatcgatgaagaagctatggttaacctattcttcggcgtacgtgacgctgcttacacaattatcgagaaaaaaggtgctactttctatggtatcgcagtagcattagcacgtatcactcgtgccatcttagatgatgaaaatgctgttcttcctttatcagtcttcatgaatggcgaatatggattgaacgacatctacattggtgcacctgctgttatcaaccgtcaaggtatccaaaaagtaatcgaaattcctttaagcgacagcgaacaagaccgtatggctgcttctgctaaacaattaaaagaaattctagatgaagcttttgctaaactagacgctgaataatctttgaatatgacggaaaacatctaaacggtgttttccgtttttttattttatcactcttatggtttctaaattttttcataaagaagagataaccttcgtcttttcgtctaaattatgctatcatgagaccgttccaccctaaacttttacttaaggagttgtcgatatgacaagatcttcgcatcgaaaaaaatcgaaacatgttgctttgctttcagctcttggtgttctcttggtgctgattagcttttatacctatcgcagtacatactacacaaagcattttttgccgaatacggaaatcaacggaataaatgtcagcaatctaacagtcgaaaaagcaaatgaaaaattaaaagaagcttattccgataaaaaattagctattaaagaagatggaaaagtctggcaggaagtaccaaaatctgagctcggctataaagatgatttcacttctgagctttctccgatcctaaatgaacaaaacggatggacttggggaatgacttatgtttcagcagctgaaaaacaagaaatcgatcctatcagtcaagaccaccagaaactggatactaccgttcagacattgacaactaaactgactgatctgaataaagaccggacacctacaactgatgcaacaattgaaaaatcaggcgactcttttgttatcaagcctgaagtcaatggaaataccatcaacgtcgatgctgcggtcaaacaagtaaaaagtgcagtaaattccggtaaagatacgattgaattaactgagttcaaagaaaaaccaaaagtaacctccggagacagttcactgaaagaacagctcgaatccatgaatgctatcgcaaaagtaaaagctacttacagtataaacggggagactttccagatcccatcaagtgatatcatgagctggctgacctacgacggaaaagtcgatttagatacagaacaagtacgtcaatatgtaacagatttaggcacaaagtataacacaagtacgaatgacacaaaatttaaaagtacaaaaagaggagaagttacagtcccagttggcacttacagctggacgatccaaacagatagcgagacagaagcgctgaaaaaagctattctgacaggccaagactttactcgttctccgattgtgcaaggtggcacaaccgctgatcatccattgatcgaagatacgtatatcgaagttgatctagagaaccagcatatgtggtattataaagacggaaaagtagcccttgaaacagatatcgtttccggaaagccatctacacctacacctgctggggtcttctatgtttggaataaagaagaagatgcaactttaaaaggaacaaatgacgacggaacaccttacgagagtccagtaaattactggatgccgattgactggacaggtgttggtatccacgattctgactggcaacctgaatacggcggagatttatggaaaacccgcggttcacatggctgtatcaacactccgccaagtgtaatgaaggaattattcgggatggtcgaaaaaggaacacctgtattggtcttctaacaaaaaagaatttataaaaagaacgcacctgtacgaatcgtacaggtgcgttcttacttattatctcaactatgcacttgcttacatttcagcagcagtaaagacttctgagacatcatcatcgtcttctagcttatctactagacgttccaattgctcccgttgttcctcatttaaatcgatcgtcgtttgtgggatcatcgtcaattctgcttgcgctaaagtgaactctttttccagctcatctcgtacagcagcaaaatcttctggtgcagtataaatctcgaacacttcaggagaagtttgcagatcttctgcccccgcctctaatacatcttcaaacatcgtctcttcatcaacagccaacccatcgcgttcaatgacgatataccctttacgatcaaacaagtaactgactgaacccgtttctcccagtgacccaccgtttcgagtaaaagctactcggacatttgtcgctgtccgattacggttatccgtcaatgcatggactaagattcctactccacccgggccatatccttcatacgtgatttcatcgtaattcgtttcatctacggcgctggtagcctttttaattgcccgttctacattgtcgtttggcatatttgcagctttggctttgtccacaacaagccgcagagctgggttcatggatggatcaggaccgcctgctttagctgccatatagatttcacgagaaagtttctgaaaaacttttcctcgtttcgcatcttgggcattttttcttccttggatattatgccacttactatgtcctgacatgatttttcctcccttgttcttttgagaatacacttctattctagtactatttcacaaaaaaacaaagccacagccaatctataaacgcttcttgaatgtcgcaaaaagcacacataataccacagcagtcagagcaccgatcgaatccagcatgacatcttggaacataggtgttcgtccaccggtcaacatctgatggaattcgtccaaacctgcgtaccctgttgctgaaagccaagcaaggatcgctgtcagccaccaaatctttagtttagggaaaacacctaaaaacaagctgccacccaaaacaaaataagtaccaaaatgtgcgccctttcttaaaaagaactctacaaatttggcgtagcccagatggtcgatactcacgatacttccaccataattaaaacgtatacctgctaatgtgtccttaaatggctgattaggaagccagctttctaatcgcgaaacttgtgattgctgtccgtaagtttgagaagaactgtaaaataagatggcaacgactataagtgcgatcactaaataaatatttccgtttttcagttgtttttttgaagaattcataagtcacctctgtatttatcttagactttttttgaggaaacaacaatcattttcatagagacttcttctataaaaaagtgctatacttaattttgtattacaatatgaagggagttttttcatgagttattcattaaattgggatctagattctattttccccggaggaagtcattctgatgctttgaaccaacggatgaagcaattggaagaccaaacgaacgaatattatcaacgtgtaacaaaatggtcacctagttctgacaatgcagagcagctaaacgcgattcttcaattgcaagaaacgattacgaacggctttacccaatgcaacagctatattactgcattgctttctgccaatgtcaatgattcagatgcaaagatcttatcagggaagctttacgccatacttcctcgtctacaatcagccgaaacagtattgtcgaagaaatttgcagaaatatctgacaatgattggaatcagatgctttcccagggttcgtttgaaacagttgcgtttcgtttaaacgagatccgtcgtgacggttcacaattattatcagaagctgaagagaacattatcaacacgctctcattagatggtctaaatgcttggagcagtcattatgatacgattgtagccagcatatcgattcccttcgaacaagatggtcaagtagtcgaattatctgctggccaagccttcaataagatgatgggcgatcgagatccaaaaatcagagaagcacttttcgcagcatgggaaaaagcatggaaagaaaaggcccccctcttcacagatactttgaatcatttagatggtttcagactttctaactatgaactccatggcatcacggattttctgcaaaaaccattagaatacaaccgtttaaaaaaagaaacattgtctgtcatgtgggagacgatccaaaaaaacaaacaaccccttgttgattacttgactagaaaagccaatcttttcggtaaagaaaaaatggaatggcaggatcaagatgcacctattattttaggcgatttgaaagaaaaaacctttagttttgacgaagcagctacatttattatcgaaaactttaataaattcagtccaaaaatggctaaattcgcacaatctgcttttgaaaagagctggattgaagcagaagatcgtcctggaaaacgtcctggtggttattgtactgagttaccagaaacaaaagaatcgaggatctttatgacctacagcaattctgttaatgaggttgcgacacttgctcatgaattgggtcatgctttccatagcagcacgatgtgggacttaccttctttaaatcgtgaatacgcaatgaatgtcgcagaaacagcaagtacattcgcagaactgatcgtagccgatgctacattaaaagccgcaaaaacaaaagaagaaaaaatcaatttgctagatacaaaactgcaaaatgctttagctatgttcatgaatatccattctcgattcatttttgagaatcgattctatgaagcacggcaagaaggattagtctcagaagataagatcacagagatgatggttgaagcacaaaaagaaggctaccaaggagctttagccacttatcatccatatttctgggctgcaaaattacatttctttattgatgacgtaccgttttataacttcccatacacctttggctacctgtttagtttaggcatttatgcttacgctaatcaaaaaggggcaaatttcgaagaagaatatatccatttactacgtgatactgcttcaatgacgacggaagatcttgcaaagaaacatttgaatgttgatctcactcaaccagatttttggcaagcaggtatcgatatggtgatggaagatatccaaacgttcatggaattgacagaagaattcatctgatttctattttctctcaataaaaaagagttagtccagaaaagggctaactctttttgattaatcattcttacatgctgacagcaaagtcaggtgcaaaccattgaactgaaccaacttttacgctttcgcctggttgaggagcatggatatattgtcctccgcctaaagcaatcgctacgtggtaagttccgcctggtgaaccccagaataataagtctccagcttttgcttgagaaactgagatttttgttccagctgattcttgaggaactgtccaaccaccaatgtcacgaccagttacttgcaagtaaacatagcgtgtgaatcctgagcagtcaaatccacttggatctttaccgccccaaacatatggagtaccaatatatttgtaagcttctgctacgattgctgcaccattcacacttccagaaggcgttggtgttggtgttgtattagttgtgttattagttgcattactaccagtactgttcccaggatcaacactttgatctgttgatggtgttgtaggcgcaggtgttgttgattcttctgttgaagtttcaggtacagttgttgattcttctgttgttgaagattcaggcactgttgttgattcttctgttgttgaagattcaggcactgttgttgattcttctgttgttgaagattcaggcgctgttgttgattcttctgttgttgaagattcaggcgctgttgttgattcttctgttgttgaagattgagcagctgatgatgattcttcagtcgttgaagattgagcagctgatgattcttctgatgctgagctttgtgcagttgatgaagcttgagtagcttgtgcttcagcttctgcttgttcgcgtgcttctttttcagctttttcttgtgctgcttgttgacgtgcttgttctgctagacgttgttgttcacgaatgcgtgcttgttctgcttcagcttctgctttttggcggttcaagtcagctttcttgtcttcagcagttgcttgttcagcagctaatgaagttttcagtacgttcaaatcagcttgtttagataaaagatcgcccttttgagattccaaagcagcttggttttcagctaattcttttagtttagcatcgttttcagcttttttgtcttctacagcttttttatcttgtttttgttgttccatcaagtcgttgtttgcttttaccatcgttgtcattgcttgaacgcgtccgatagcatctgctaatgaatcagcattcaatacagcatcaatatagtttgagcttgtattgcttacttgtgcttcacgtgcttgtttttggattgtatcttcacgtttttcaatacgttcttgtaaatctgcaatatcttttactaattgtgcagattcttgacgcaatgtgtcttgttttgctaatagatcttgtgcttgtgtgttgatttcagaaacttggctttctagggcatcgatttgtgattgtgcatctgcttgttggtttttcaagtctgcaatcttttgatcttgttgttgtatctgagaatcaaaatcgtccgccgcggcagcgatcggtgatgctacggcagtcaaggtcattgaacataccattactgctgatattaaactctttttcactcttcattcctccgactggcttaatttaataaatatctaaatatatttaagtctttcttaacgatataaaaattgtaccatagcagtatgtcagcgatataatagttatgttacaaaaatgtttcaaaacaacctctaaaaatgacaaaactgttcgtttcagaaaatgatcatgaaaaaggcatgctaagacgggctttttttaagataacaataattcttttttactttcagacgaaaaacaaaaaaagaaattattcatcactgaataatttcttaaatggaaaaatgaataatacaaaaataatcatgttcaacagtagtgtaggccctaagaaccttgtaataaaatacgtgttatttactactgctagtttaaaaatcaattggaccaccatcgtaaacagttcataacccgtgacaaagataatcatactgaaaaattcagtaaagatgttgacgtggatgacatctttcattacgtacatcaaccatacgattaaagggagagctactgcatagataccgataacaccgatatagtaagcatcatagactgcaccgagaacaatcgtggtgattagcaaatagcgtttttcaaatgccatactacaacataacaatgccaagatcagaaagtgggcatttgacatatagctgcctttcgaccactctcctagcattcttgttaaatggccatctagcaacatcaaaaagaaaagaacgattggcagatagtacttcattgtttcttttttcaacatggactaatcctccgctagccgttggacaatcgtcacaactgacacatcatacatttctgcataaggtttcacatacacttcccgatccagaccataactgtctggtttcgttttgataaccgtaccgatcggcaagttagctggagaatttcctccaagaccggatgtctgaacaacatccccttctttgatatccgtatcaccagtcaattgggtcaccactaatgcatggagtttttcatcatagtttttaagcaaaccgaatgcttcgccattagccgaagatacccgtactggaaaatgattggagctttcgttagaggatgacagtaattcgattttagacgaagctgtattgacttcgatcactcggccaatcaatcctttttgcgacatgactgccatatttgcttcgataccgtctttagaacccttgtctacgatcagcatgtcctgccaactatctggtgaacgagtaatgacatttgccgttactttttcgtaactcgtcagcgtttggttcaaatcaagttcttttttcaaagattcgatttctctctcgtaattcttgttttgctgtgcaacgtcatcataactatcgattttttcttttagccgctcattttcggcataagttgaaaaaagactatggacagaatctactccgtttctcacccaccgtactggggcagaaattgttttatcaaccattgcaacactgtcattaacgatggattggaagaaattaggctttccttcattcgctcgctgtgcagcggtcacacttagtatcgtcaccacgatgataacaataaccaaggtaataataatatttttattaggattgaacttcttcacaaagacacctcgaattaattagactcttgtgttcaattttatcactaaatgccgggaaacaaaaggcatgttgctcctcttaagcttttttttagtaaataatagattctgtcatttttagcctgaaagacaaaatttttccttttgttcattggtcagtctttgctttgaataactgcaatcataccatctgaaaaagaaaattcagcggtatctgaaagaaactcgttacttgcataagatgtcgggtattcaactgctttattttccaatacatacttactgcctttcaatgtaagagccgagacgggcgtcaaacagcaataagctagatacttcatacttggaacctgtcttactatatgctttccaggcaaataataagccaaataattttgacgatctctaataataagctgatgggcaaacggtttgaagcgaggttccagacctaaccagagattggctaaaagatgatccaatcttccgcctgtggcgccgatcaaagtgacttcagcttgcggataatgttcaaatgtctttaagatccccaattgtgtatctgtatcgtctttttctgcgggtgaacgggcatactctttggcttttgcaaatacttcctcctgctcttcgttcgacaatgaatcaaaatcacctactgccagatctactgggtagcctgcttgaagcagatacagcgcaccacgatctattccgacataggcatcgtatttggtcagtaaaggctgcggccagttttccggattacctccagcagctaataaaattttcatttaatctaatgcctcttttaaccgttcgatttgtccgactggattttcggctccatagatatatgatcctgcaacaaagacatccgcccctgcatctttacagacttttgctgtttctggaacgattcctccatctacttcgattgcataagaccaattgttctctttacgtagatcagcgagttctgcgattttttctaccgtttcttcaataaagctttgtccgccaaaccccggattgacagtcatgactagcacttgatcagccaaaggcaaaacatgtttgatcatggagactggtgtccctggattaataactactccagctttgacacctaagctttttgtcatttggagtgcccgatggatatgaggagttgcttctacatggacagtaatgatatctgctccagctttcgcaaatgctggaatgtaattttccggatcaacgatcatcagatgaacgtctagcggtaacttagtgacaggtcggattgcctgaacaatatttggccctaacgtgatatttgggacaaattggccatccatgacatctacgtggatgtaatctgcgcctcctttttctactaactcaatatctctttgtaaattggcaaaatctgcgctcaaaatggatggtgctattttcattcttggttcctcctattttcgtttaccttcttttttcgtatacatgggttttcttttctcgatttcttgtaagaattgcaaataattatcgtaacgtgtctgtgcgatatcacctgtttctactctttgtttcacttcacagccaggttctttggcatgcatgcactctctaaatttgcaatgggcagaagcttccacaaattccggaaattgtcttggcaattctcctgcttcgatagtcaaaaagtcaatcgagctgaatcctggtgtgtctgctactaatccatcatagatagggagtagctccacatgccgtgttgtatgccgccctcttccaagtgcatcagaaatctctcctgttgctaaattcagttctggagatatttgattcagtagtgttgattttcctgctccagactgtcccatgaagaccgatagccgttctggaaagtaacgaatcaattctgtcgtgtcacccgcatgattgggtacaatcactgggtagcctatcttagtataggtttgtttgatttcttcgatttttttcggttcgtctaacaagtcggtcttcgtcaaaaaaatgagcggttcgattgattcatattccaaggtaactagaaagcggtcaagcagattataagaaaatgcaggttccacgatacttgtgacaatgattccaagatcaacatttgtgactggcgggcgaactaattgattttttctcggcaagatttccagaagatagccgtctgtttgattttcactctcaaagattacctgatctccgacaagcggcgtgattttccgattccggaaattccctcttcctcttgtttgataggtctctccgtctgcgtatacatagtaaaaaccgctgattgcttttctgatttgtcctttgataagtgccacctccgtttttgtttattttaccatatgaaaaggaaagtaggtgtcgttccacgcaaacttctcaaagtaaaaggcttgaaaactaatcaaaagggatagaaaacacaaaaaaggaactgtgacacagtccctttttccgagtaaacggtgttccagaagtagcttcttcgaaaaataagccgaaatttcacaaaaatttgagaatcaattttcgtaaattccttcttatttcttgaagctgatcacttctgtcacaacctctttgttctattttattaaaaacttactttgagctttctgaggtactatctgatgaacttgcggtgctggaagattcttctttggaagagctactcgtactgctagagctacttgagctactagaactgtctgaagaatctttctcagaactagaagacactgggtctgatcctttagagtaaatcacgtttacaaccattcctttggtaatcgtcgtacctgcccctggcactgtacggattactttgtccttatccaccgtacttgaatattcagaagactcatgaccgatatattctgcaccaatactagccaaataactttgtgcttcgctttttgtatagccggagatgtcattcagtttaggttctgttccttggcttacgacaaaactgatgtaagtttcttctgctacaacttcacctgaggctggatcctgactaatgatcgaacccgatggcacagtgtcgctatagtcataagtagcactaatgttattgatattgaatccttgtgtaacaagccaattacggacagtttcgtagttttctcctacatgactactcaaagtcactgtttctggtcctttgctgactgtgaaagtaatcgtgtctgttttaggatcgacttctgtatcttctgatggagattgcgaaatgatcattccgctttctacctctgaactgaattcctcttctttttgaatcaaatcagcagaaaatcctaattctttcaaacttgcttcagcatcttcataacttttaccactgtaatcatctaatttgatttttttcgtgccactgctgatataaagagtgacttcgcgtttttgcttgactgtggttcccgctgcagggtctgtcttcaccacattgccttcttcgattttgtcatctgcaatttcttctgtttttgttgctacttctaatttcgcttttgcgagtgtttctctggcagaagcttcagaaagatcagaaacatcaggaacaacaacttctcctcgtccgccagaagcaaagaatacagctgttccgattcctaaaacagcgaggacagctaacaggatcagccaccattttttctgtcctttctttttagggtcaggcagatcttcttcctcttccggcaatgtttcgtttctcggttcgtcttttggcagaggcatagatttgaatgaatccggcattggtgtatctgctgcaagcggtgtgataacttttgtttcgttatccatcgcatgaggttgccatttttcttcgtttgcacgagctggtgataatactgtagaaagatcatcagacatttcttcggctgacttgtaacggtctgcaggttctttagccgtcgcccgtaaaatcacattttccagtgcttgcggtacatttggatcaagtgcctttatggatggaagatcatcttggaaatgttttaaagcaatcgtcacagcagattcgccatcaaacggcacgctacctgtcagcatctcataaagaatgatccctaaagcataaatatctgactgcttcgttgccatactccctcttgcttgctcaggagataggtaatgaacagatcccaacatcgtattcgtctgtgtgatcgatgtttcagataaagcaatagcaatcccgaaatccgtgatttttactacaccttcgttatcgatcaatacgttttggggtttcaaatctcggtggatgatttgatggttatgagctaaagaaatagcagaaagaatctgctgcataatatttactgctgtttcataaggaacaggataatgtgtttggatatatcgtttcaagtccattcctttgacgtattccatcactagatactgcatattgtcttcttcaccaacatcgtaaacactgacaatatttggatgaacgagttctgttgctgctaaagcttctcgctgaaatcgtcgaatcgcggtttgatcattttgaaagtcgaatcgtaagactttgactgctacatctcgatccaagatcaaatcgtgcgccaaaaatacattagccatcccaccactaccgatattccccgtgatttgataacggccatttaatttttttcccaactcgatcatacacagtcctccttatattcgataagaagaacggtgatattatccgctccgcctgcttcattggcacgatcaatcagctcagttactttatgggataacgggccttcttgattaatgatcgttcctatttcttcttcagatagcatattcgtcaagccatctgaacataacagcaagcgatcttttagctgccaaagatgagtagaaacatctacttcgactgttcctggcatgccgacagaacgtgttaaaatattctttcttggatggttcactgccatttcttcgctgatttcccctgatttgactagttcgttaactaaagaatgatcctctgtcaattgcatgattttatcttcgcgaatcaaatacgctctgctgtcgccaacattcgcaatcgtgaaccagtcatctgacagagctgccgctacgattgttgttcccataccgttatattccggctgttcttgtcctcgctgataaatcagcatattttcctcttgaatcgattgaatgaaccactgggcgattttttcatcgtcggcagcttcttgttcttcccaagcttcgcctagatttgttaccgccatttgactagcaatgtctccagcacggtgcccacccatcccatctgctaatacagcaagcttgagacctgaacggctagtaaatacactggcatagtcttgattggtgttacgtcgtcttcctacatctgattgatattcaatctgcattttttcacctcattactttttgcgcaaacaacaaatgaaaaatccatctgtgtaaaactgatgcggatacaaagtcaacattttctctacgattgatgattgtagcataggattggtcaaaacatcaatcctctcaaaatcagggtgtctttccaagaaagcagaaacaacgtcttggttttcttcttttaagatcgtacaagtactataagtcagaataccggaagactttaaagctggtgcgcagctttctaaaatttccaattggatttttggtaaattcgctaattcatccggctgttttttataacggatatctggttttcgccgaaggagcccgagacctgaacaaggcgcgtctactaaaatccgatcgaactgctctggttcaaactgcttgctgacttctctagcatccatcttttgagcgtaaacagcagaagagacacccagacgtgttgcattttcttcaatgagtttgactttgtgttcatgtacatctaaagcaatcacttccccaccgcatgaaggatccaaaaaagaagcaatatgtgtcgtcttacctccgggtgctgcacaggcatctaagacatgatgttcaggctcgatttgcatagacggcgctacaagcatcgaactttcatcttggatcgtcatgacgccatcgtggaacaatgagctagaagctaaatgcccttttttcgctactataccgtatggactgacttggcttttttcagctgagatctcttcttcttgcaaaacagtgatggcctgatctctggaaagtcggcgtgtatctactcgggcactagcatggctaggctgatatagcgataaaccgagcttttcagtttcttcgtaaccgatttgatccaccaaccgtttcgtcatccatagaggcaggctgattttgacagaaagtctttcgataggatcagcaatgccttgcagatctggtgctccttgacgctgataattcctcaaaacaccatttacaaattttcctgttccaggatttccttttactttcgcgatttcgaccgcctcgtttaaaatagcatgtgcagggactttatctaaaaattctaattgatatacagaaagatacagaagcgtcttgacccagtcatccactttttttgctttagcgatcaatgatgcaacgtaaaattccaatagtcgctgatggctaatcgtaccgtagatcaattctgtaaatagacccacgtctttttgatttagctcgctttgtttgatcatctcattcagcaaaagattcgagtaggcgccgcccttgttcactcgctctaatgtcagtaatgccatatatcgtacagattttttcatttttttagggatttttttcattatttcacctgctgaccaatctgaacttgctgaccgcttccgttaagaaaatcgtgtacggcttgttttcctttaccagctggctgtaattcattgatggctaatacggtctgtttgccgcaagcaatccatagattttttttgtcttttcggatgatcgtgcctggtgcttcgtctgtactttctgccagtacttcaaccgataataatttccagcgtgtaccttcataggtcgtgaatgcaatcggccaaggacgcatcccgcgtacttggttgtcgatttcttctgcagttttatgccaatcgaccgcttcttgttcacgtgtgatgtttggcgaaaaagtggcttttgactcgtcttgagggactggtttttgtccattcaaaatattaggcaatgtttctaataatagctttcttcctaaaaggctgagcttttcaaacatcgtccccacatcatcttgtttagtgattggcatgctttcttgcgcatagattccgcctgcatccatttttttgatcatttccatgatcgttacaccagtttcttcctccccattcatgatggcataatgaacaggcgcacctccccgatatttaggaagtaaagaagcatggacattgattgcccctaattttggcacttgcaataacttttcaggcaagaactggccaaacgccgcagtgacgatcaaatcaggtgccaattcaatgatttcttccatttctggcgaaccggagattttctctggttgcaacacacggataccgtgctttagagcagcttcttttaccggtgtcggcgtaattactcgtttccgcccaactggacggtcgggctgtgtgactactgcctggatctcgtagcctgattctatcagcccttcaagaattggcacagaaaaagcaggtgtgcccataaatactaacttagtcatcaagatgttcctccatatattcttcaagttcttcttccgggatctgctgtaccattttctcaatgaacagaataccgtctaagtgatcgatttcatgctggaaggcacgggctaaatagccgaaagctgtcacttctatctcttctccatcgcggtcataatagcgtacagtcacttcatctgctcgcttaactgttccatagacatgcgggatactgagacagccttctacgtccatgctttcaccttttgcttcaatgatttctgggtttatcagttcgaatttttcgccttcatctacttcgatcacagcgattcttttgttttgtcctacttgaggagcagcaatccctattccgtcattcgcaatcatcgtctcatataagttgtctaacaaagcaatcgtttcgtccgtgatcacgtcgattggctgagcaggtatttttaatttatcattagggtggatcaatataggatagcgcataagttggtcctttcttaaataaagtttaatggttcgttgtcaattgccacaaaaagaccttgccgctgttctttctggcttccattcaagatttcatccaaaacatggggcagattcggttcatgtttatatttgatgatcagttgataatagtatcgatttttcactctcaaaatcatgctgggtgttggtcctagtaacaaactttgaggacttaatacttcttttagttgattggcaatctgaaagattttctttgccgccacttgttcttcaggatggctggcagttattttcacagtaaagtaataaggagggtagcctcctcgatgccgtacatgcatttcctgctgataaaactgttcatagttttgttttttagccaattctatggcgtaatgctgaggattgaacgtttggatcacgacttcgcctggtttttccgctcgtcctgctcgtcctgaaacttgggtcagcaattggaatgtatgctcgctagaacgaaaatccggtaaattcagggaggtatcggcattcaacacgccaactaatgtgacttctggaaaatccaagcctttagcgatcatttgtgtccctaataaaatatctgcttcttttgcaccgaatttttgtaaaatctgttcgtgtgccccttttcttcgggtggtatctacatccatacgcaaaatcctagcttgcggataaagttctcggagttcctcttctactttttgggtgcctgtcccatagtaacggattttgttgcccctacaattgggacagcgattaggaataggttcttcgtgtccgcaataatgacagcgcatcgaacgtgtatccatatgcaaggtaagagagatatcgcaattagggcatgggagaacaaatccgcagtctctgcacatcacaaaagacgaatatcctcgacgattgagcagtaggacagtttgttcttttttgtctaaccgatcttgtatcttttcctgcaaattagcagaaaaagtagaggtccgatgattctgaaactcttcacgcatgtctacgatctcaatagctggaagttgtgcagctactttggctcggtgattcaattgcaataactgataaacgcctttttgagctcgtgctcttgattccaaagagggtgtcgcacttccaaggactattgggcaatgatggtacttactgcgccaaatagctaaatctctcgcatgataacgcggcgtctcatcttgtttataacttgattcatgttcttcatcgataatgatcaatcctatatttttcagcggagcaaaaatagcagagcgtgcgcctactactacttgtgcttcttcacgctcgatcttgcgccattcatcatatttttcaccttgggaaagtccgctatgtaagaccgcaacagattcaccgaagcgtcctttgaatcgctcgaccatttgcggagtcaatgcgatttcaggcactaacattatagccgttttattttctgacaaaacatcagcgattgattgaagatatacttctgtttttccactaccggtgattccctctagcaaaaagacctgatctttttgttgctgacctgctgtgatgatttgttcgacagcatttttttgttctgtattcagttccaatgccgtcgtttggtcaaatactcggtcttgataagggtcgcgataacgttctgattctacaaactccagccagcccttttcttttccttgattcaagacagcagtactgatttctttatctttgaaataagcgattggttcttcttggctcagttcagataaacacaaaagaagctctttttgtttcttggcattttgccgtaattttgcccattcttcttcgatttgcttttcagttaatagggaacggaccaaacgaattgtttttactttatttcgtgtatggacttcgtatttgatatctactaattgctcttggcgccaacgaatcaattgagaaaggctgccttcttcttctgcttctttccaggaaatcacttcccgttgaccaaacaatgcctgaatttctggtgtatctgccaaaggatagatcaatttatcatattctgctttcatcacactcggaagcatcgtttgtagacaagtgattttgaatgcataagtgatttttttcatgtaatcagctaatgaaagtaattcttcattgaccaccggagcaaggtccagcaaacggatcactgccttcaacgatgggttagctgattcttctgatttttggatagccataacaaatccttggacatgacgattgccattaccaaaagggacctctacccgcatcccgacttgcaaagctgtttccatttcagagggaaccagataggtgaatggctgatcggtctgcatagtaggtacgtccacaatgacttcagctgttaatgtcatggttcgtttcctcctttttttgtcttttcatatcaagcgacaaaaagttctttgcctattttactagagatcgctggatttgtcttattttctgccaaatcctaacaaaaaattaacagcagataagaaaaaaaagaactgtgtcaaaaagttcagacacagccttttctaccagacaataagtggcgaatgtttgaaaaggaaacagctgggtttgcttttctttttagatgttcgctctacttttctttattacattttttgctcttcgcggatacgtgattccaattcgtgttgttcacgctctttttgagcttgacgttcctcttcttccatcttcaaacgttcacgttttaattcaggatgaggatcattgactacattccctgcatcgatttcttctaaagcttgaccaacgctttttactgaatcaaaagaatctagtgtaggttgtgcacttgcatccaactcatgcgcgcgtttacttgctaaaattactagagaatattttgaatttacacgatctaatagtgagtcaattgaaggttttaacatcataagactacatctcctttaacattttaatatatttaccgattacgcgatctactcgaaaatgttcactggcaataatgtgtttgattcgttcaactgctagcggcacttcatcatttacaacagcatagtcgtaaagagccatcatttcgatttcttcttttgcaactttcattcgttcttcgattacttcgtctgcatctgttcctcggcctacgattcgtgattttaattccgctaaatctggcggagtcaaaaaaatgaatacaccatcgggcactttttctttgacttgttttgctccttggacttcaatctccaagaaaacatcttttccttcatccaatgtcttgttgacatatgacaaaggcgttccataataattcccgacatattctgcgtattccagcatctctccagcttcgatcattgattcaaactcctctttgcttcggaagaaataatcaacgccttcgacctccccttcacgcattttacgggtagtcattgagattgaatactgaaaatcattatcctcactctcaaaaattgcttttcgtactgtgccttttcctacaccggatggaccagacaacacgattaataatccacgctctgacatgacgacgtcctttcaactagtctttttgtacttatcgtttattttgcactttttttctgcaactttcaaggttatctttaattatagctagaaattggtaaaaaagctaccctgtaccaagaggtcgtgaaaaggctgtcctgcatcaagtaataagaacgaccaaacataaacagcttctcatgtttttcgtttggttgggcttattaccgcagatgcaagcttttgaacgccgtgtatgagaggtcgtgaaaaagctgtcctgcatcaagtaataagaacagccaaacataaacagcttctcacatttttgcataaatttggcttcataccgagaaaatggtttttgaacatcacttattcaaaatatttttattaatattttataactttacgcaagatcataattttgtctgtgtagatatttcgttatatcactaaagataataagatttaatgacctcattaatattgtttgctaggtccaaactcttattaaactttccttgctataaaacccaaacatagtaataaaagaataacttattacctttaaattatactaccaacaaatggtagtatattattaatttatataatatgaaacctaaaatatagtagtgtgttaatttatactaaattaaataaagtactacctttaataggtagtactttattatcaagccattattccttcttctactagttctttttgtcacataattttgcaatcaataaatgttgcgcaataagtataagaattccattttctaaatttgaaaggtgatccataatttcatgttcaagtagtttattaattgtccacttgtcgcttcatctaaaaattttataggttttaggaatgctattcgcttattttaggaagattttaactgtttgctatagatatatatcatactagtatcgtaataaaagtactctaaaagaagaattttcaaatacgcaaaattaagtacgaaagagttgaaacaaatttggagaaaatgagcatagaatgtctgatgagttaaatagacctaaaaattatctaaaagtggagcaaaattaggaattacaaacaaaacactaaattagtttatataattttccgtaatatttaatatatatgaaaaggaaaacgtagaaaattacgtctacgttttcctatttagttctatatttttattaaattttatatttgctcttttcacttttcggaataaattcactgtgactcttgataccttcttttatatattgctaatgtattttctccattgctatgaaaatagactcaacatatttataatatctatctaatctattttcatttaaccgcagcatcttattaaataacgtgtaaataagaatataaaagttattgaactaattaataaagatagaatcatcgtagttggatacgtagatgaaacctcaactatagttctttttcccgtacctttaatagacactaaaccattgtcattttctatagtgctctttttcccatttactttcacaactgttccccaataattgaatacaggtaatgtgatattttgctcatcggcatcttctactgtatagactattttggaattatatgctttatgagatgcattctcccatcgatcaccaacttttacttcatgtttctttaaatgatctttatatttcaatgcatctaatggtgcatagtcatataggcctccagttcttgaggatgtataacgtgtaacatcttttttggtcataactaaacgacctttatacgactgaattttatgcgaataatttgcttctgttgctgcagtcacagtaaaaataataagaactattcctacaaggctccacatactttttttgttgcttgttttccactttaaaaacactatggttaagattaatgaaccaaaaagcacttgaaaacccaagattctccacggaaattgaatgatttgaataggtgttttttgtaaaatttcccatggaaaaagattcgttgataaaaaccaagtggtcactgcacaaaaataaataatcttttctttattggtaaatttttttaaaaagaaaagtggaagaatcaatgaaaccacaccaattgttcccattgtaaacgttactaaaccattatttactgcaccgattaaactatcagaaatattcaatgccctttcttgaagatttgtgcgaaaaggacgattaattttttgatgtaggacttgttgtaacatcggataccaaacgtaagccgttaaaagaatggtccaaccaacagcttttatcatatttaatatcagatccgacatttcttttttctcttttcgcttagagaaaagagagccgataaacaagaagccaataacaatcacactcataaaagtggagagaacatgggtatagatgagcaaactcatactgatagctaaaggaatcacacagttctttctttcataaagaagattatacgtgtaatacaagacaactggtataatcgtcaacgcaattgattctgaaattgcagaacgctgatatatatcaattaaacgatatccataaaagctatacaaacagctaaataagaaagctgcatctattcgcttaaagaacctttggccatattgataggtcactagaattgtacaaatattcaatacccaaacgtataaaatgtaacttagaatcaaattatttgttatccagtaaaaaattacggctggaaagagtgttagatacggataaaaaaaattgacccctccgccataactattaaatgtggtaaaatttattggaccagaaaatactgaggacaagccttttattctagaaaagtgaaaagcgatatctcctgtagttgagatcttttgtgtattactaaaaacaaaaaagaataaagactagcaataactaataatataacaagtagtactagttttttatttagagagtataaaatattttgtgtaaatagaaaaaaggaagtctcttctgtagaatagagttaccataacacattcacagaattccgcgcgaccgcaacggcgagttcaagcaacagactgttcctgcttatagacggacgaatgataccttagaggagaccatcattcacctcttccgaaaaggtattaccatgtcggaaatcgcagacttgattgagaaaatgtatgggcatcactatactccacaaaccatgtccaacatgactaaagtgctgactgaagaagtaaatgcatttaaagttagaactctaaatgataagtatgtcgctattttcatggatgctacttatattcctttaaaacggcaaaccgtctccaaagaagcaatctatattgccattggtatacgagaagacggcactaaagaagtactaagttatgcgattgctccgactgaatcgacctacgtttggaatgagttgttacaggacatttactccagaggggttcatgatgtcttactgtttattaccgatggcttaaaaggcatgaaagatacgattcaccagatttatcctaaagctaaataccaacattgctgtgttcacgtttcccgtaatattgctcataaagtacgtgtcaaagatcgaaaagaaatctgtgatgattttaaggctgtttatcaagctagctcaaaggaagaggcaaatacctttttagggagtatgattgagaagtggcagagaacttatcctaaagtgacgcagtcactgataaaaaatcaagatttattgactttttatgagtttccgcctggtatccgccgaagcatttactcaactaatttaatcgaatctttcaataaacaaatcaagaaatacagccgcagaaaagagcagtttcaaaatgaagaatcactagagcgtttcctagtatccatctttgatacatacaatcaaaaattcttaaatagaagccataaaggcttccaacaagtgacggatacattagcttcaatgtttactgagtaacccattattttgcagaaggacgagttatttacacaaaattattgacgctcccatgataacaacggatgaaaaaaatgttatcataacttttaaacattactattcatataattcttagaaattttatgtactatggtaagaatggaaaacttattatcgatcgtaagaaaaggaatgatgcacattccaaacatagaaagcgcatttatcccttttctaaaaaaatttggcttactagcctcaattattttgatattatatctcactagtgttgcaaagattctcaacactcactaatccttgatttaccgctatccaaccacaaaaaagtcctttatactactcttggatgacttatccaagaccaataaaaaggacgtaagcatggataagtataactcaaaaacaacctttcagaaatggatcgggcctttatggagctaggtcttcgccaagaaatcgggattgattcattgtgctgcagttcgctctctcgtaaaactgccgaaatcagtcaagaagttctaatggagatttttacccagttggttcgaaaagtatccgaacaacggccaagttcaaaaacaaccagtcttcaactcgttgattcaaccacgattccactgaataaaacgcgatttctatgggcaacgtttcagaaaacaaaagcaggcatcaagcttcatttgaacctctgttatctggataaaaacaatcagtatccagaaaggttttcgatcaccaacaccgaagaacatgacctgaatcacttcgaatggttagtggacaaaacggaagcgacctatgtggtggatcgtggttattttgattatcgcctgttggatcgtttgcacaatgatagctatttctttgtgacacggacaaaatccaatacgacgatcaccgtcttagaacaaattgaactcgtgaatcgaaaaacaacagacggttagattatcagtgatcaacacgtcattttaggcggcggaaacaatcgcatcacagaatgatttcgtcttgtgaccgttttgacgaaaagtcaacgtctcttgcgaatcgttaccaatcgttttgatgtttcgccaaatgaagtcaccgacatgtatcaagcacgctggcagatcgagctgttcttcaaacatttaaaacagaatttgacgatcaagcagctgtattcacgaagcgaacaaggtgtgatcaaccaagtgattcttacactgattgcgacgctattgacctaatttgtaaagatcgaattgaattcgacagcgacactcttccagttgaagcgctcctttcattacctacgttttgaatctgcggaatttgggtgaaacgacacaaatccggctgattttaaacaagtggattatcgacgctgttaggattcagatgaatatgcaccaaaaattctggaaaaagtcatcctttgcgtaagcattcgactttttggaaatttttagcaagaaatagttttcagattattatgactatatctgcgcaacattagtgataaaaaatataagaagatatctaattaacaactacatcaaaaatttaaatattttcctttttttattcatcaaatattactccttgaagaatatatatcaggaaaatttccaatctcaaaatctactgctggtatatgagagtcaaccagattttatattaatttatccaatacagatatattttaacttttgtattttcttctgattactaaagaattaatacccattttctgattgaattaattctagtctaatccattacttatgtttactttatctacgaagtccgtttttttcaacggaactaaagccgctatatttctcatataaaaagctggatcactctttgatctgattgaactgaagttggtttgtctcgtagtgaatagtctggctgaacctctattatcttccatcttaccaacgtattgaaaataacttatacctctttaagtagaccattcatattggcatcatttttcactggtctttccataaaaataagttattagccgttctactatggcattattctgatagatgtaaaaactccctttgtatagcacaatgtactatacaaagggagttagcttgcatcgaagctttttatattatttcgctaatcgagcaacacgcataacatcacgagcaatgattacttcctcatctgtcggaataaccataactttgactttgctatcagcagattcaagcgataaagcattgtcttgattcttactttcatcaattttaacacctaaataagttagagaatcgcacaccattttgcgaactcttgctgagtgttcacctacaccagcagtaaaaacaagagtatctagaccatttaaatcagcagcataggcgccgatataatgaatgatttgatgagcaaacacatctaacgcaagctgtgcgcgagaattacctgaagatgcggcttcttcaatatcacgacaatcatttgaaattcctgaaagacctaacaatccagatttcttattaagcaagtctttgattccttgcgcatctaatccttctttttcttggataaagggaataatctgaggatcgatatctcctgttcgtgttcccatcactaagccactcaatggcgtgaaacccattgatgtattgatcgattttccttcaagaattgcagctatgcttgcaccactaccgatatgacaagtaatcattttatgagtagccggattcaatgaaattgctttttctgaaacatattgatgactgggaccatggaaaccataacgccgaatcccatactcctcatagtatctataaggcaatgcgtacatataattcttttctggaatcgtatggtggaaagatgtatcaaaaatagctacttgtttagcagtaggtaaaactttttcaaacgactgaataccaattaaattaactgggttatgcagcggtgataacgtacttaattcatcgatatgtgcttcgacagtttcatcaatcagggtagcatcttgataatatgtgcctccatgagagattctatgtcccacacctgcaatctcatcataagatttaataatttcctgtttgattaatgtatccaatacaagttggactgcttgttgatgatctttaatcgttgtcgtacgtgaatttttttcaccagcatatttaaaactgaaaacagcatcgactgacccgattctttctacgattccttcagtgataacagtttcttctggcataataaatagtttgaatttcaaggaagaactccccgaattaattgccataattttggtcataatttctttttcctttcaatccgcttagaataatgcatgtacaaaacatgctataaatgctccggcaatcggtcccaaaataggtacccatgcataatccatgtgggcttctcccttattgggaatcggtaaaatcgcataggctagtcgaggactaaagtcgcgggccggattcaaagcgtagcctgtcgttgagcctaatgctaagcccaccgaggtaatcaccatcccgacgatcaacggttttaaccccactgtaaattcacctaaattcaacaaaacatacacaaagaagaaagttgcgattaattcactgataaagttccagctctttttcccagatactttgggaccagtggcaaaaatacctacatgattcccttcttcctctgttttcgtcattttgaaatgtggataatagtgaatcgcaataactacggctcctagaaaagcacctaaaaattgtgcaattaggtatccaacaacttttgttttggcaaataaattaaacgatgcaaaagatagtgtaactgcaggattcagatgtccctcagctccaaaagcgcctgctacatagacaccaaacataactgcaagcccccaaccgaaactgatatataaccaatcagctccttttgcatacgcattttttaaattgacactggcgcttaaaccgattccgagtacaaccaaaaccattgtccctataaattcgcccaaatattcttccataaatataatcattcctttcgcgattccgctcaaggcacaacaccgaatgaaaaagtgttgtgttcctagcggaacctatttctcttgtagtaaacttttcttgaagaagcctgtatacactacaaatcacggggaggtgagtaagtgcgaagacacacttttcgaccttgtataaatatatgtgtagcttggcttttcaagcacaactaactgtgacaaagagcacgtaaacttatttttggataagcgactcgtttgtgtagagcctcgcagtccctatacagttcttcttctaaaatctatgaagggagtttctcacgatgttaaaaatcgtgtacccaaattgttgtggcatcgatgtccacaaacagttcgttatcgctgtgatcgcaatcactgacagcgaagggattactcaatacaagcgccgtcgcttttcaacgtttacgaacgggttgaaagagctgaaaaaatggcttgagttccactcttgttttcatgtttgtttagagtcaactgggaaatattggattcctatctataacgtccttgaggacgaaatggacatctgtttagctcacccaaagtacgtcaaggcaattcgagggaaaaaaacagacaagaaagacgcccaatggattgcggacttatacaaacatgacttagttgcaggaagctttattcctcctgcgaaaattcgtcagctgcgggacttgtttcgctatcgaatgaaattaacataccttcaaaccagtgaaaaaaatagatatcagaacagtctcacttggtcaaatctccaaattgcgagtgtggtttccgacgtatttggaaaatcagctcaaaagatcattcaaagtgtactggataatccagaggagaaaccggatattgcttcgcttatccatcgtcgtatgaaagcctctgttgatgagttagaactctcgatggatggcgagctatctgaggaacaagcagaaaaactgcatgtgatcaaagctcactatgacgcgattaccctatgcaaaaatgatctcgaagagatgattactgaattaggtaaagaatactctcaccaacaagagttgattcaatccgtttctggatttaaaaacccgttaacagcgctacgtgtcatttcagaaatcggtatcgatatgaaccaattccctactgctggtcatctttgttcttgggcgggagtcgttcctgccaataacgaaagtgctggtaaaaagtattcgactcggatatctaaaggtggtcgctatctcaaacctttgcttgttgaagtagcgaatgccgtggtgaaatctgaaaaaaatcccgaacatcgaaacaaatatctacaacttaaaaagcgtagagggcacaagaaagcaataattgcgattgctcgtcggttacttgtggcaatctatcatattctcaaaaaagatgaggtatacaaccccgctctttatcactatcaagaatatgtcgctccaaataaaaaactgtcaattcaagaagcagttcaatttgcaaaaagccacgggtttcaagttgtttaatttggtatagaccgataaataaccgttgaacctcttatttttgtgcggtcttttttctgtaacttagtaaacgaattaatccgtatttttttcaaacttacactccttattcttaattccttattccatttaatgtattccactaaaaaatgacccacttgacagggttatcattattcaccgctgtttcatgagtcacacattcgttgtctcttgaatcaaagattagggactacttaatgatttttataattaattgtttcaattcatcatctgttggtactatcggatttcctgggaaggttccatcttcttttgcatgactgacaatccaatcgatattttcaagaacatctttttcctttataccaaaatctttcaaagtttttggacaattcatttcacgcatcattgcaaagatatgtttttgcaatcgtttgatcaataaattatcacttaacgttggtgagcctaagtgcgctttaacgattgcttttccgtatttttctgcaactgttttgtcctgaccattgaaagcgacgatatgtggtaagagcatcgcattagcaagaccatgaggaacatggaatttagcacctagttgatgcgccaacgaatgacagattcctagaccagccgtgttgaaagctaaaccggcagcacaagaagcttcatgaatcatttgtctagttttaacatcgtcgccaaattgataagctgaaactaattgattcgcaatcgtatcgatcgctttttcagctaacgcatcggtgaaaagattcgcatctttagcaactaatgattctaacgcatgggtcaatacatctaaccctgaaaaagctgttacacttttaggtgcactcataactaatgtcggttctaaaatggcaatatcaggaatcaaatgatctctgataatcgggaactttactcctttttttgtatcagatacaacagcagtattcgtaacctcagagcctgttccgctagttgtagggatggcaataaaagactccagtgattgatcaaccaatttttcaccaaagaaacggatggctttggctgtgtcaatcgcagatccaccaccaattccgatcataatcgcaggttttatcgtctcaaaaacggctacccccgccatgatattttcaagcggtggatcaggttttacatcagaaaataaagttacgctgttggaagatgctaaatgactttgaatattttttagactatcactctctggtaaaaatgagtcacaaaccatcagaatatgactattttgaattgtatctagaaccgataaactatcggtcccagaataaatttttgtaggaatgatcaattgttccatcttaatctctccaaactctcattgaaaatccttcaggtgagtttagccgacggcggcgagtaaatgttttcgcagtagtagttccttcacctgttggtgttgaaattgttaaggcagatgcccccgtaaagccaacaccagttccagaataagttggtccattaacaacaaaaattgatgtattgattcgatgtgcggctttattgatgtttggtaaatattcagaatggattgaagcagtgtggtggttgccaccttcaacttctactgcgatggctaacatatcgtcaaagtcacgagcagatacaactggaacgattggcatcaacatttctttgactaccaaaggatgatctttagaagcttccaaaataattaatttcggttttccagtataactgatatgagcttcgtctaaaatgaatgaagcatctttaccaataaatttacggctaggtgttccattttcacgtaacgtgattgtagcaagtgtttcaatgtctttaggatctgtaactaagaaggctccttcttgttgcatcaaacgaattaattcatctttaatgctattaacagcaacaatttccttttcagcagtacataaaatattattatcgaatgctgcagaatcaacaatattgtgagcagcaagagcaatatttgctgtttcatctaccatggctggaggatttccggcaccggcaccaattgcttttttaccactagtcatcgcttgatgaacgacaccgggacctcctgttacaactaatgcagcgatatctggatgtttcatcatttcttgggctgcttcgattgaaggtgtttcaatcgtgaccactaagttttctaatttaaccgcatcatagataaattcattaattttttcgacagcccaacgagaaatgactttggctcctgggtgaacactaaagtagacagtatttccgccagctaacatcataattgcattagcaataactgtttcaactggattagtacttggggtaacagcaccaagtactccaaaaggagcgtattcatacatgattaagccaccatcaccagtttgaacttcaggtgttaagtcttctgttccaggtgtattgtataaagcattttgtaatttttgaactttggcttctttagttcccatcccagtttctttgacgatttcttctgcaatatagtctaatgaatctgcaaagcctgctttaattgcttctacaactttgttgcgggtttcaattgaacagtccacatatacttcttgagctgctttagcagccgcaactgcatcgttgactgttgtaaaaatccctttatttccacgagttgaaacagatgttactgcacctttacccatttcttctgctaaaatttttctgatttgttcttctaatgatgtcattattattctccttttaagaaggctgccactgcagtctcacaaattaattgatcttctgatactaaaccaccgctgacaccgattgcccctataatttttcctttgaaatcaatcggaatgcccccagcaaatgtcaccaatttgccatctagcattgtttctatttgataaagctcgccacctggttcagtatctttgtttaaatctttggttggtgcttgcatcaacaaagcagaatttgcttttttgggtgccaaagtcaaactgactaatttagcctcagccatccgataaaggattctaggattaccagccagatcactgatacaaatcgttaccggaacattgatctcttgcgccttattttctgcaatatcgatggttttctgcagattttttttagaaaaaagtgcttctgcttgcactgtgagaacagctttttcgatcatttcttctaaattattcattttgttcacctacttggttgagataacgtttgacgatttcatcgacttgtttttcttccttgtcaaaatggtcttcatcacgagcaatgatgtacaaacaatcagagagacgatttacatattttaaaagttctgggcgaatcgttatttccgcttcttcagatagacgaacgagcattcgttccccgcgtcgacaaaccgttcgagctaaatgtagatgcgctcccgcaacgctagtccctggcaaaataaacgaagtaatcttaggtaatttttcagtataacggtcgataacatcttccaaactgaaaatatcttcctcagaaatttgttcacttttaccgtagaatttatcagtatccgcagtcgcaatctctccagctagctgaaacattttatattggattttttctaatagttgaatgttttcactgcgtcgacaaaattttgctgctacactgataaacgcgttgcattcatcgaatgtcccataagtatccactcgatcagaatacttttttacacgttttccatcgaataaacttgtgcttcctttatcgcccgtttttgtatagatagccatactcacacatccttacttattaaagcgatcgataatccctacaattgcgcaatcgacaacatcacgtgtgccagttgcttcacgctgggtcttacgagcgccagctccctttactaataagacatattcacctacacctgctccaacagtatccgcagcgacttcttcgtaacgaatttcttcttgattgctattgacctgttggacgatcattaattttcgtcctataagtgaagcatccttttgactcgcttcaatcgagccaactactttccccatatacatgcttcatcgatcctttcttgtattttgatttttttccgttgaataagttcaaaagcttcagccgttactttttgctgatttgtcttaactagtagcgacccctcttccagtaataacaaatcttcacgcttgattgtcttttttttacaagcgacaactgttttccctgctacatgaaaatcaattggccattgagtcaacattttccatggaacaaaggcaagtgtctgctcgctgaggtcaaagacaaattgaacttgataggagattccggtcaagagccaatcaatccacggttctttttcaaaataataaaggtcatgaatcagctgaatagggacttggatcaatccgatataatgataatcaaaaaagactcgcttatctggaacaggtgttggcctaaaattttcctgacaaagcagatttagccgagctttttcccttctagtgagacgctcagtgattaaactgatgagtttttcttcatccatctataggcctcctaatcaaacattgcaatgccaaggggtgtgacaaattgaggataatcaggccttaatatagaatgtcccattactttactgaaggtcggaacgaaatcttcaaaattcgtcgcgccaccaactaagaaaattggtgtcacttgattgagaggtacatattgtttagcaatactagccattttttcgacaacgggccgaatgattccaaagatttccttttcatctttcgcctcacgtttcaaaacttcagcttcgctcacaggaatttttttagccccggacagtactagtgacatatgataaccaccagtcggttcatcaaaaacggtgatttcctcagcctttttgaaattactgataccagtagtcccaccgccgatatcaacaacactgccttcttccagttgcaagaaacgagcagctgcagtcggttcatcaataattgttttagctataaatcctgcatcgttgatgacatttgcgaccactttttcagcattttcaccagtacctggcgggatagctccgctggcagagaacaattcaacgcctaattgttcttccgcttgctttttcaattcttttacaatcttgactgattcaatataattaacaacaataccgtcacgaacgacatcggcatattggaacgctccgtataaaggaacatcatcttgatctaaaacagccaagacaattgatgaagtccccagatcgatccccacttttaattgttcctttgatgaaaccggtcgagcaatttgttgctttttcacaagttcagcaaactgtctcaaaattttgtttgactgttttaaatccatcagaaagctccttaatcttttactaaacgacccacggttcctttaccaacatttgccgcattggcttcatcggtatcaatatgcatttctaaaacaaatttaggatcaggacgaacgacaacatcatcgtaaattgtttttcgttgttctgtttcaatctctactttaacaagatcgccttttttaacaccgaagttttcagcatctttatcactcatatgaatatgacgttttgcggcaatagcgccttgaatttcaacttgtccatcaggagtcttaaccgtgattactggtgttccgactaaatcacctgacattctgattggtacaggtacgccaatttgacgtgcttcagtctttgccaattcaacttgtgagtgtgcacggcaagggcctaagacgcgtacccgttcgatcattcctttagggcccacaaccgtaactgtttgatttgaggcaaattcacctggctgttttaaaggggctttgacagtcatttcctgtcctgggaagagaacagcaaagtcttctttagtcaaatggatatggtgattggaaacgccaattggaataactggttggctttcttctgcaataattttatgaatcagtgttcttaactcttcttccttcatttcattcatcctatctttgtattacaacttagtttttctttggtaagatcccttcaacatctgtatgtggacgaggaattacgtatgatgcataaacatcgccaactgtttcagcagcactagcacccgcatcaactgccgctttaactgcaccaacatcaccacgaaccatgacagtcactaagccggaaccaattttttcagtacctactaaactgacattggccgctttgaccattgcatctgctgcttcaatagctgctactaaaccttttgtttcaatcattcctaatgcgttattcataatatattcctccgattaatctttatttttcaattcttcataatgaatacaaactttccgaggctcaccctttttgcgtgggcaagcaggatctttgcatagattacaagtataatgacctgttttttctactatttctatatcttgttcaacaattggttcttcggcaacaattggttcttcaatgactggatcctttaacagctctggctcagtactagcatcaataccattttttagccagatagctgaaaggccatcagccattcttggaatgacccgtgctgcgaccaatttgtcttgttgttgagctattgatttaccagcctcaaccgccgcattaactgcaccgacatcaccgacaactttgatggataaccagcctgaccctttcgctctttcaatcccaatgattgaaacatttgccgtttttgccattacatcacttgtatttactgcgcaggcatagccaacgacttcaattagtcctaatgcttgattcaatcatttcacttcctttaatgctttaaacggaatcccttttactagacgagccgcatttgttcctagctttcttagctcttcatcggccgtatcaataataaaaagtggttcattttttggtaatttcttgtaatgcaggactgcttgacgtccatccattacgattccaacccctaatggtgaatttacagctaattcgtaagccgcctctaccaatgtcaactttgtcgtcacaacttcttcgtaaggaatcccttcttcttcaatccccaataaaatcggagctagagaagtatctgctactaatttagtaacaaaaattgttggcctcaccgtcatcgctattcctccttaagcttgttggcataagataaaatcaatccggtagccaccgcatttcttggtccttcaacgcctcgaatattccctcgacctgcgactaacgcataatgagatagggcatctgtgaccaattgtggaacctcaaaatctaatgccgagccccctacgataacaatgaacgggatatcacgaatattccccgttgggctaacatgagccaatgctctaagggcattggttacaaagacacgttctttcgctgtttgacgaaccagtttaattttttcgatacttaaatcaccatttaccggcacaaaaccatctggggtaatcacgacagttttagcaaagatgttggcaggcaaagctttgtcaaaaaactccactgttccatcttcatgccggatatagaataagctttctacttttgctaaaggatatttcttgatttcttcagctaaatagcgatcttccagtcccagttcagaattaataatcatcgtgaccatgtcgccggctccagctaaatgaatagctgtcgttttaccggtttgatcaatgatcgaggcatccgtcgaaccagctcctaggtctagaatcgccaatggtttattcgtccctgccgttgtcaatgcacctaaaatggccgcttctgcttcagctccaccaatttctacaggtatccccagttgtttttggatctcctcagcaattagcgccatctgtaaatgatctgatttcaccatggaagcaattcctactgcttgttcaagtgagaattctccagctaagccgcctttaacatttagcggtacgaatgtatcgatagccaataaatcctgaatacgaatatcttttaattgtttattcgttaattctgacattgttaggcggacacgttccaacatcccgccaatattcgttccagcctcgccagtaacattatcaatgttcttaaaagcagaaatgaccttcatgatcttttcagcacctgctgagattccaatagtctctgtccggccatccccttgtaagactaaattcccagcaggtatgacccgtgctttaacatcccccttaggtgtcttaataacaactgctgaacgattaccgattaatgcccgggacactggaacgatatttttggtttcgtctgaagacaagtcaaagactgttgcgattccataaggattagaaagttcagaaataacttgtccctgattagccacttcaaccgctgccagcatatttaaaggaactttttcaataaaagcaacttcatcaacgatcggaatttttttatggagacgattgtgaatcaatacgccatcatctttttgtaaaatagcggcactcacttgataaccatattcagcataaagattgatcagcttagccgcatcatcaaaatcgattgcttttggcactactacaatatatttccgctttttatcggtttccttaaaaagctccgtcaataaaatcgtataaccaatccctaacccctcgccaccaggcgttttagggtcatgcccaatcattgttgattctgtaatgatcgtttctgtaattgtttccattgctacatccccaataacaggagtagcttcgttgatccgaatcaaatctatttgttctttagcaaaattagctttagctaaaactgtttgaatcgacttttgaattccaattaaatttcttttcgtccccttgattccggttgtttcagcaattgctgaggcgatgaatgtaacatcaccgttgtctgaaacatctgctaatgctacttccgttgaggaattaccgatatcgacgcctatgacttttttcataataagcctcctcgtctagttatcccctttaagtttcttacgtgtttcataatattctgctgcttcccgcacaaaatctgcggtaatctttgcattgtatttcgtttctaattcatctgccattgctaaaagctccacttttgaagaacggtaaggtcgtaattcaccatacatttctaatagacgttcatcaggaatcgctgttaattcagcagctcgtttgaagttttcttgtaatgcgtctcgtccagcatcactggcaatttggccttgatacttcaaagtttcccgtgtaatacgtaaatcttttccgtctacttcaccagctaaaactttatccagggtaatctcattaattcctttgccactaggtgaacgtacgatgtcaggatgtttttcaaataatggataatcactgcgcttcatttcagtttgaggagtcgacgcaacagttgctgtttgttgtgtactttcttcagctgccatctgcgcgctgattcgtttgattaattcatctatttcagccattttttcccctcctatgcttttgtgaaatcaatttgaatttcttcagcaggttttccgattataacgtattttgtttctttgatatgcatcagagccgatttcgcttggtaagcaacccgagacatttgatcactaaccgtaggaacgggatcaggggattcacctttagcatattttgcggcatttttgccgattgctcgataggtatctaaagtcaaagttggtgcttgtgggaataattcaagatttgatagtggttccaaatctttttgatgaatgattgttgttcccttcgattgaatagcaattgcgattccagagcctgaaagcttatcaccttcagcacctgcaaaagaaacatcggctgtacgataaactttgattactcgagcctgtaagccttcttcttcgatccctgcaatcatttgacgtaaaatttctttatgaggaatccctaaaagattctctcccatcgcttcagcaaaaccaggtgcaaccgcgatgactacttcatcttgagcgactcccggttgagctataccaatatgtttaaaccatgctagttctttaatcgctgtgggcacattttgttttttttcaatggctggttgtccttcattagctgtaggagcttccacgatactctctttgaaggtcactggtttgtcatccaatggcatttcttttaaaacatctcgaataattgagcgtaatagcgattcattgatcgttgtttctgacatttgcttctcccttctgtcccagttaaatagaacgaggatccatggccattgggatattcttaacttgctcccatttttctcctgatagacgatagccgctacctggacccatataatcattgctgtcattaaccgctgacacaacatgccaattgttatcaaaaattgcagatgtttgtaagaaatcaccggcaaccctttgttttaacagactcaacacttcctcagccacatccataaaaccaccttcggctaaggctttgacgatatctgccccattcagcttgcgatctaataattcttgtgccgctttcatatcctcgactaagttacgagcaggcatatctttagaaccatgggcatatgtcgcagcttcaacttcttcatccgtaatttttggcaatcctaggccttcaaaaacagcttgaatagcacgagcagctttactacggatcttgataacttcttcttctgtgactggacgaagcccaccgtcaacttttaggtcacgttgaaagactaaataatcatcgacgtcttcaatatcggtattagaaccagcaaacatgttgtcataattaggtactgccgaatatccacaagaaataatgtcggtccctggtaaaaattgacacattaatttttcggtccgacgcatatctgaatgagaaaatgcttggtcatttcctgaagcaacttctaagtccatcatgacgcagatcaaattttctgctaaaaccgcccggataccagagggtacgctgccgggaattccaatacaacttacggcaccgttttgtaggccttgaacaccactggcttttgtgatgaaaatacaacgggcttctaaataaagcattgattttccttcagcataacccatcataacttcggaaccagagccggaagtaaaacgcattttcaagccgcgagaagcataacaggaagctaagaatccttttgaccacggtgtatcgtctccatcagtaaagactggctcagtcccatacacagaaattgtttctgcataggatgtaaaacctcgcatccctaaatcaagttcaagagcttcttctacggaacattgagtcaagacgcctgggcgaccaacttgtgaaccaaccatgattgaaatcgcattgaatggtgcgtaacgggcaaccgcaacggtcgtttcttgttctgcaaagccccgcaatgctccttctgccgcatccgcagcaatctgaactggattatcgcgtaagtttgtcacgtgtgattgagtcgcaacactacgacgtggatgcattttttgcatcgccatcatcatttcaacaacattcatttggctgacgacatcaaccactttggccggcgtcatagataatgttaatttcacgatatcttcacgagcgacattgggattacataacatattggctaattcgactgaatccattgccaaaacgcgttcagcaccttctttgtcgatcccatgttccgcgatatatagatcaatcaaatcaaaatcttcacgtttctttccatcaagttctgtaatcacaccgttttccactttgatactaggctttggatcatttgggctttccattgcaataaacccttcatcgatccattctttaacaaagccatcttgatggattggccgttgttcaagtacctcaaaacgtttagaacgtttcatcatttctcctcctaactaacaggcaacacgcgatcaattaaatatatgaaggaaaatcattgatcggttcgctgcctaacgtgtttaatagatcgataccgacttcacgagccgcgatgacagcttgacgaaccgcccctgagtcgcctttaatatgaatcgttacttcatttgaatatttttgtccatgattaggtgaagcataggaaataacttcgacattcgctgctttgacagctgtgtcagccataaccacaccaattgccgcaggtgccgcagcaattaagccgtaagacttcccaacttcagcgccgaaagcttcagctaaagcgaaactagcacgagctgaatattgcaattcgatatgtccggcttcattattgtaaacatcaccaaatgtccgttctgtttcttttaatgtcacttcaactgctcgacgtacatccgaaacatcttctccgccaaaaataatcaatacaccgtgaccaccgccacctttagtatcacgaggtaattcaacactgacgatctctgtattggttgctttcactgcttcatcagcagctgtgatttgcggaccagcaccagaacgcgctcctacaattcctaatgaacggtaattcttttttagtttcattgcttcagctagatgactgtctacattagcaatgactaaaccaatcgtatctccgactggggcagtacctacaaactctgttaaagaacttacttttttatccacagaagtttcctcctttttattgactaaatcggaagaattagtagatacgatcaaacgttccataattttattgactaactcttcttccataatcatgtctattcacttacgctttctggtaaaagtccttcaacatccgtatgaggacgaggaatcacgtaatttgaaacgacttcaccgatattttcagctgctgcgacacccgcatccacggctgctttgacagcgccaacatcaccacgtaccatgacagtaattagtccttgaccaatcttctcttggccaactaatgtaacgtttgctgctttgaccattgcatccgcagcttcaatagatgcgactaaaccacgtgtttcaattaaacctaatgcttcttgttgcattgtattgcctcctaaaagatattttttaacaacccgagtataagaaaaaaaactatgacatattagccatagcttttttgtgatctttttcttattttggaaaaaaatgatgattttgctaaaaatcagccttcgtttatgacaaacaattaaataaaccctttgttataaatacttcacaaagaattcgataatgtgtataataagaacttgtaacacgatttagcttattcaaaagcaaatttatatgattccgactgaaagaagggtactctaaattggaagagtattatcaatatcttgaatctaatcaaaaaatcttagataaaattttaagtgatttcactaaagcaactggtttggcaacgatcttggttgatacccatggtatggaacttaccgcaagctatggtttttcacctttttgtcaattgatgcgtaataatgaggaaacacgccatctctgccaaacttgcgatatgtttggaggacgcagttccattaaaaataatgtgacaacaccttatatttgccatgctggtttagttgatttttcttacccagtaaccattgatggacaagtcgttggctttatcctgtgtggacaaacgcgaatcgaaaacaaagacggctttcatcccatcatcaaggaaacgactgactggaaagatgatccaatttttgtcgaagcttatgaaaacatgccgattacaacccctgagaaaattcgttcaggtagtgaattgctaacgattatcgttaactactacctttcggatatcatgagcaaacatctggttattcaacaaccaactcaactgatcaaccaaatcgattattctgaaaaagaacttgctgaggctcgcatgaatcacgaacaaattccttttacttatcatgaatctcaggaaaacgcagcagactctgctcaagtaaaagtaaaaaataaaattagccgaccagaagttattgaagcgctagaatatatcaatcatcacttaaatgaagtaatcacgctagatgaagttgccgaccatgtctatctgtcaggctattacttcggtaagctttttaaaaaagaagtcggtatgaacttcgtcgattatatcaatgagaaaaaaatcaatcgttcgatgatcttgttacaggattccacttggtcgattgatagtatcgcccacagcttaggtttctctcaatcgagttacttcagcaaattgttcaaaagagttaccaaactctctccccgtgagtatcgtcaaagaattcaaaaagaagcactccgaaaataaatcggagtgtttctttttcacataaaaatgtgcagcaaacacgccgatctttttcttcccgaaaagatcatgcgatgaagtatcctggctttgcttcttccgccacaggtccttccaacaatagttgccgtggttacctgttttgtccacaatacagttgcgggtacagtatcagattctcactgatttccttcattctattcaattattaattaccgtccacgaaaataaagcaggcgaatgattacttttagataatcaaaaatttccaacatattttctgaagtaaaaccaaaataaggcaaaagaacttcattttcttcaatcgttgtgttagtttgagttttaatgaccatcgttggaattctacgtttcgttaataattggcgaaatgtcgtgtacttctctggaataataaagtaatcaacttgtttcaaattcgtttcaaaatcagtcagctctataatggcctgcagttgattcatcactctcacgtgacgcgtaaaagccaaacatgcaaaactcaaaccattacctacactagcaattggctccagtaaatcaggtttattcaataaacgactaatcgtttgaatacatttctctgtttctcgatccagcatcttgacaatttcatcactggcaccagtcaatgcttgattctgataagaaataccctcttctcctaccaaaagatctaggttttttttatcagaaagaatcaagtattcataattgagccattttttatctagtccctcataggagaaactactgatctgcccaatttttccaccactaatctcaaatggacggccttgagcattgtaaaaggtcatccctaactcttcgaacatacctaaccctaggtctgtagcaatactgtaagtattcataaaaacaatttttttcgtttctaaacgtacaatttttttcaaaacagtcccgataatattactgttggaaatcaatggtgactttgcaatcgttggtacgatagtaggacccaataacgacgctatatccaaaaaaagagtctccttatctttcgaatagccataccttggattaatcgaaaaaccaaacagcccatcttcctgtaacgtttttattggctgttgataatatttaagaatcattttcagtggatccttgtggtcaacgaaaggaaatgaacgcgcttcagctttactcttatcttcaactaagtactcattgaatttttttacaatattttcatctatctttgtttcatctaaaattggtgcaatggcaaacacttctgtcataattatcacccactgatagtataccaaaaaaagttgtgataatttagctattgactagttcattttggccaaatcaaagacaattttgtcattttctttcaccttaacttcttttgcccctttcatgatctctttgtcgttaattttaaaagtccaatactttttggcgttctcatcttgtgtatgtccttcaattttagttataaaaccatcctgatcctcgatcgcaaaattcttatccattacatcatataacgttgcacccttttcaaagttgattgtttttttagagagttcctttccatcctcttgtagcttaaccgttgctttttgttcagtcttttgactgactgaagtttcttgggatgttgcggtttcatttttttgacagccggtgaaacctaccaagcttactaatagtgctgctaaaatcattgtttttttcattttattcttctcctaaaattaatccatattttattttgatatgttgtaatttttctaacattggtttggctaaaacagccagaaagatcaccgttgagatcgcatgaatcaaatccatcggtgcaccggaaataaagaccgcaattaaggcttccttgctgatcacaggtgtgaacatcagtaatgaggcggggttcataattagtccatagatcaggaaaatactaaaaaagccaaatagacataaggacaagcgattggctcgcaataaaccgcaacggtaaaagactccggccacaaagccaatcatgccaaaagcaaacatctgccatggcgtccaaggcccttgactaaaaaagatatttgagactaacgccgtcccactgccaactaaaaaaccgacttctggtccaaaagaaacagcactgataattactaacgctgccactggcttaaattggggcaacatgaaaaatgcaccacgtccagcaacacctaatcctattagaactgaaataatgatcagttctcgtgcctgtgtcttacgcccttcaaagatcagtaggaaaggagccattgccaaaaagatcaataacagactaacttttaaatagctgcgatccccactttttaatccgtaataaatcactaacggcatgcatagaaaaatagctactaaactgagtttagttcgtcgtgagagtttttttgcttcaacctcttgattccatattggcaagtttggtgaattctcactttttttaggtaatggcttctggtaattatcatctcgatagaagtgccttaagaagtctgattttttttgagacattcaatcacctccttaaccgtcactgcgttaggaaaatagcctcgagccattcgattagccgcagtagtataaaaattattgcccgcaaaaaattcccgtgccggtttggtggtgacgatggaaccatcaaaaaataagccacacagatcactgaattccgcgacaaattcaacatcatgagaaaccatcaagatcgtcacaccttgctcttttagtttcaatagaatttcacctaattcttctttaaaaaaatcatccagtcccttggtaggctcgtcaagcaataaaattttaggacgtagtaacaggactttcgccaaagctagccgttgctgttcgccaccactgaggtcataaggatgtttcattaataactcttctaagtgaaccagctcgacaattcccgcaatagcagattccttactcatattcaaaggataggccgctgttttttttgcttgtttcccgtcaatgatctcataaagatcttccagcacagtcttcttaacaaaaaggctttggggattctggggtaatacacctagaaattgatgataaagttcattatcagaaaatttatttaagggtttgccctttaactttattttcccacggtatggctgtcgaatccgactgattaaagataatgcggtacttttccctgtaccatttcccccgacaatgctataaaaacaccccgccggaacacttaaggacaagtctttgatgacatccggcgcatctcgatcataacgaaaccacaggtccttgacttcaatcattgtcgctgtttcagttatattttcttcagggaatgattctgctgacttatttgcccgaccctccagccaactgcgaccttctccaacagtcagcggatagtcagagccagcatcgcaactgccatatattttcattggagcaggcatcgcgataaaaaggtcatttttagtctcttttaatgctttccctactgttctaggttctccactaatcactatgcgccctttctccatcatgaagacctgatcagccattggtaaaacttcttgcaatcgatgctcagagattaagacggttgtcccaatctctcgattgatctttgctaccgtttctaaaaagttggtagcggcgattggatctaattgcgaagttggttcatctaaaatcaatagtttcggatgtaaagccatgatactagctaagttcaataattgtttttggccgccagaaagttcattgatattttttaaaaaccatgattggatgccgaaataagaagccatctcagcaacccgcagacgaatggtcgcttgatcgaggcctagaccttctagtccaaatgccagttcgtgccaaactttatctgttacaatttgattatctggattttgcatgacaaagccaatctcttcactttgctctcgaagagttaattcggttaatggtcgatgatcaaatttaattaaaccggtcatctctccaaacggacttaaggcaggctttaattgtcttagtaacgttgtttttccgctaccacttttcccaaatagaacattgaagctcccagctaccagttcaaaagtaacatcatccagacgtttttctgaagactctggataagcaaaacttactttatctacacttaaaattcccattttcttactccttctgtccaatttggttgaaataatttggtagtgtggtcgcttgatttaccttaatacgcgaccatttataagcatcccatgcgcgcaagaacagcggtagagaaactaacaaaaagaaactcaaggttccaattccacttgaccaattcaaaggccaaccgtgtatgataatctgaggattgtaactcacatagagcgcctgattagcaaaattccacaaacagcctagcgaagttaacaacaaatatcccaagatgatcccgtctcgcaaatcaaaacgatacagtgaaaaagccgtgcgcatctttagtccatatcctcgtgctttcatagagtcagctgtttcaatcgcattttccaacgcccaagtgaccatgattgaaaaaattttaaaggctcgacggatcttctcgatgaagttgccgttactaagatcccgtccaatacttttttgaccgttccgaacgatggccaattgttgcgtaaatttaggtacgaaacgaaatgccattgataaaatcaacgagctggctggaatgagcttcccaaaaagataaatgaatttgtcactagtcatcacttgattgtaacaagtaaaccaattaatcgtgttagcaaaaaccagcgctagagccaaaccaatgataattgcttccaaagtaatcgcatttccattttccatccgataaagttgggtaacaccgtaatgattgaaagctgggttgactactgccactactaacattcctggaataataaatttcaactgaaatagcaagctttttttaactccaactaatagggaactataactgagcgcacctaaaaaagagagtgctaaaatgtatgggtgcagtgaaaacatgcttattccaatcacaagcagaaaatatataaaattattcaatggatgaacttgtgaaaaaggatctctcatcgctgctcccccttatttttgattattaccaatatcatgtcctaaatcacaggtatattcccatttaatctcatcgccaggatgaagatctttgtactttgaacaaccataattagggaaccagccattaacttgatacatccagccagaaagatttccacaatcaaactcgtatagctgatgaataccagatacataataggcatcatacatcggagtccaccgtgattccatttgaatgcctctttctttagtggctcgaactaataagtcataaacactatcccctgatttcaagggaacttgagtcggcggcaagatccagccattgcttggaacatagggttgtttttcttttactaaatccgaccaattcgccaagatagttctagctgatattgaaaaagtaacggtcgactcagttgactgttgctctttttttgttttgtcaccaaccacttgtgtctgattagtggcttgtccagtcggattttgcgcatttgtctctgcaggattttctgtatcagcagtagtgactgaattttcggtcgcttgttcgtcattgttatctatcgcttgatcaggagttgctttctgttgctgattagcttcctgcttgctttgatcatttgaaagagcttggttttctgtttccccttcggtagtagcctgttcttgggttgaacccccggcaacgatataataatctacgcctgcttccaacaccctaagacgcaagagcgtttgattgtccatattttctattgtaataggacttcctttgacttttttcaaacttcctttgatatcgctgactattgttcagaatcaatgaataaggtatcctgactccgcttcattctctatctgctcttcccaagtcaaaaacttagtgagtcatctcagatatcgtccacgttacagtagataggggctgttgaagaattgcacttcattccctttctccattgattagtattcaattatatttgattttaggtgcgagtaataccacagattaccgtgaagttgaggatcttttccaatcctctgagcgctgcgttcaacccttcttcaactgaaccaacatccccagtaatcacaacggaaccagaaaagcgatcaataaaacctatttcaacattaccgcttttggttgcaatatccacggcaatgatcgctgcctcgctaggcgtaatcgtcataatccccaaagcatcgccttgattatcctgtaaccctagtttggtgtataggttgtgatctggactagcaatgacatgagccatcgtaacttgttttcctggaacatattcttgaatcatccgttttgtttcttccatggttctactccctctctaaaaaacttcgtaattcttctaatccagcctgattgacagaggaagcataaaagattttttctgctccagctgcttctaattgctgacgtatctgttcgatttgctcatcattttgtgccaaatccgtcttactaacaatccctacgacttgtttcggaaacattgatgcaaaccctggtgaaaatacttgttcaagttccgtaacactttgaacgatacaaaccacctcagcatctgcggctgagacagaaagtgcactataatactgacgatgcaaaataaattctccgggtgtatcaatcatatctggataataagaaaccgcttgagttttgttataactcaatgcttctcccttcaacgcttgacataaagttgttttcccacatcctacggcgcccatcaagataatttttctcatctattccctccaaactgaataagcctctcatcttcttaacttttcaaatcatagcatttttttgaaataatattacttagtcaaatgaagtcgactaaatcctattagaaattcactgaaaaccatgatgattcaatcaattaaactatattgccattttttaatatctaaagtagtagcactattaagttaaaaaagtacaattctgctttaaatcgttgaatcaaaaccacccgtgtgaacgggtggtttgctctgcgactgaaagcctctgccctgttaccggccatagcctaaaaggcttactgaaagatctccctctcgcaccacttttactcgctgattctaaaagaatctctttctacttcttcttgtttttctttcctgtgaacggatcatattcttcaaacaatgtgatttgatctgctacataatcttcttgtgcttgattacgaatatattctgctatctgctccttgtttcttcctatcgtatccacgaaatatcccttacaccaaaattttcgatttccgtatcgatagttcaactctgcatatcgatcaaaaatcatcaagctacttttacctttcaactatccgataaattgtgccacgcttagttttgggagaatacttactaaaagatgaatgtgatctttgcacgcattcgcttccaagatttgaatcggctacactagactagacagaaaaaataaggtgtgtagaataataaaaaacacactggaggatttttcatgtcaagaagtcaacgtagaacctattcaaaagatttcaaacaacaagtcgtcgatctctaccttgcaggtaaaccccgcgcagaaatcattcgagactatgagctgactgcttccgctttcgataaatgggtgaagcaggcacagtcgacaggctcgttcaaagaaaaagacaagctaacaccagaacaagtagagctgatggcacttcgaaagaaaaataagcagctcgaaatggagaacgatattttaaagcaagcggcgctgatattcggacgaaaagacaggtaattgatgccaacaagcacaaatactcgatatcagcgatgtgcgaaattctaaacatttctcgtcaaacctactattatcaagcacgacctgtcagaaatgagtctgagttagaagaagtcgtacaggaagaatttattcgtaaccgaaaagcctatggcactcggaaattgaagcaatgtttagcaaagcgtgaccttcaactcagccggcgtcgaatcggtcgaatcatgaaacgtcgtgggttgacatctacctatacgatcgctcattttaaaggcctgcgaaaagcctgtaatgaagcgaaaacagcgaatgtattagatcggacttttacacaaaaacagccattggaagccatcgttactgatcttacttatgttcgcgtggggaaaaagtggcattatatctacttaattatggatttatttaatcgagaaattatcggttattcgtgcggtgagaaaaaggatgccacattggtaaaagaagcctttggccggattcctcatttattaacggatgtcaaactttttcataccgatcgtggaaaggaatttgataatcaaaccattcatgagattttgaatggttttgagaccacgcgctcgctgagtaagaaaggctgtccctatgataatgccgttgcggaatctacctataaatctgtcaaagtcgaattcgtgcatcaatcccaatttgagacactggcacagctacgtctagaattgtttgattatgtccattggtggaactacctacgagtgcatggcacgttagggtatgaaacaccgattcagtttcgtcaacagagattggcgaagcggacccttgataatgagcacggatttgatacctctggagaggcagcgtaattgaatgagcacgcttctgccggaaagaatccgatccgaggaggctcattgtcaagggcaatcggagccataacaccaagagattcaccccaccttataatttttgtcaaaaaaagtgttgccattccaactttttctaaatatagtgaattccaatatatgatagcattagttactaatcctaatgcgttgagctgttcctccataccgtcgtaataagtttgataaagtttgccttttctaccataaaatatatttcgacatagagcatgacgagcttcacctttatttaactgttccgagctaggctctcctaaataaacaccaaaagaatttttattgcgcttaatttcattcattcaaaacctccaaagtaaattataagtagacttaaaatttatttttaaaaatgctatgataacagtaaaactacaagtaaattttacatgtaaattatatcattttttaaaaggagtttttatggcaaaaattggatatattagagtgtcttcacaagatcaaaatttagatcgacaattggcaatgatggaagaccttaacattgataaattattccaagaaaaagccagtggtaaagatatccagcgacctgagtttcaaaaattactaaattatatccgagaaggtgattgtgtcattgttgcatcactggatcgcctaggcagagattatgaagacataaaaaatacagttacctttatgaaacagaaaaaagtagcattaaaaatactagatgcacagtttttagattttaatactggaaatgaactcctagatactgctatgttcgatatgtttttatcattgctaagttatattgcacaaaacgaacgtgagaaaatccgtgaacgtcagcggcaaggagtattattggccaaaaaagctggtcgatataaggggcgaccaattgaatattctgagaactcaacagatccgcaaaaacgattagtctttaaaactgtggtggacatgttaaatcaaggagttccagttgcagaaattgccaaagaaaatggtctctctcgaccaaccatatataaaataaagaaagcgaatgatttgtagaatttatactacattcattcgcttttctaccgtgcattttcgtttctatgttccatgtaccccatattctctatgaaggagtttcaatgtcatattctttttcattagttctttatgaacatattcccagtctacaggaaggtaacctcgtgctgttgtttgtttttccggaaaaagatattcctgcagccaagtatcgctcatatcagcggttagttcagtcacccccttcctgtctgctcgagaagtaacttctcgaatcgtatgtctggagcttcccacagttgaactaatcgttcgttgagaaataccggaaaaataaagctccaaaatttttcgatagtgaaccaataaaataacatcctgtataagttgtcataccgaaaggtatgcctttctattatacagaaggttattcatctattaaatatgaaagtggagcagtttgttgccctggatggagctatctattgccttgagtggagcagttattcacctcactggagctatttatctgcaatactcaacttgtttaaattttttttcagtaactaataggagtcaatggcaatacgtacatccatgtattctaaagtggtacaaacaaggggattatccatcggttttctttcaaacgagcttagagttgccctgagccaactaataaatagcaaaacaagcgaaccgagagaaggcttcgcttgtttctgatcaattctgtttaattttatctaggatcacttcaaatgtttcaaaggtatctatatctaactggcacagccaaagtaagtatttcttttccttatatgtctagtcaacagtggggtaggaggtgatcaaattattgtatcttgctctttgttcacttgatgctagctgccagcgtttctcaaatattttttcttcttccattatcgatcccccaaaaagagcgctgcctgaaacttcaataacgggcagcgcaagtctaattatgcagatctatgtatagcataacaaacaaatatgaaaaaacttagaaggtagtagaagttctggcgtcttttgctttgctttcgttcttaatgtgtttcattctaggatatctcaaaataaaaactatgcgtggtgttctcatattaattacttgtttttttctcttttaagtacattaatacttcatattcctcaacatgcttacttacaaaagcattataaaatgaagtacctaaaaccatagcaatcaatgttaatatagaatagctgacaataccccagtctctagaaaacatttcaggaaacactgcttgtggaagacctagtattagaaatgaaatataacagatcataactacatttaataagtttttattcctatctgtcacttttctttttaaatggcaaaaatttcaatctttaaatggcgaaaaacaaagagcgtgagaccctatccttatctcacgctctttgtctatttttctaacaaatcaagtatttcttgaggagaatcaataattatatctacactttgaaaattttctatatttttggctccccatttagctaaaccaaatgctatcccacaagctttcgcactttgcatgtcatataatgaatcaccaatataaatcgtttcttattttttatgcccaattcatcaattgccttttgtatggggtccggaaaaggtttatgcaacttagtatctgaagctgtaatttgtatatcaaaatatagatttagaatctaacaagcaatgttcaagcaacgcttgactgaagagcttccatcccaccaatgatataaacagcacgaaatccgctagcagtaagttgatcggctaatgcttctgatcgtctgcctgtatagcttagaatataataaagtttttttggatctagattttttaattgtcttggcaagatagcagcggggatagaaagcgagtggcttaagtgtttttttgtgtaatctaaagtatttcttgtatctaaaacgatgctgtcagcatcgagcggcaatttattgaagtcttggacactaattgattgggccatttatctcatcctttgtttagtatgtggctattttaatgggcagctctcattaattcaaatggaaggattcctcttatcacttttttaatgtatcggataataatgaaaaaaaactatgcaaatgtcttgcgaaacaggtgggaggtgttataatgacatagcgtcatatgacaatgtgtcatcttagaagaaaggaggatccatatgccgacacagacatttttccatttgccgaaagaaaaacaaaaaaggttaattgaagcggcgagaatcgagttttctagagtacctttgaaagaagcctcgattgctaatatcgtcaaattagcggatatccctagaggcagtttctatcagtattttgaagataaagaggatctttatttttattactttgagacaatgagacgtgacagctctaaagatatgttgcaactaatgaaagaatccgatggtgatctattcaaaggattcgaatcctatttttctaaaatgatttatgagattttggaaggtgagaatgcttctttttatcgtaacttgtttatgaacatggattaccgtgcctcaagaaaagtcgctcctcatacgagtcgccaaaaatcgcctcacgatccacataaagaacacaaacaagatgcaaaagagttgcttgaattgattgatcggacgaagctgaaagtaaaaaatgatcatgaattggaattactgatccaattagtgatgaatactgtatttacaacaattgcgcattcgtatcgcttattttcaacatctgaagattactcagtagagcaagcaatcagtgaattcaatttgaaactttcttggctgaaaaacggagtatataaatagaaagaagggaactagatgctaaaaatcgtaaaacggatctccttgacttcagcaattgcagctgcagttttcatggtgatccaagtactggcagatttatatttgccgacacttacctccaatatcattgataaaggggtagcgcaaggagatgtcgattatatttggcatacaggttttgtgatgatcggtttttctttgatcagtatcttagctgctattgcaaatacattttttgctactcgagaatcacagaaactgggtaagcaattgcgtacggatgtctataaaaaatcagagagcctgacaaaagatgcgtttgacaaatatggaacggcctctttgatcacaagaacaaccaatgatgtgactcaaatccaaatggtcacacaaatgtttttacgtatgatgatcaatgcaccaatcacgttgattggcgcaagcatacttgcttatcaaaaagatcatcagttgacaaaaatcttcttagtcgtcatcccagtaatgattattttgattggtggaatcatgtattttgctgttccattattcaaaagcatgcaaaagaaaactgaccgtttgaacttggtatttcgagaagggttgacaggtgtcagagtcatccgcgcattcgataagacacgctttgaagaaaatcgttttgatttagcgaataaagattatacaaatacagcaatcaaagttaatacgattgtcgcattgatgatgccgatgatgacattgatcatgagcggtacaaacgtagcaatcacttggtttggtggacactacatagcagatatgaccttggaagtcggtaatctgattgcatttatgacttatgcgatgcagatcttgatcagctttatgatgctttccgctatttttatcatggtacctcgtgcacaagcttcagctgatcgtatcaatgaggtgttggatgaaaaaatcggtatccatgaccctgaaaatcctaaaaccgtttcttttgctggaaaagaagcaacattggccttcaatcatgtcaattatcgatatcatggagcagaaaaacttgcattggaagatattgattttcaagctaagtcaggcgaaatcgtcgcaatcataggaggaactggttcaggtaaaacgaccttagtcaatttgatcccccgattatatgacatcgaatctggttcgatccaaataaacggaacggacatcagtgaaatgactcaatataatttgcgggagctaatgggctttgttcctcaaaaagcagttcttttctctggaacgatccgagacaatatgcagtatggtaagccggatgcaacagatgaaatgatttggaaagcgttagaaattgcacaagctaaagattttgtttcagagatggaagatggattagatagccatgtggaacaaggaggaggaaacttctccggcggacaaagacagcgtctagcaattgcacgagcattagtcaaaacagcagacatttatgtgtttgatgattccttctcagcattggatttcaaaacggatgccaatcttcgccaagcattgaaaacgaatatgaaagaaagtatcacggttttagttgctcaacgagtaagtacagtaatggatgcagatatgatccttgtgctagatgaaggaaaactagttggcaagggaacacatgaagaactattggcaacaaatgaaacttatcaagaaatcgttcattcacaactaagagaggaggacttagcatgagtaaaacaaacacacgtccctctcacggaccagcaggcggtccaggacacggcggacctggcaggaatctcggtgtaaaaggggaaaagcctaaaaatttctggggaacagtacgccgattgtttggctatatgtctaaacgtatggttgcaatcatcgctgtatttgtactagcaatagcagccgtgattttccaaatccaaacaccaaaagttttggggaaagcaactacagaaatattcaaaggtgtaatggctggcgcgcaacagatgcaacaagggcaacaagtaacaaaatttccgatagattttgataaaattgcgcaaatcattgcaacagtaatcgtgatgtatttgatctcagctgtattcaactttttacagcagtttattatgacacgtgtttcacagcggacagtttatgagttgcgtcatgacttggaagccaaaatgaatcgtgtaccgatttcctattatgatacacatacaaatggcgatatcatgtctcgagcaatcaatgatatggataacatcgcaagcacgctgcaacaaaatttgactcaatttgtaactagtgcagtcacattgatcggggtcatcgtgatgatgctttcaatcagctggcaattaacgttagtcgcgttattgatgatccctttaagcttgatcaccgttatggtcgttgcgccaagatcacaagtgtttttcgcagatcagcaaaaaagtttaggtttattgaataaccaagtagaagaaacatatggtggtcatacgatcgttaaaacattcaatcatactgaaaaagatcaggaagtatttgaaaaagaaaatcagaatctgtatgccgctggttggaaagctcaatttatttcggcaatcatcatgccgttgatgaatttcgttaaaaatctaggctatgtgttcgtcgctgtactaggcggagtaaaagttgcaaatgggaacatgacattaggggatgttcaagcattcttgcaatatacgacacagttctctcaaccaatcactcaacttgcaagtttgatgaacactatccaatcaacggttgcttcagccgaacgggtatttgaagtgttggatgaagaagagatgtccaatgaaaaatctggccttccagaagaaaaagatacaccatacaaagttcgttttgaaaatgttcaattcggctacacaccagataacttgctaatgactgatttcaacttggatgtcaaacctggtgagatggtcgctattgtagggccaaccggtgcaggaaagacgacactgatcaaccttcttgaacggttctacgatgtttctggaggcagtattcgttacgatggtgtagatacccgtgacctttcacgtgatgaattgcgcgcacagttttcaatggtactgcaagatacgtggctgtttacaggaagtatctatgacaatatcaaatatgggaacgacgatgcaacagatgaacaagtcattgaagctgctaaagccgctcacgtagatgattttgttcgtaaattgccagaaggatataacactgtattaaacgaggatgcaagcaatatttcgcaagggcaacgtcagctgatcactattgcgcgggcattcttagcaaatccggatgtcctgatccttgatgaagcaacatctagtgtagatacacgaacagaaatactgattcaaaaagcgatgaaccgcctattggaaaaccgaacaagttttgttgtcgctcaccgcttgtctacaatacgcgatgcagacaacattattgtgatgaatcatggttcgatcgtagaaactggaaaccacgatacattgatggaaaaagacggattctatgcagatctttataacagtcagttttctgaagaagaagcttcatagaaacgtacaaatttattatttttctttaccgcatgaagcacatttcaagaaaacgagtttcatgtggttttttactcatttatttataaaaaacaagtaaaatgcgaagtttctcacactttttttaacaaaaacaaagttattgcttgaaagaagaagaatccatcgttaaaataaagcttgacgtagaggggagcaagaaatatgagagattttcaattgggggctgccacctatttaaaaagtgtagccattcgggtgaaagaccgagataaaatgattgatttttacaagaatgttgttggctttgatttgaaaagagaagaaaacgaattagccattttaggaacagaagaagctggaagtgaaatgttgctgctggaagaaagtcctagagcgaatgatcacatggggaagatcaaaaagctgaaccgtttctcattgattatccctagcacagaagaactggcagatattctttgccgtattcgtaaaatgaattatccaatcaaagaagctttagaagatcatggacgtatggggattttactcgtagacccagaagagaatgaattagaaatttaccatgaagagaataagaatgaccaaagagaagttccagagacgatggatcaagaagcgttgttaagaaaatctgaagaaaaattcagtaaactatcagcaggttcttattttgaaaaaatccatttaaatgttactgatttagcaaaagaacgccaatttcttaatcgtgtccttggtttgaaggtacataatgaagaagagggcatccatgtattgaatgaaggagacttccatgttggattgacagaagcaagtggtggtgccatcgatttgcctacagatgaagtgattggacttgattttctgaaattcatgattgatactgaaagcatggaaggactgattgctcacttgcagcaattatcagtcgatttcttcttggacaaaaagcatacagtactcacaatctatgatgccataggaatcgaatggtggttcgtcagtgagccaaaagaaaagaataaaactgacattcgatgcgacgcttaactttttctttcttaacgattgtcgcatgtctcgtcattttatgaacggtcatactatcacttgttctagagatagaaagagcaaacagtataccgaatgaaactgcgtggttttccgcgcagtttttttgtgtaaaaaggttgattcctcatagattaagctttaagcttggactgtaagaatctgacagaaaagcaggagaaaaagatgtacccacaaacgaaacagcttattttgaaaaaaatggaagaaggattttatccaggtgtagcagccgccttcatcaaagaaaatcaagtagaatcatttacagctggctttgcccaagtcgttcctgaaaaacagccgatgacagaagatctgttgtttgatgcagcatcactgacgaaagtcgttgcaaccacttcattagttttgcgtctattagaagatggaaaaatagaactcgatcaaccactgcataaatatctttctgaattcgaaaatcagacaatcactttgcgtcatttactgacacatacttctgatatcaaaacatggataccaaacagagatgagctatctcaggaagaattgattgccgcttatttgaagctagaaccaggtgagcaactaggaaaagaagtaaaatatacagatgccggaacgattcttcttggattgatgctggaaaaaatttaccaagaaactgcagtggaaatctttcaagaacaagtattggaaccattagaaatgatgaacagcttatttcttccttttccttccaaaaaaatcgttcccacagaacaactgccttcgggtgaggttttgcgtggacaaactcatgatccgaaagcaagagttttagctgaacatgcaggaaatgctgggctctttatcgatttgaacgacagcattacttttgtccaaatgtatttgaacaagggaaaaatcagtaatggtcggtttttagaagaagaaacgattgattctttgctacaagatcaaactccagaaagaaatggctatcgttctctagggtgggatttaaaaaaagatgtaggagacggtcatgcgattctttttcatactggttatacaggtacgtttttcttgattgatataaaaacacaagaagcgttgatatttttgtctaatcgcgtacatcctgtcgatcatcgtgcggagtatctcatatgtcgagatgaaattgttgaaaattttttgaaagagaaagcggtattacagaaataatgctataatagctatgaaaaatgagaggagtttgaattatgcaagaacctatgtttttaaaaccagtttttcaagaaaaaatttggggaggaagccgcttacgttcagtcttcggttttgatatccctaacgataaaatcggagaagattgggcgatcagtgcgcatcctcatggtgtcagtgtagtagaaaatggcgaattcaaagggaaaagattagatgaactatggtcagaacacaaggaattgtttggccatccttcagaaccagtgtttccattattgatcaagatcttagatgcagaagatgatctatctgtacaagtacatccagatgatgcctatgggatgaaacatgaaggtgaattaggaaaaactgagtgctggtatatcatcgatgctgaacctggtgcagaaatcatctacggtcatcatgcaaagacaagagaagaactagctgagatgatcaaaaatgggcgctgggatgatcttttgaagaaagtaccagttaaaaaaggtgatttcttttatgtaccaagcggaacgatccatgctattggtaaagggatcatgattttagaaacacaacaaagctccgatacgacctatcgcgtgtatgactacgacagaaaagatgcgcaaggacaaacaagagagctgcatatccaacaatcgatcgatgtaacaactgtccctgccaaaacaccagaactacaaatcaaagaagttcgaaaagggaattcatcgatcgtcacttatttagaaactgagtttttcaatgtatatgagtgggatattaaaggaatcgcatctttcaaaaaacaagccccttatacgttgatgacagtgattgaaggagcaggagaccttgttgttgacggaaaaacatatccattagaaaaaggaacaagctgtatcattccaagtggcgtttctgagtggacggtccaaggtgaactagcaatcattgcgtctgaaccaggcaaatagttcccagatagctgaaagcggcagacggttttcgtttgctgctttttctacataaaatccgtctatcaataaatagaagtatggtgaaaaagatggaatacaaatggaaagcaaacagcaacagtcgagtgtttacgaaacaactgagaaaagccggacaccacttgaatgagatgatcatgccaaacctaagtctgtttattgcttggggaatcttgtcattagtaatgaaaggtgtgtctggcgatttgcacgccacgttggaagaggtatgccactggatgattcaactgcttttaccaatcttgatcagctattcaggcggaaaatcggtagggggacaaaaaggagcagtcgcgggcgcaatcgcttctttagggttgattgctcgttccgatgccccgcaaatcgtaggagcgatgattatagggccgcttgccggcatctcgtatgaacaatttgtttctagatttcatgcgaaattcaaaggtggttatgaaatgcttgtcagcaacttactagtagggctgattggtagtattatttgtataattggaatcgtttttattgagccagctttaaatagtttccacctgttgcttgtctccgtcgtgtcttggctagtcaaaatgaatctgttgccgcttgtcagtttgatcctagaacctctaaaagtactattttttaataatgcaatcaaccatggtgtgttgacacctttaggaatcgaattctcacaaacagtcgggtactcttacctgtttttgatggaggcaaatccgggacctggtttagggatcttacttgctatcctttgttttgcagaaaaacaggaaaaagtaaatgcgagtggagcattgatgatccatgcgattggcgggattcacgaaatctattttccatttgtcttgctgcgaccgtatctatttttagctgtaatggttggtggagcaagtggcacgttgatattccaatggttagatgcgggattagctactcctgtatcgcccgggtcactactcgtgatttttgccaatacgccttatccgcaactagctggggtaagtatagggatagcaatcagtacatttgtgaccttcatttgtgcaacgctgctattgaaattaccgaaaaaagaagaaggagacaacacggtcaaagaaaggggagaaattttggaactatctaccattcattctgtcgtttttgcgtgtgactcaggcatgggatcaagcgctatgggagctgccctgctgaagaaaaaattagcagcggaaaaaattgatctcgctgttggatacagctctgtctatgaattgaacaatcaagtaaatcagcttgttatcgtccaacatgaattagcggatcttgcaagagaaaaagtacctcaaagtcaaattttcgtattgaatcactttttggaaacagatatcttgctgtcacgaataaaaaaagcaatccacgaaccaaattggaaagaaaaaaaagagagagtagaagtaatagaacagaaaaagtcgcccgtcaacgttgtgtttttgtataaaaataatagacgtggttcacaaaccatgggcatggcgattttaagtcaattagcaaaaaaagagaaaaaacagtttgttatcttaaaggaaccaatcgaacagctcaaaatccaagaagaaacgatttatatcgcccaaagagaactagctgtaaatgaacagctaaaagaaaagatccctcagctagtcctagtggaacattgggtagctacgaatgaatacgaaaaacttgtgaagggagaaaaataagatgtacttatcgcccagagaaaaacaattattagcagaatttctcagcagtccctcacctgtgactatccaaaaaatgatgaatttattgaaagtcagcaagcggaccatttaccgcgaattagataatcttgaagtctcattgaaatcggtaaatgcttcgttgaaaaaagtagcaagaggttcgtttgtcattgaggcatcggaagaagtaatggagcaattaaaagaaaatacagaggggaaaagcgatgatttgcctactgctaaacgccaacacgcaattttagccgagttgttactaacgacagaaccgttgagtcttgctcattttatggaattataccgcatcagtaatactactttttatgcagatatcaaacagttggaagaaagtatccgccaactgcctttggaaatcattcggaaccaaggatatgagatcgtaggaccggaaaaataccgtcggcttctaacagcgaatgtattagaattagaaatcaatgaatatgaactttttcatagtattccttttgattcatcgctgaattacttttttcgattcgttgatccgcaacatctgtctcttgcacgccaagtagtcggggaagaattgatccaaaaaaagactaatctaagtgatagaaaacttgaacatttggttttgatgctgacattgacgatggatcgtgtaacgaaaaatcatttactgacaaatgagacgtataatggtctggcaaacaaagaattgcttcagaccgctaaacgattattctcacggattgcttctgagacaaaacaactttacccagtaaatgagatcgtcttttttgcaggattattaaatgacttcacgaactcatttgatcagaatttctttgaagaaacgttcgatacacagcttgcttatttagtaaaacaactgattcaagaagtaagtgaagagacgaatgtccatttttatgaagatgaaaccttgtacaaaatgcttttgacccatttgtctggtgtgttttcaagagccgttttacaagaagagacactgactaatccgattttagaaaaaatcatggttcaatatgaggaaattgccaatgcaatccgcaaagcagtagagcggatttttcaagaaaagaaattatcagaagaagagatcgcatatatggtccttcattttgcaaattcattggaaagaagcccgaaagaaagcgatatcagtatcgcaggattctcaccaagcggcttagcttctactagcatgttggaactgcgtttgaaacggtattttcctttcattcaacagattcatttctatcggatcgctgatttgaaaaaaattgatttacaagaagaatatgatattgttatttctacatctattctaccaggatatgatggaaaatatattttagtctccccgctactgctagaagatgaagtcaagcagctaaaagaagctttttcgcatattgagaagaaaaaaaggcaaaagaatacgtataacagcaataacgagtggatgctagaagatacttatgaggaaacgatgcatttcatggagcaaatcaatcaattacttgatcgtttctttattcaagaactagataatcctaatacggtctctgaaacgattcgcagtttatttccttattttcctgaaggactagtaacagatgaagaggtggttcatcgccgactgcttaagcgatatgaacaagcacctatcggaattcctcatacaaatatggggttattccatacatccagctcattggtttctaaaccgatcttttgtattttcaatttgaaacaaccgttgacaattgacgggatggatagacagccagtcgatttgtcccgtatgttagttatactggcgccttcgccaatccaagaaaaagacggaattcttttaggaaagatcagtggagcaatcatcatgaacgatttgaacaccgagatcttccgctcaggaaataaagaaatcgtttatcaattgttagcgaaaatcctgattgaagaaataaagaaatgagggtgaaaagatgatccagctaccagcagaaaaaatattgctcgatcaatcctatcaaaattggaaagaagcgttgaccgagatcggccagtggatgacccaacaagggggaatcaaaccggcatatatccaatcaatgatcgaaagacaagaaaaagcgagtgtctatatcgggaatttcgtagccttgccacatgggactgacaaagatgaagaagtagtagaagaagggatctatttagtccaagtacctgatggtgtggactttggaacaaaagaggaaccaaaaatcgcgacactcttatttgtagtggctttaaaaaaagaacatcagttagctgtgctacaagatttagcctttttttgttcagacatcgaccaagtaatggcactcagtgatgcggaaaccattgaagaagtccaaatgatttttgaacatggacatatataaccaatgttctcagtaaaaaagatgccttgcatcaagtaataacttcaaccaagtgaaaaataggagacggtgacaagatttttgtcaccgctcctattatttttgtgttttaataactcttttttatatagatagcgcacatacctatgaataatagaacaatactccatgtaccaagtgtcaagataccattcatgaaagtaacctgttctgaagctagtggagagaaaatatctcctcctacgatcacattttgaaaatcaacataagaagttggcaagtaatgactgattgattctatccatccaatcgaagaaaacaagcgatactctgctaagaaaagacaaagaagtgtacctaaaagattgactagagaatgttcaaataaagcagatagaagaaaactgatcgtacttaaaaagaacacccacaacaacaagaacagaaaactctggaaaagatatgcatacatcggaaggattcgtatctcctgaccaatgatcgttcctacaggataacggaagtcgcccaaaccatttttgattactactagtatagagacgaacaaaaatggaatcacgagacttagcatagctgcaccataataaacggtgaaacggatgctatgtttctttaccatactatccggtaatagattgactagagagattacctgctttcttttttcataagagatgatcgaggaaagaaacaaggcggttatacataaaatcaaaaaactagaaatcattcctgaaaaaatattttcgtagtaattcgctaaagggaggtgcgctggcaagtcaaaaattgaatatctttggatctgatgttctttcatataacggagcaactctacacgtttttgttgttcaatgattggaagtccttgtctttgaccagaaatcagccggcccagtatatctttttcataatgataagttgcttcgaccatttcctggacattccctgtgttttttgcacgtaaaattgcttcgatcagtttgttgcttttctctaaactttccacaaattctttctcattctcatcttctttcaacgtttcaatcaaacgttgcgtctcttcatagttatgattcagttcatcgaattctgtataagcaagttcatgatcaaaaaaaagtgggaatgcaaagagcacgatcaacaatagagggaataaaaagtttactttgttttttagtaagagattgcgttcaaatgtaaataaagtcatagttacacctcatacaattgacgataaatagctaaaatctcttccatatttgaggattctgtgacgatttctccattttttagaaaacatgctttagaacaaatcgattggatattcgcgatagcgtgggaagaaagaagaatcgtcttcccctcttcctgccattgtctgatcagcctattcaagatatcaatacttcctgggtctaacccgttcaacggttcatcgaataacatgacagatgaatcactgatcaagtaagcagcaagcaagacatgttgtttcattcctagagacatttttccaatcggcaaagtaaggtactcagtcatcttcaatcgttggaaaacagtttagcattctactttgctctgccaatagtatttgatcaaagtcaaataatcaacagccgttagatagtcggataactgattcgttgattctagaaaaaagaaagaccggcgataatctgtataagcagtaggagagatgttgtgaagggacaattgatcataagttgttggcagcagttgggcaatgccattcagcaaagttgttttgccaaatccgttcggggcaatcaaagcagctacttctcctgattctactaaaagatccaattgtcgaatcacacgttttttaccacgtttcatgttcatgtttttgatcagtaatgtcatagataggtctccaatataaattttaatatcataataaaacaaaaagcatccaaataaaatgctgacaaaagttattatttacatattataaaaaagttaaaataacatgtttatttaaaagtaaagtttgctgatcccaaaatttttttattttgctgatatcctcaaacctttggcacaaagtttcgtgccaaagtacgactatttctctttttagtaagcgaatacaattagagtatcaaaaggagagaggaagagacaaaatggaacggatgattcccaaaaacaacatttcgctaaaagcgagggtacaaaaattaggcagtaccttatcaagcatggtcatgccaaacattggagcactgattgcttggggtgtgttaacggctttatttatcccagatggttatttgccaaatgaagcttttgctaccatggtaagcccgatgctaacttatctgattcctttattgatcggctatactggcggaaaagtaattgctggtgaccgcggatcagttgtgggagcaattgcaacgatgggtgtgattgtcggaacagatattccaatgatgctaggtgcgatgatcatgggacctcttggtggatatgctatcaagaaatttgatcagctgttccaaaaacggatcaaatccggttttgaaatgttggtcaataatttttcagcaggtcttatcggttttggattagcgttattaggtttttctgcgattggtccagttgtcgatacattgactcaagcaatggcaaaaggtgtagagatcattttatctgcccatttgattccattgacaagtatttttattgaaccagcaaaaatcttatttttgaataatgcaatcaatcatgggattttgacaccattaggaactgaacaagtagcagatgcaggaaaatctattctattcttgcttgaagcaaatcctggtccaggacttggcgtattacttgcttttactttgtttggcaaaggagcagcaaaatcttcagcaccaggtgctatgatcatccactttttaggtgggatccatgaaatctattttccttacgtcatgatgaaaccgttattattcttatcagttataggcggaggaatgtcaggaagtttcattttccaattgatggatgctggactaagagcgccagcttctccaggatcaatcattgcgattctagcgatgacaccgttcaattcttaccttcctgttattttgggcgtgattgttgccgcagctgtttcattcggtatttctgcagtgattttgaaagcggatgcgaaagatacaaatgaagactttgaaaagtctgtgcaagagacaaaagtagctaaacaagcatctaaaggtgcccaaggtattcctcaaggaactgcgctatctggcgtacaaaaaatcatttttgcttgtgatgcagggatgggatcaagtgcgatgggcgcttcgattttgagaaaaaaagtacaggaagcagacttgcctcaaacggtgactaaccaagcaatcagccaactgacagatgactcgaatacattgatcgttactcaggtcgaactacaagaaagagcaaaacaaaaagcaccgaacgcgcgttttgtttcagtagaaaactttttgaattcacctcgatatgatgaaatcattcaagaattgagcagcaaacaggaaccatcaacttctgaaactaagaacgagccaacagaagagtttctttcagcaaacatcaaacaaatcaaagagattctacttgtccacgatgatcgttcgggatcagcaacaatgggaatgactgtgctcaaagatatattagacaagaaccatttaactatcccgttacgaaaagtcaacatccaggagttaaaaggggagcctgattcactgatcgtagccaaagaaagtttagcagaaaaagcacagatggctgcaccgcaatccattcatttatcggttaatagcatggtcaacccacaaaaatttgaatcaattgcacaatatttgaaacagacagcttaagggaggaaaacagcatgcaaagtttgccattcgacatgatcgaactcaatcgatcatttaaaaccaaagaagaagcgatccgctattgcggtcaaaagcttgtagaagcaggatgcgttgatgaggaatatatcgatgccatggtagaaagagacaacatgttatctgtttacatggggaattttatcgcgattcctcatggaacagatgaagcaaaaaaatatgtgaaaaaatccggcatttgtgtcgtacaggtgccagacggtgtcaattttggtacggaagaagaagaaaagattgcgactgttttgttcggtatagcaggagtcggcgatgagcatctgcaacttgtacagcaaatcgcactttattgcagtgatatggacaatgttgtccaactagcagacgcgctcagcaaagaagaagtaacggaaaatctagcaattgcttaaggagagagaaaaatgagagcagtacattttggtgcaggaaatatcggtcgaggatttattggagaaattttggcaactaatggatttgagattactttcgtagatgtgaatcacacgatcattgatgctttaaatgaaagaaaagaatacgaaatcgaattagcagatgaatcaaaagaaagaatcactgtgaaaaatgtcaaaggaatcaacaatcaaacaaatccagaaaaagtaatccaagaaatcgctgaagcagatttagtcactaccgccattggcccgaatatcttaccttttattgccgagttgattgcaaaaggtatccaagcaagagaaatggaaggaaacgcaacacctttagatgtcattgcctgtgaaaacatgattggtggttcagcatttctagaaaaagaagtgtataaatatcttccagaaacatcatttactgacaaatatatcggctttccaaatgcagcagtcgatcgaatcgtcccattacaacaccatgaagatcctttattcgtccaagtagaacctttcaaggaatgggtcattgacgatagccaaagaaaaaataaagaaatccaattaaaaggggttttatatgtagatgatctagaaccatatatcgaacgcaaactatttagtgtcaatactggtcatgcgactgtcgcttatacaggtgccttgttaggttaccagaccattgatgaagcaatgcaagatgcgttagttgtagcacaattaaaatcagttctgcaggaaacaggaagtttgctgattgccaaatgggggtttgattcagagcagcatcatgcgtatattgaaaaaatcatccatcgtttccaaaacaaatatatctctgatgcgatcacacgtgtcgctcggacaccattacgtaagttaggttatcaagaacggtttacacggccaatgagagaactgcaagaacataacttgacttgtccacatttgacggcaacaatgggtattatttttaattattatgatcctgaagatgaacaaagccgtcaactgcatgaaatgaagatccatgaaaacttagaacaattgatccaagaagtcacaggaatcaatgatccgaaaacaatcgggaatatcaagcaaaacgtgaaccgttatgccaagcaagtcgcttaaaataggatacgaaaaaggggaatgtgacgcaacttttgtcacattcccctttttcgaataactaggctgtttgtccttcaagatagggcaggtccaactcttcaccgtaacgttgttctaaagctaggcgaatcaagcgagctgctaatttctcatttcttgcaaggataggtccgtggaaataagaaccgaagacatttcggtaaatgacaccttcggattgatcttccccattgttcccttgaccttgtaccactttccccaaaggccgttcacctttacctaagaaagtccgaccattgtggttttcaaatccataataagtttcattgaattcttcattatggatgacaatgtcaccgataaaccggttgttttcctgacttaatgtgtagtgatccagggcactgataccttggatcttttctccgttggctcccatgtagtagtgacccagcaattgataaccaccgcaaatggctaacatgacaccatcattttcgatatagttgatcaaagaatctttctttttctggatgtcttttgaaatgatcagttgctcaaagtcttgaccaccgccaaagaaaaccaagtcatatttattagcatcaaaaggttcatgtatactaacgatctccgtatggcaagaaacccccattttttctgctacatatttcaacatcaaaaggtttccgttatcaccatatgtgttcatcaaatttccataaaggtgggcgatattgagttcataattagccatgattcattcctcctttgataaatccttgagccgccagttctttacgtagctgcaatacagcagtgtaagtagctaagatatagacatgttcagttggcaattctttgattttttcgattacttctggtaattcttttgtttctgtcaatttattttctggaatcccggcaactttcagacgtaaagtcatatctgtatgacgatctcctccagaaataacggctgggatatccatatcggcaaagttttcaaaattaccatcccaaatccagctgacatcgattccatctgcgtaattggcattcaataaagctactaaagaaaatggataaggagctagaccaatcatatcgattacttgattgatgcctacaggatttttgacaagtactaatgtacatttctttccattgatattgatgacttcttgtcggccgaacactttctcgtcatatcctaaaccttgtttgattttatcaggatcgacattgaagtactccgccactgcagtagctgctaaagcgttgtagacgttatacataccaccaacttcgattccatattcatgaccatcaatcacaaaatctgctgaaacattgtccatccgtaccatatcagtcaatcggtaatccagttcaggacgtttgaagtcacaatttggacagtaatattttcctaagtttgcataagtgatcattttataatgcaggatgtgatgacaattcggacacaagacaccgtctgtattgtaatgcgccatttgttcacgatcttcttcatggtcaaagccataatattttctaggattaactgtttcgatcgaattgaagatcggtgaatcaccgttactgataatcgttgcatttggtgactttgcggcaccgtctacaatcattttataggtcgtataaatttctccataccgatccatttgatcacggaaaatatttgtaaataaaaatagttctggtttcatatattctgtgactttgctcaaacttgcttcatctatttctaggacagcaaattttttctgtcctttttttggttttgcctgcaagaaagtcgatacaattccctgtaccatattcgcaccagtagggttggttagaacttcatcgaattgctggcgcaaaatattgactgttaaagcggtagtcaatgttttaccgtttgttccggtaacaacgacgacttggtagtcttttgccaagctatccaatatatgtggatcgactttcagcgctagtttacctggtaaacttgatccgcctttaaaaaaagtttttaatgcccattgcgacgttttcccaactgcaatcgcaaaatgactgcgtattcccattatgtaacctccaaaaacgatttgctgacgaataaattcaactaatcataccatatgttgaaaaaaaggttaaattgcttttcttattcttaagaaaaggttacggctgaaagtgcatgaaatcggagaaaaccgcatgatttaaaaaaaacagcttgaaacaaaatgattgtttcaagctggtgtgattttattattactcttcatcggtcttttcattattaaccaataatgattttctcacttggatattcatagcccagatctcgggtttcttttggtacgaacagcatcaatgtatacagcattccaatccgcccaataaacatcagggcagcaatcgtgattttccctacaacagacaagtcgccggtaatccctaaggacaaaccagttgttccaaaagcagaagttacttcgacgatgatcgagatcagtgtttgttcctctgtagcagataaaaaaacgatacaaaagaaacacataccaagagaaagcataaagacaacgactgactttcgcacatcatcttgatcgattctccgtccaaaaatattgatattatcttcactcttgaggaaggagtatagatacaaaccgatgattgctacagtagttgttcgaatcccgcctcctacagaactaggactgcatccgataaacatcagtaaagaaaaaatgatcagtgtcgtaatctgaaaatcacccaaatcgtgaatctggagaccggcattacgagtcgtaatcgaataaaacatcgaattgatccatttgacactcatactggaatcttggaataaatggtccttttccaatagataaattaagatagttcccgaaacaaacaagatgacaaaagccaacacagccaatttggtaaacaaggaaaaacgaaatggaagctttgcactggaacgtttatataatagccactcccgacactccatcaatacaggaaaaccaattccgccgacaaaaatcaaaaacatgattaggattaagaaaaaatagtcatgtgcaaagggcttgatggaatccccagtgacgtcaaatccagagttcgtgacagccgatatcgcctgataaaaaccgtaaaaaacggcatcacgccaacgatcaaaatagcctctgtaataaaaataaatagaaaagaatgtcccaaaaagtaattgaaaccagattaaaatagcaaaagtaatccggatcagtcggacgataccagacaaacgcggttgattcatatccgtcatgatcagctgccgctgtttcaatgtgattcgtcgtttagaaaaaatgacaaaagcagtagaaatcatcatgatccccaaaccaccaacttgaaataatatttccagcagtataatgccgttatcattgaacacagaattgatatcaaaagtcgatagtccagtcacgctcactgtactgattgccatgaacagcatgtccacaaaagaaacatggctatctggttcgcgaaaaatcggcagataaaatagaacgagtgataagaccgtcatcaatatataataaaaaacgatgatttggatcgatgagaaatgattagcagcaaacttctgtcctcgccgttgcagccttcgaaagaataaatcaacatgcacagtactatcctcctgacaatagtcgtttctaccagtatacaaggggaatcaggaatactcaaagaaattattgaacagataacaatacagctttcgattaaaatagaaatggcttataataaagcaaatcctagaaaaaagaaggaggaggaataacaaattgatcaatgcccaacaaatcgtagaaaaaatgaaaaatcaaaaaataaattatgatacagttctaaaaaaaatgatcatgcaatgggagaaagaagaagtaaagcctaagatattaatacatacatgctgtgctccttgcagtacgcacacgttggaattcatgtctcaatatgcagatatcacgttatttttttcaaattcgaatatccatcctaaaagtgagtatttgcggaggttacatgaacaaaaacgatttgtagaccaatttaatgagaaaactgaccatcatgtagcgctgattgttgatgaataccgtccaagtgaattcaccaaaatggttttaacaaaccatcttgaagacgaaaaagaaggtggtgctcgctgcagtgcatgcttcaatatgcgattagatcttgttgcgcaaaaagcgcaagaactaggatacgattactttggaagtgccctgacgatctcaccaaagaaaaatgcagccttgatcaatcaaatcggaatggatatccaaaagatttacgggacacaatatttgccaagtgatttcaagaaaaacaaaggctatgaacgctctttgcaaatgtgcaaagagtatgatatctatcgccaatgttattgtggttgcgtgttcgctgccaagcagcaaggatgtgatctgaaagaaatcaatcgggaagcaaaagcttacttaaaaacatcgaccgtagtttttgatgaaaattaaagaaatctttcggaaaaacgtaagaaaaaaataaagaatttatggtagaaataaggtagactgtataatttgtccgtagtaaagtaagaaaacaagaataaatttcaatgaaggaagagataagatgcgaaaagtagcacctattttgaagccaatcgctgtattaacaatctcgacgattgtcgcgactactacaggtattgtgaatagttccagctaccgtgcacccagttcaagttctagtactgtagaagaaacaacaccaactacttcagtctcgacatctgaaccaacaacaacggaaagtttgaatgaaaccactacgacaagtacatgggacgacacaacaactagttcgtcgtatgatgagacatatacaactgacagcacaagcgaaacaagcaatacggtaccagatggcacttcatcggattcaaccaatccaagtacaagtccggatacaagtgctagctccgaaacgataccaagcagtacgactgtagatgataacacgcaaaatgatgatgcagcacgtacagcacagcaaaaccaagattcaggaaatacccaaacgtataaccaacaagcaggtgattctcaatgacatttttactagaccttatcaatggggtgcataaattccttggctatttagacatcagtcctaaatatcttaaccgtggatatacgattttaagtgtgatccccacgctttatttattgagaattgtttatggactttggcaaaaccaaaactatcttcaatttttcttatatggacttgcatttctagtgcttgtttattttactgttttaaatgtattttattactttttagataaaaacacgaaagccgatgtcacacagctttttgtgaagtatttgcctgatgaagcgttcaacatccagacagaagaaacaatcaataatggaaattcgatcgataaagtgaatacacaagaggtcatggtttcttatgacgaagattaccaattgaaattagccgagaatatgcggtacttgattggaaatggtgagatcaaaataaatgaactcggtcgcatggatggatttcttgtcgatagaaatacgttgtatccttattactatgtcaagaaaacaggagagaaagagtatgttctaaatattggacgaagctactcggacatggaaaaagtagggaccattcggctgagctcaacagaagacacattagaacctgtcggattgttcatcgttggcggtgattttgtcaaagacgggttgcgttatcatgagccttatcgcctgaaattaattgcaaaaaaagcacaatcacaagaagaacaagttgtttatagtcggagccaaagaagaagacattcataaggggatgtgacatgacttttgtcatgccccttttttatataacgagaaaaatagaacgaacacgtcacttattctttcctttcatttataaacattgtagaataaagagagtacaatgaaatatcgtaaaaaaatgtaataaataacgaggaaatataagtaggaggtaagctgtgaaagaatttttgaaaaattgggggattctgatccttgtattagcggctattttattagctagagtgtacgtgtttacaccagtcactgtaaacggacattcgatggaccctacattaagtgatggacaacgactgatttcatctaaaatctcgaactatgaacgaatggacatcattactacgaaggaaccaggggatgaagaacgaatgatcgttaaacgaatcattggtatgcctggggacacagttaagatggaaaatgaccagttgaccattaatggcaaaaagtatgatgagccttatctagataagttcaaaaaagaattttcagaagataagttacaaggagagtatgcttatagttcagggttccaagcacaagcagaaagtgcctctacctttacgagcgattttgaatatactgtgccaaaaggaaagtatcttgttctgggtgataaccgtttgatttcaaaagacagccgaatgtttgggttagtcgacaaagatatgatccaaggcaaagttgttttccgctactggcctctttccgaaatcaaaatcatttgatgaaaaaataaaaagaagaggttgtgacagaagtggtcagcttcaagaaataagaaactgcttttggaacaccgtttaaacgaaaaaagaagctgtgacatatttttgtcacagcttctttttaagctttttggctgatggataggaaaagcgaagcgtttttgttcataaatagcttttctccacgatgaaaagtatgactagcagtagagacaaagccagtttttttcaatcgatcgttcaattcttcttggataaagccattatggactttcggatgactgatttgttcattcttgtcaaaatctacaataatcagttgaccgccaggagctaaaagttcgaaaagtttcatgagaatagtcttcgtatcaggaatgtgcaaaagtacgagtgatagaaggatcacatctgcttggatagcaggaaattcgacagaagcatcagcgtggatcgttcggacatttttcagatctgctgcttggatcttttcttctaccattttcaacatagtttctgaagcatcggcaatgatcagttctttgaatctttccgcaagcggtaaactcacaagcccagttccgcctccgtaatccagcaggactttttggtggctgtcgcgcggtagataagttgttagttcttcgcgaataatcttggctaatgcttgacggtcaggggaatcataatgattagcgatggaatcaaaaatattttttgtcatcaaatagctccttacataaaactttggaattttaacttattatagcacgtgaaaagaaagaaaacatgctatactcaattcaaaaagaaagtatttagcagatgtacttatttttataaatcctaagaattttcaaggacagaaatttttctagaaagataagataaatggatcgccttatttagttcttgtcaaaaaattggaacaaaagtaagcaagggatttgaacgataatctgtgcttgatgaaaattctcactgtaaaaaatgttgaaaatcaagtataataccataggaacaaactggaaggtgaaaaagagcatggcacaactattttttaagtatggcgcaatgaatagcggcaagacaatcgagatcctaaaagtcgcacataattatgaagaacaaaataaaccagttgtcttgatgacaagcggtattgatacgagagatggtttaggcgttgtttcaagccgaatcggactgaaacgtgaagcaatgccgatatttgaagaaacagacgtatttgacgtgattcagaacatggaaagcaaaccctattgtgtgctgatcgatgaagcgcagttcttaaaaaagaaacatgtcattgcttttacgagaatcgtggatgaattggatattccggttatggcgtttggtttgaaaaatgattttcgaaacgagttatttgaaggatcaaaatatttattgctttacgcagacaagattgaagaaatgaaaacgatctgttggttctgccacaaaaaagcaatcatgaatttacattatattgatgggaaacctgtttatgaaggcgatcaagtgcaaattggcggaaatgaagcttattaccccgtttgtcgaaaacattactttcatccatcaatgattacagaaggagaataagcatgtacgatcaattacaatcaattgaagaccgttatgaagagcttggagaacttttaagtgacccagaagtgatttctgatacaaagcgctttatgcagctttcaaaagaagaagcaaacacgcgcgaaacagtcgaagtttatcgtcgttataaagaagtagtacaagggatcaccgatacagaagaactgcttggtgaaaaactggatgatgaaatggctgaactagcaaaagaagaattatctgagttaaaaaaagaaaaagaagtcttagaagaaaaaatcaagatcttgcttttaccaaaagatccaaatgacgataaaaatatcatcatggaaatccgcggagcagcaggtggagacgaagcagccttattcgcgggtgatcttttcaatatgtaccaaaagtatgctgaagcacaaggttggaaaacagaagtgatggaagcaaatgttaccgggatcggtggatacaaagaagtgattatgatgattaccggagagaatgtttattcgaaattaaaatatgaaagtggtgcacatcgtgtccaacgtgttccttcaactgaatcgcaagggcgtatccatacttccacagcgacagttgtcgtgatgccagaagctgaagaagtagagatcgatattgaagacaaagatatccgcacagatatctatcatgcttcaggtgctggcggacagcacgtcaataaaacagcatctgcggtacgtttgactcacttaccaacagggatcgtcgttgctatgcaggatgaacgttctcagatcaagaaccgtgaaaaagcaatgaagatcttgcgtgctcgtgtgtatgataagatccaacaagaagcacaaagtgaatatgatgccaatcgaaaatcagcagtcggaactggggatcgttcagaacggattcggacgtataatttcccacaaaatcgcgtgactgatcaccgtatcggattaactatccaaaaattagatcagattttagcagggaaattggatgaaatcgttgatgcattgatcatgtatgatcaaacatcaaaactggaagctatgcaaaatgggtaaaatgacctatcgagaagtcctgtcacgggcttcttcttttttagaggatcatggaaaagaagcatacagtatccaatttttatttttggaacgaaaacaatggaaaaaacttgattggctccttcatatgaacgaagagatttcagaagaagaacaacagttgatcgaaacagatctgcgacttctgcttgcagatcatccgcctcagtatttgctaggatatgcagatttttatgatcatcggttgaaggtaaccgaagcaacactgattcctcgaccagaaacagaagagttagtggagtggtgtttagacgagacgcctgatgtaccattggaagtgatagatatcgggacagggactggggcgattgctattagtttgaaagcagcaagaaaaaattggcatgtatctgccgtagatctttctgaagaagcattagaagtcgcgaaagaaaatgctcagcacgaaggaacgaaaatcagtttttaccatgggaatacattggaaccagtacaggatcggcgatttgatgtgattatttctaatccgccgtacatcagtcggaatgaatgggaactgatggatgaaagtgtccggtcattcgaacctaagatggccctttttgcggagaacgatggattagctgtttatgaaaaaatagcagttgaagcaccaagcgtactaaaaccaaatggaaagatttttttagaaatcggatttcgccaaggtgaagcagtaaaaaaaatattccagcaagcatttccagataaaaaagtggcgataaaaaaggatctttttggtaatgaacgaatgatccaagtctacagttgaagctgtggatgaaaaaatttttatttgtttttttattataaaaaaacactaatttgacaaggatgtaaacgactttttggcttatcaacaagtttatccactattgacaaacgaatgatccacagtcagtggaaaacttgaggataaagttggataaaacaagaacgtatgaaaaaggggttgtggataaactgtggaaacgaaacgttatgatgaaactgaattaaaagaggcagccaaagcactgaaagcaggagaacttgttgcttttcctactgaaacagtgtatggattgggcgccaatgctctattgccaaatactgtcaagaaagtgttttctgtaaaaggaagacctcaagacaatccattgatcgtccatgtcgcctcttttgaacaagtaaaagagtatgtggacaactttcatccagaaacagagaagattgtgaagaacttctggcctggaccactaactttgatatttaaaatcaaaaaagataccttgccctcagttgtaacaggaggattatccacagctgcatttcgtatgccggataacaaaaaaacactagaagtaatcgaactttcaggggttccgcttgtcggtccaagtgcaaatacgtcgggaaaaccaagtccgacaactgcagatcatgtattccatgatctacaaggaaaaattaccgggatcattgatgatggagctacgcgaattggagtagaatccactgttcttgatttaagtgatccaacagccatgcctatgatcttacgaccaggtgcagtaacgaaagaacaaatcgaagcagtcatcgaatctcctgttgctattgatcagcatcttgtaaaagaaaatgaaacaccaaaagcgcctgggatgaaatacaagcactactcacccgatacacgtgttctgatggtcagagagggcgattggtcaactgcagttcaatgggcaaaaaataagaagatccgtgtaggtgtcatagcaagccccgaaatttcggatcaagtgcggacagatactgcagctgtttatatgtataacgacaactcagtagaagcggcggctaaaggattgtttgcaggtctaagaggattagatgaaccaacacttgggttagatttgatttttgtacaagtatatccagaaactggattggggaatgcttatatgaatcgcttgaaaaaagcagctggacaaaattattttgaaaaatgatcaattggttattgccgcattcttttagtatgatacaatgctatcaagtaaatcttctatcagtgaacgaaaaacgaagtgtaaatagaagagatacgaatatttggcaatttgtttttgatgggaaaaataaaattgtaggaaaataaaaaggagctgttgtttgtggtagattacaaaacgtttgaccctgatctttgggctgcgatcgccaaagaagaagaaagacaagaacataatttggagctgattgcctctgaaaactttgtctccgaagcagtgatggctgcgcaaggaagtattttgacaaataaatacgcagaaggttatccagggcatcgctattatggaggatgtgaatttgtcgacatcgttgaaaatttagcgattgaccgtgcaaaagaattattcggagcgaaatttgcgaacgtccaacctcactccggctctcaagccaacacggctgcttatctcgctttggtagaaccaggggacacgatcttaggaatggatctttccgcaggcggacatctaacacatggatcaccagtcaacttcagtggcaaaacctatcactttgttgcttacggtgttgatccgacaacagaagttattgattataatgtggtacgtattttagctagaaaacatcaaccaaaattgattgtagcaggtgccagtgcttacggacgaacgatcgactttgcgaaattcagagaaatcgcagatgaagtaggcgcaaaactgatggtagatatggcacatatcgcaggattagtagcagcaggacttcatcctaatccagttccttatgcagatatcacaacgactaccactcacaaaacattgcgcggacctcgaggcggcatgattttgacaaacgatgaaacattagcgaaaaaaatcaatagtgcggtcttccctggtattcaaggcggacctctagagcatgtgattgctgggaaggcagcggcattcaaagaagcactagatcctgcatttaaagaatatagtgaacaaatcattgccaatgcaaaagcaatggtcaaagtattcaatcaagcaatcggaacaagagtcatttcaggagcgacagataatcatctgatgctgatcgatgttcgtgagttaggtataaatggaaaagaagcagagagtattttggacagtgtgaatatcacggtaaataaaaactcgattccttttgaaacgctaagtccattcaaaacaagcggcatccgaatcggtacaccagcaatcactactcgcgggcttaaagaagaagatgctgtaaaagtggctgaattagttgttaaagcattacaagcaaaaggcgacaatgctcaattagacgaagtcaaaacaggtgtacgcgaattaactgaaaaatttccattgcataaaaaataaaaatttaaattccatataatacaataatacagaaaagttcaataccggacttttctgtttttttctattttatttttttatggaaaacggattctttgacaatattgatgatgctctctagtatatgaggtgtaattttagtcttcacattaaatctcagggaggaaaagtcatgactgatcgtatctcgttagaaaaggaagccatagcattcagtgatgcaaatgcacctcatccgcgaatctatgaactagcaccggaagaaggaagagcattactggaagaagtacaagaatcacctgtgaacaaatattccgttgatattgaagacttgatggtagatactggcgaatggggaaaaatcaatattcgttttgtacgaccggaaggaaatatagataaattaccagttattttttatatccatggagctggttgggtctttggcagtactcaaacccatgataaattgatcagagaactttcggtccgcacgaattctgtcgttgtctttccagaatatagtcgatcacctgaagcgaaatatccaatagcaattgaacaaaattatgctgtgttgcaacagctgaataaattagccaagtcaaaaaatctggatctcgagaatctaatcgttgcaggagattcagttggtggtaacatggctacagtcatgacgatcttaacaaaagaacgaaaagggctcccaatatctaaacaattgctgtattatccagttaccaacgctgattttgatacagattcctatcatgaattcggagaaaactattttttgacaagagaaggaatgagatggttttgggatcaatacacgacgaatgaggaagagcgtgctgagatcacagcttcgcctttgagagcagaactgaatgaactaaaagatctacctccggcaatgattttgacaggagaagcggatgtattaagagaggaaggcgaggcttatgcacgcaaacttcgtgatgcaggggttcctgttacacaagtacgcttccaaggaatcatccatgatttcgtcatggtaaatgctatggatcagacaaaggcaacgcgtgcagcaatggcattatctacttcttggatcatggaaaaagaataagctttgcttgtcagcaggaaaacttcttttcaaaaaaggattttcttaggaaaaatggcgagtttgactagtcaatcacttgattttgttttacaattaaaaagaaacgacagaacaaaggagagcttaaaaaaaatgggcaaatttcaagtgatcgatcatccattgattcaacacaaactaactattattcgggacaaaaactgcggaacaaaggtttttcgtgaagtagtcgatgaaatcgctatgttgatggcatatgaagtatcacgggatatgccgttggaagacatcgtgatcgaaacaccgatcactgaaacaacacaaaaaacgttgtccggtaaaaaagtagcgattattccaatcttgcgtgcaggtatcggaatggttgatggtatcttggaattgattccagctgctaaagtgggccatatcggtctttatcgagatgaagaaacgtttgagccacatgaatatttcgtcaaacttccagaagacattgatgcacgtcagttgttcgtagtagatccaatgttggcaacaggtggatcagcaatcatggcaatcgatgcattgaaagaacgtggcgcgtcgaacatcaaatttgtttgtttggtagcagcacctgagggagtaaaagctttgcaagaagcgcatcctgatattgatatctatacagcttctctagatgaaaaattgaatgaacatggttatatcgttcctggactaggggatgcgggtgaccgtttgtttggtacaaaataagtaaaatgaaacatactaagattagaggggaacatcattgacgaatgcttttaaaatagccgcagcttctgcttcttttctcttttcctctgctatagctttaagctcctcctcccttcttttttcagcttcttgtttttgattttcaaattttgctttttcggattgctctgtcgccaaagaagcggatatctcattgatttttatactttgagttaatttggcttctataaggtcattttctttctcttcgagagatcgagtttctttttccgcatctgtaacttttttctcagcttctttttttaattcatctaaattttctttatcatctatctgggcctgcataatctcattactagcagaaataagcttagtcataccaatggctgctgtgactgcatctgataatgattcggcatttaccatgacagatattatagagtcacttttttgatttacttgtgcattcctagcctgctcttcgataagtttattcctaaggcgtattctttcctcaagagcagtaattttctgattaatctcggtaagtttcttctcagatgtgtttttttccactagcacttttttatattctttttctagctgagttattttgttatctaaatcagtaagataattttcagctgattctttattttttacaatcgcttcaattttatcatctttttctttgattttttcctctatagtctgtgctttagctaagagaccattactaaaaaatagcgaaaacacaatgacagaggtagatataaatgtttttttcaaattgatttttcacttcccttattttatttgtgaagaaacattttacataatattctcctctctattttatcgttgctacaggttctactaggaattgaaattggaattactatacaaaaagtaataggatccatatgctatatttcaatttaatagacagcttcaaaataactaaaacttatggagattttatggagcatatacatacctacataaaattcacacaactgtaaagtatgatatcaaaagttaatacaggagaacgaatttagtgaataaaacattgagactcatgaaaccttgggactatttcattattactgcggtcattatggcatcattcgtaccatatttactatttgatactaataatgatgaaaataataatagggaaagtacagatgtaattgcagttgttaaaatagatggagaagttgtagacaaatttaacttatcacaagttaatgagtcttttgagaaaacatattaccctcaaaaagggaaatacaatattattgaagtagctcctggaaaaatcagggtaaaagaagataatagtcctgatcaaattgctgttcgtacaggctggattagtagaccaggggaaatgagtatatgtctgcctcataaattgattgttgaaattttaggagtagaggagaatcctttaatttattagtatgaactaataagtaccacgaatcctattatagagacatggacggagtaatctaaggaaagaccgttaactaaaatcgctaaaacctgtttacattattcttcatttaaggtggttacggaattttgcatatagaaagccatattagagctaacgagtttataaaatattaatagggatggtaggtgtcattacagtggataatacttatttaacagatgtgtttaatcaatataaattacgcgaaaatttactgtatcaaacttggtttatcaaaagtgaaaaacgtttgaaagcgtttaaaaaagttaggaaatacgtacaagtacttatcaaacatgtcaataacggaacgttcccaacagattttaaaaattcagccctagaggacataatgaatgtaattgcagaacaaacagaaatttttaaaggagccaagcatgcatttatgtggaaacctaaattgagaattccggatatttatgaaaatagggaaaatcagttagctttttcactttgtcttgatcaaattcttaaagctaatcaagaaattaaaatgttatttgctgtaaatattctagcagaaaagaaaatcagagggcttggtccagctgtcgcaaacattttatattttctagaacctaccattttccctccttttaacacagctattgtaaatggatataattatcttacgggctcgaaaattcgcttaggtaaatgggaggactattttaaactccgtgatggtatgattgaactcaactgcttaggaggacttttttcgaaagatttgggtgctatctcagcttttttatttgatattgggaaactaaattatattgttcgcgaaaatgaagaagagtatgtcagaatttcagaaagtaacacccagaaattaataaaacagaagttggaaaaagaggatggcaaaaatgtgcaccaaaaaatccaatatatcttagctactttaggtaatgagataggttatcatgcttggattgcctcaaacgatcataatagaattgtagatgggaatcgcttaggagatgtgtctatacctctattaccagaaacaatctatcaattaccaaatccgttaagtaggacgattggtttgattgatgttatttggttttcaaaaaatggggaaccgatatgtgcttttgaggttgaaaaatcgacgtcaataatttctgggatgaatcgaatggatgatttgtattcgattcatcaagaaaatttgatgatgtatattgtctcaccggatcaacgtgaagaggagatacgagcacaatttaatagaccacattatatgcgtaatcaaaatttgcatgatcacttacgatacattctatttacagatttagagaaacatgctaattttatgaagaaatttggcaaagattttacaattttagccccgatatctcattatccaagtggtgaactagttcggtagttattctggacaaagaagttgaaattaatacggttaattgtagtataaataagcatttgggcagaattggaaatcaatcttccctttttttacgagtagcttccacatttataatggcgctcattgctattgaatgtcttagcaacgtccagaagaaaatcatcatattaatgctgcccatgcttccattttagtaactttttgttgaagaaaattgcggatagagtgaatactatctattcataacctagaaatgttatctaaaaaggtattttccttatattcatcgaagataatggttttatttgcacttaaaaacgaaacaataaatcttacttctagaatcccctggtgtatggactaccccatacaccagggaatgttatgtactcttggtggaatgcaacgagtggatggaatgatgaggatcattttctttggtgtcagaaatacataaagaaagattataaaccacgcatgccttattcgttttataaagagtaaagttagactaaatattttgagagaatcaattctattctgaaccatgaatttagtgaattttaaagggactgtgacataagtccatagaagaaaaccgcaagaaatgacgagaaagcgttcatttcttgcggttttttgggtaaaataaaaaggagcaccggttcccgccaatgccccatcatttaatcctgaaaggactaaacaaaatgtatactaattataacatgaatcaactcactttggatctatctacttcattttctccaaaagaaaatcatgtcgccgtttttatccatgaactggtcgaagcgcttcagattaatgacccctatctttttggtcgaccaagagaatatgatttaggtgccatgatgaaggtggttctttttgcgtatacgcgagaaacctttacaagtcgcaagattgaacgcttagctgaagaaaacctatatgctcgctggttgacgcaagaacgggttccgacttatcgaactatcgcccgtttttgtgtatccaacgatgtacaggagttgaccaataaaggtttagatcagttgacagagtatctgcgtgcacggaatctgattgatgatgcgttgtttattgacgggaccaaaatcttggcggatgcgaataaatacagctttgtctggaagaaaaatacgatccggttcgatcaaatgaatcgcgaaaaattgcttactatgatgacggaactaagagaagcatatgccctgaaacagattcccgaagggacgaccttgaccgtagacatgatagatgaactgttaacacggatggaactgcatctggatgaactagaaaatgaagttgaggcaacgaagcgtctttcgccaaatccagcgaaacaacaacggcgaacgttgaaaagccaagtacgcaaactaaatgcaaagcgagaaaaacttctggaacatcaaacgcagttttctatttatgggactagaaacagttattcaaaaaccgatcatgatgcgacatttatgcgcgtaaaagaagaccacatgaaaaatggccaacttaaacctgcgtataacctgcagatcgctacatgtaatcaatttgtgctcggctacgatgtctttcaaaacccaacagacactaaaacactgaaaccattactggaaaaaatgaagactgcacaaaagtcccctcattatttggtcgccgatgcaggttatggttcagaaagcaattaccgctatatagaagatgaacttcctcagcatactgcactgattccttatggaacgatgtttaaagaacaaagtaagaaatggcagacagatgaccggaaagtaatgaattgggtttacgagcccaatgaggacttttacatcgaccccaaaggggtacgattcaattttcatgcctaccgtcaacgaacagatgcggatggctttgtccgagattttaaagaataccaagcagaaaaaacggatgcgaaccaagcgctcattcctgaagccttaaccccaaaggggaatcgtagaaagatcactgtaaatccgtcttgggagtatcataaagaaaaacaaaaagaacggttatcaacgcctgacattcaaaaaatatatgggcggagaaaagtcgacgtggaaacagtcttcggatttatgcaggcttgttcgggcttcactcgctacacggttcgaggcttagagaaagtcagaaaacagacgggtttactcattacggcaatcaatatgatgaaattgacaaaaataggaacttgaactactcaaaatgaataaaaaaacaagaagcactcgaaaaatctcatgatttccaagtgctccttgttttttggagagcgtaactaggtaacttatgtcacgcctcctttaacttattttaaccttgacttcaaatcgcttagttcactacttaagatatcattttgctcttttaaattttcaagatcctgtttcaattgttcgtcatctttttcattatgcgatcctgagtgcatacccctcatcataaatatcatcattatcggacataataaaagtaataaccactgcattgtcatcgatccttaactaagttctttagagtagcaacttcttcttttaattgctcagtttggatttttaaacttgctatatcattttcggaaccagtgtgttttgaatgatcttctccatgcatatgatgatgcccagcatgtccgtgccctttatgcataaacatcattgagatagggcaaattagtagtaatagtagtggtaagagattaagtaatgcttccatgtaaatcttcctccttagattttttgagatagatgtaagttaatatagagccaattaataggactatggacaggacttgagccattctcaagtttgctgttagcattaaactgtcggtccgtaatccttcaatccagaatctcccgacggaatatagtgaaacataaattaaaaatatttgcccaaagaacattctatttctagacaccagaagcaaaataatgagtactcctatattccataaagactcatataaaaaagtcggatgatggtaggccccatcaatatacatttgatcaattatgaaagatgggagtttcagagattgcaggaactctatgtctacaatttctccataggcctcttgattcataaaatttccccatcgtccaatgatttgtccaattactatactgggagcaactacgtcagcaacattccaaaaagaaagatttttcttcttgcaataaataacccctgtcaatacagcaccaattaatccaccatgtattgctagaccaccttcccaaatttttaagatacttaaaggatcatcaatgtacaaaggtaattcaaaaagtacatagtataatctggccgatataatagaaactggcaatccatataacaacagatcaacaattgtatcctcaggcaatgccgcacgctttgctcttctattagcaacaaaatatccgattatgatcccaaacactatgaaaatggcataccaataaatagtaaatggaccaaacgaaataaatactctgtcgtagggttctctcaaattctttcctccttcctaatgaacttgttttgactatagcaggctattatggaaattttatgtagactttttgacagatacattggtacacattttctacacaagtttttttatcattatattaaaaggagtgatctaatataaatattaatttaatgaaaaaaagcatgctatttctattattttttgtctttgctttatccctcgcgattacattgacaagcaacttccctggtttgctcaaaatcaatttattctttcaaagcgatataaattttcaaaactggagtagatctcaagttaatcaagattttagaaatttaatgggctatttaaataatccttttcaaaaagaattggtttttgataatctatacgtctcagatcgcggtataaaccattttaaagatgttaaatttttgttccagcttaactattcattgcttctttctacgagtagcgttcttttatacctaaacaggaaaaaattagtaacgcgtgatcaagtcagagaaatcactagtttaatcaagtggatgataatatcagtctgtgtaatggcacttctgttttttgataaagcatttgtgctttttcatcaagtattttttgacaatgatgattggatgtttgactatcgtacagatccaattatcagttttttaccggaaacatttttctttttatgctttttattaattgtaactataagtgtttctactttgacaacaattcatcatttgtttaataaagaagaacgtactttatgaatagcctaaggagggatggtcttggtcgaacacaaaatacaggtatcgaattcagagttagatgttttaaagtttatctggagatatgaaccggtaacatgtggtttaataacacatggaatgcaagagcgtaatagttggcatccctccacaacaaaaacgttaataagaaggttgttagataaaaatgtgatcacgtttaacacttcaaaaaaccaaagatactacacttcactgattaagaagcaagaatttttagaaaccgaaatacaaaggttactttctggaatggatgaaggttgtatctcagaagtaagctactatttaaacggattggttaaacgttctgacacggaggaattcaatgatttcaaaatataatctttatggaatgacttgtgcagtttgcgcaacaacaatagagaaaaaaattcatgagttggatggagtatatttcgctaaagttaacttaacaactgaggttctaaaattggaatatgatgaaggtgttttgtctaatcatacagttataacagctattcaagacattggttatgacgctgagattcgaaaaaaaactgagataaaggtatttggaataagtggaatgacttgtgtgtcctgcgctaacaaaattgaaaatgtagttaaatcaatgacttatgtcaaatatgccaacgtaaattttgaagcagaaaaactctcggtaatatcaactgacccttcagcggttgcaaaaataagtgatgttgtcaaaattcttggatatcagctatatgctctttctgaagatgaggaacaagtaatatataaaacaaaagaacaagagcaacagcaacagaagctaaggcgaagatttatcacgtcaatgctatttacaattcctattatatatgttgctagtgcaaatatacttgagttacccctatttgaaataattgatcctacgacaaaccctagttttttttcgatgacgcaattaatacttaccgctccggttatattggccaataaagactattataaaattggattttcctcactcatgaaaaaacatccgaaaatggacacattaattgctttaggtacaagtattgctttgttatacggcatctttgcaacaatacagattatattgggaaattatctctatacaaaagagctctactttggagcatcagcagtgatattaacgttaatcagactagagaaatacctagagttggtgacgaaagataagacatctgaagcaatacaaaaattaatgaggatgactcccaaaacagcgaaaactatcagacataataaggaacagactgttcctattgaatcagttttagtaggagatgtgatcatagcaaaaccaggagagcgtttgccactggatggtattgtaataagtggtaagtctttagttgatgaatctatgcctacaggtgaaaatcttcctgttgaaaagaaagctaatgaccgagtaataggacccagtaaaaataaaaatggcgtaataagatatgaaacaactcatattggtaaagacaccactttagctcaaataagcaaactagtggatgatgcacaatcttcgaaagctccaatcgaaaaactggctgatatcatttcaagttactttgtatatatcattattgtagttgcgattggatctagtctactttgggtgctatctggacaaagtatttcgttttcattctcagtcttaatttcagttttagttataacatgtccttgtgcattcggtttagctacacggacagctattatggtcggtatgggaaaaggcgctgaaaatggtatcttaattaaaagtggtgaagctatagaaacaactcatcacgtaaaaacaatattattcgataaaactggtacgattacaaaaggaaaacctgtggtaacagatataatacttgcagaaaatatggatagaaactttctcttgtttttagcggcctctgctgaaaaagcatccgagcatccgcttggggaggcaattgtaaaagaagccgaaatcgtggggattgatctggttgaacctagtatattcgaatctttctctggattgggcgttaatgctatattgaaaggtaccgaagtaagtttaggaaatgaagagttctttaagcagttgaatatagacattagtaaatttaagttaatttcagataatttagtatctaaaggaaagacaccagtgtatattgcaaatgatcgtatctttctcggaataattgcgattgaagacactataaagccagcaagtgcattagcaattcaaaagttgaataaacttggcctcaatgtggttatgctcacgggtgataataaacttactgcacaggcaatagctaatcaagttgggatcaccaacgttattagtgaggtattacctcaagaaaaggcctactatgttaaaatgttgcagtcaaaagaacatagggttgcaatggtaggtaatgggataaacgatgcacttgccctcgctcaagcggatataggttttgtgatgggttctggtactgatatagcgatggaatctgcggatataatattgatgaacgacgatctgcaattgctaatgtccacgattgatttaagcaaaaaaacaatttggaatataaagtcaaatttgtactgggcatttgcttataacatgttaagtgttccaatagcgatgggtgttttgaacattttttggaggcctttattaagcccgttaattgcaggagttgctatgagttttagctcaataacagtacttttaaattcacttcgcttaaaaaacttcaaagtcaaataggaaaggtgattgtcttatgactgaacatttacagcccttatttattagtggaatggcttgtctaggatgcgccggagaaattaagtatgcattagaaaagaatccctcaatttctgttaggaaagtaaatctcgaagaaggtttagtaactattgcaacaaagacagatttatcaattagcgttattaatcaattgttgaaaaatacgaattataaggcattataaatttggtgaatcatcacattaaatatgtgaattcttatggtaagaaagttcctctatattctacttttttcaaattgagatatatagaaaaaccagttttttaaatttattcactgctttttgtgcataagtatatgttgaatccaatggacggatttctgagaggcatttcatgtttttttgaactcaaaaatcctttggaatcccaatgtaggtttttggtattagttgaaatggattttcacttggtagtagaggagggtagagaggattgtgaaattcttatgtagaacaattatttatttgaataggaggaagaactatccaaaatagcagttctaaacttatatttcatattaggatgcttatcgaatatcatcatagcacttctacctgttaggatattcatgaaactcgaaacctatgttttgggcgcgatacttagcgatatatgtccatgatatgcaatcatacactaaacaaatcaatctgtatctatcctatatttaaaagctctaaaacaaactctatacatggtttctccataaattttccttatgatacttgtaagacaattcttaaaagattgattagattagtaaatccaatataggcgacttttttaagaaagaaggaattttatgatgaaatatttgcaaatagtggttattgacggaatgaattgctcaaggtgtgcatcaaaagtaagaaatgctttggaagcagagccaacagtcagtgtaaaaatagttgatttggctagaggtacagttactttcgatgctgattcaaaattaactttaacattcttaaatcaactactaaaaaatacaaagtatactgtaactagggatatatctatataagtataagtatatgtgggggaatcaacacaaaatctccacatattttttttatggtaactacataatagatatgggagatgatgggttgaagaataataaatatatttggttatcagcaacaatatcaatgttgaccctaggcggtgttttcatattgattcaacagcagaacaaggaggagcatgctgaagttgtctttcaagaagaacaacgacaaatctcaagtagaatgtccaatatgatgggggataatcaagaagctgatttgaaggtagtacaccaaacggagagacaactattgattccccctgttcttgaaccatcttcaaaaagcaaagaaaatgtgatatatgatatagttgctcaaaacggagaagttcaaataatggatggagaaaaaactgaaacattaggctataacggggattttttaggaccagttattagactgaaaaaaggtcaaaaagttactatcaatacaaacaataatcttgatgctagcacatcttttcattggcacggtttgaaagtagcttctgatgcagatggaggtccacatcagattatagaagcaggacagaaaaaaagtgtaacattcgaggttgatcaagaagcttctacactctggtttcatccccatccggaaggagaaacagcatctcaagtttataagggtttagcaggtttgatgtatattgatgatgacaactcaaaatcattagatttaccttccaaatatggtgtcgacgacattcccttgattgtgcaagataaatctttcagctccactaatcaaattaactatgaaaatgattttaactctgatggaacaaaaggggagacgttgcttactaatggcactatcaatccatatattgagataaaaaaccgatggatgaggtatagaattgttaatggatctaattcaagaaacttcacttttactttggataaagatgaatcattctaccaaattgctacagatggtggttttctgaatacttctgttaaacttagtaaactacttttagcccccggggaaagggcagaaatattagtggatactcagaattataaaaaaggtgaggtaattcatttactagcaaataatttggttgccttgacaatgagaattgagaatacgatagaaaacaaagagtttactccctctgatagtctaaatactattagtactttagatgaaaagaaattggaagatttagcaagacaaagtattaatttaagaggaatgtctcacatggtaaacatcaacaataagcaatttgatatggaaagaatagatttatataaaaaattaggtactcaagagatttgggaagttaacaatattagtagtatgatgggaggcatgattcatccgttccatatccatggtgttcagtttcaaattttatctagagatggaaatcagcccgcactaaacgagcaaggatggaaagatactgtgctggtaaatccggatgaaacagtagaacttcttgtgaaattcgaccgtgaaggtattttcatgtatcattgtcatatattagaacatgaagagtatggaatgatgggacaaatggaaattaaatagaaaataatttaagaaggatgattgtctatgaaaattcttattgtggacgatgaagaaaaaatattagaaattattgatgcctatctagttgctaatcattattcagtttataaagcaataagtggcgcaatggcattggaaaagttcgagaaaaataatcctgatttagttgtgttagatttaatgcttccggatactgatggattgactgtgtgtagaaaaatcagagaagtatcaaatgtaccaattataatgttaacagctaagtctgatgaggatgatattcttactggtctcaagttaggtgccgatgactatatgattaaaccatttagtcccaaagaattagttgcgagaatacaaactgtattgcgcagaactgagaccttatcaaatcctaataagctttcttcaagtaatggggaattgatagtatatcctgaaagtcgccaagtttatctacatcaagtggaattaaacctcacaacaactgaatttgatattctacacgccctaatatccacacctaataaagtcttttctcgtagtgatttgatagagaaagttaagggaatagaatttgatggactagataggagcatcgattctcatataaaaaacttaagacataaaattgagaatgatgctaaatcacctatgtatattttgacagtccatggtacaggatatagatttggtggccactaatgagaaaaagaacgataaaaactcaattagttctttcctttttagcaatcgcaacattaataataggatcgattagtttagtcgcattaagtttgacgaacaatcattttagtaaatacgtagaagagcgacaagaagatttgttgaatcagtatgtatatacaattgatttattgtggttaaatagtggagaaacatggaacagcgaggaacttgcagcactttctgagaaagcattagaaaataatatttatttttctatagaagacgaacaaggcaacatggtttgggaacttaaaggaaaaaatttgaagtcagcacaggacaaactgaaaaaaaatgccttgaaagtttctgagaaaaaaagtgtgaaactagacgaaacaatagaagcgaaaaagaagttaattaatgatggaaacgagtttggaaaagtaacgttttattatttcggaccttttgcttatactgagcacgatgccttgtttatctccagtatgaaacaaagtttaatgtatgttgctattgcagctcttcttgtatcatttatacttgcttcgtggatctctgctagattaggattaccactaaagcatgtaagcgactttacacataaattaacccgtggggaatatgctgataaaatcccacaagaaacttcaattattgaaattaattccttgattgattccctaaatgatttaagtaatcagttggagaaacagcatggacttcgaaaaagattaactactgatatttcacatgaattaagaactccattagctacccttaaaggcaatgtggaaggaatgattgacggagtctggaaaataactcccgagcgcctacaatcttgttatgatgaaatagatcgtctaactcgtttaattggaaatatagaagtaatcaacaaaattgaagcaaaatatgatcatttaaataaaactgagtttaacatatataagttgattgaatccgttattgaaaatttcgccagcaaaattgagtcaaaaaaccttcatgttgaaatccaaggggataacatcaatatatctgcagataaagataaaatgaaccaagttgttatcaatcttttgaataatgctattaaatttacgcaaaaggagggaaccattaagttttctataagtaaaaataaagaccatgttcttttaattgttgaagacaacggcatcggtatagaaaaagatcagcaacttcatatttttgatagattttatatggctgacccctccagaagtagagctttaggggggcaaggtatcggattagctattgtaaagagcgttattgaagcgcataaaggtagtataactgtaaaaagtaaattaggtctaggaactaaatttgttataaagttaccatttcaataaaggaggagagttatttgtttcaaaaacagataaaaattgctaaactagtatgtgaatgttgggcaaaaaaaatattttttcaactgatttcgatagatagtgtcgaaaaagttcatttagatatcttatcaaattctgtagtaatcttttctaagaaggacttatcaatagctacaattaaaaaagaagtttttggattacaaatttatgagatgacctaaatgtgattaattaaaggaggatgaagacagtgaaaaagatgacaaaattagtatttgcaagtcttggaattattgtatttttaggagcgtgtagcaatcaaagtgaatcgaataattctaaaagcacaaacgaggaatcgacttctacagcgtctagtgaaatgaatagtatggagggaatgaatcacgaaggtatggttccttcttcaatgaaagatgctgcgaaccctaaattcccggtgggaagtaatgttatactgctaggcgatcatatggaggggatgaaaggtgcaaatgctcaagttgtaggggcctttgatactacaatgtatgaagtaagctatgagccaaaaactgggggaccaatggttaacaatcatcgatgggtagtacaagaagagttaaaagatactgagactgtagcaaatgagggcgatactgttatcttgaatgccgatcacatggatgggatgatgggagctgaagcaaaagtagataaatctattacaggaactgtttacgttgttaattacactccaaccgatggtcaagaagaagttaagaatcatatgtgggtaactgaagatgagatggaatatgacgaaaataatgagtaattttatatactaaaccaataagctggtacatggccttcgtattctcaacatgaggaatatgagctctttgttaataaggactgatgagttgtgcaaaatcaaatctgggtcagaacgaacctcattctggctcagatttttggctcttcgacatttagtgctggtagagagacaactgaaaatttagtcataaccagttaggcagagtgcttaactggtttttgttttacttggaagatcaagccttgaatgagataaattcttgctcgaaagttgtggaaatttcgatagccgtaggctactcgttttatcacttttatcttattatttgttctttccaatgcaccattactatacctgggttttaaagcatattgaatccctaatttgtatttatttaaaaacgtcagcttcttacaaaaccattgtggaaggcattgatctaagctgttgatcgtatcgaaaaaactttggttgtccttgtgtttaaagtgatagaggaggagctggcaagtctcgtaagccctggttaattgctcgtcgtaactcaaaagctcatcgaccatcgctttttgcgtcattggtctgcgaaaggatcgatcatattgataatcggaactatccagatcataggcatgcgtaaggagtaatttccagaatcgcttcaatcgtcaatactttgtcggttccgttttttgaaacctgttcattgttttgattcgcaactgatttaacgtacgagtgatttgttggacaatgtgaaagcgatcggtcacgattttggcgtttgggaagaccgcttttacaagttcaaaataaggggcattcatatccatcacgacgtatttcacgttcgctcgtgcttttctagtgaatttaaggaaatatggttttaagaaagcaaggcgacgattctccaatacaccgattaattgctgggtctgcccattcataaaaacaaaactcatttttccactgcaggacttcatcgatttgaactcatcaaaacaaaggaccgaaggtaacgtatcaaaacgaggatgatacgtttttaaacaggtgtgcaggacacgcagaacggttacgtcagagacaaaatagcgatcggcaatttcttttcttgttgtattcttcgccagctccaaggcaatttgtacctttaattcctttgagagatagcagttttcatctaccaaattggtctgagcgttgaatgtcgactgacattctttacagtaaaagcgcgtacgtaccaagcgtaattctgttttggttgctcgataaggcaaaagttggacttttgttttatgtgagccattcttgatgatttgtccttcatttttgatgccacatttacggcaatggcttagtatatagctaagtttagcatggataagattggtgcgaaaaccatcttcttctactgtctctaaccattcttcttcgaagaataaattttcatctgttaaacctaacaattttctagtacaatgatacatggagatatcctttcttggtatggttttgttttagacgactaaattccaccagttaggctatctctttttctatctttttttacaaaaaaagtgtcagtagaaaatctgtagattttccaccaacactaaatattgtagaatcaaaaatcagaactacatccagtagttctgatttttggttctcttattgtatgcctagtatttaagactctgattcaaattttgaaaaaggaaaattactattataattaaaagcgtcacttttgtatattacaaatactaactattatctataagtgtctcactattttttggcaagcgcacatagttcaataatagtgagctcaaaacaacagtaattgagctaagtgccattgcaagaccagctaactctggagatagtgtaaatccaagtgctgagaatatacccgctgcgactggaatacctatcacgttatatatgaaagcccaaaataagttaatcaaaatccgactatatgtttttcgtgctaatactaaagaagttacaacatccatcaaatcatttttgactagtacaatacctccagattcaattgcaatatcactccccgatcccatagcaatacctactgttgccgtggataatgcaggggcatcattgattccatcacctacaaaggcgactgctcctttttcttgcaactttctaatatgttgtgctttgtccccaggcataacatctgctatgacctcgtcaatcccaatatcatctgctatggcttgtgcgaccaaacgattgtccccagttaacattacagtgtgaaatcctgatttttgcattgccctgatagcagctttagagctggacttaggtgcatcttgaatcccaattaaagcaattatttgaccatcgtaaccaactaataccatagttttcgcctgcgcctgtaaagatgtcattttaaccttaagatcatctgtcatgttaaagtcatcggataaacgatcattaccaataaaagcctgcttaccatcaatcaaagcttgtacccctttaccagaaatagcagtgaaatttttagctacggcaggagtaattttcttgtcctttgcttcattaattactgctaaagctaatgggtgttctgatgaatcctcaagtccagcagcgattcgcagaatctcgttctcactaattcttccgatagagataatatcggtcacttgtggtttgccaacagtaattgttccagtcttatccatgacgacggtttttatatcgtgggtcgcttcaagaacctcagcatttttggttctgttgcaaagttttccaaaaaatctattttagtgtaaaattgagaaaaaagacagagaggacagagtaatgaatcattttaaaggcaaacaattcaaaaaagacgtcattattgtcgctgttggttactacctgcgttacaatctaagctatcgttaagttcaggaattgttatatgatcgtggaataaatgtttgtcatactacgatttatcgttgggtacaagagtacagcaaagtcctctattatctttggaagaagaaaaatagacaatccttctattcatggaaaatggacgaaacctatatcaaaattaagggacgttggcattatctttatcgtgcaattgatgcggacggcttaaccttagatatctggttacgaaagaaacgggatacgcaagcagcctatgctttcttaaaacgactccataaacagtttggtgagccgaaagcaattgtgaccgataaagcaccttctcttggctccgcctttagaaagttacagagtgtgggtttatatactaagacagagcaccgaactgtgaagtatcttaacaatttaatagaacaagaccatcgacctattaaacgacgaaataaattttatcaaagtctccgtacagcctcttccacgattaagggcatggagaccattcgaggaatatataaaaagaaccgaagaaatggaacgctcttcggcttttcggtgtctactgaaatcaaggtattaatgggaataacagcctaagatatttggagttcagagagggcgcgtttgattttcaaacttcgcaacagaaccccataatttaaacacctttcttctaaataaaaatctcttcttttctgagctattcgtaatcaaaacaagcaactattgagtatttgctatctgttcattcggtaaaatagtaaactgataggtcgtatggttgaccttttcttgaccagggtacaaagcgatcgaaccgagttcaggtaaatggactagatccggaaattcttgtggctcgatggctaaaccatagtttgaatgcatatgtttcccgttgatcataaaatcagcttcaaaaccagtcgtagaaaataataccacacttttatttgttgttgctatagacaactggcgtccagattgtttttctgaaagacacagcaccttttttgaacgtttcggtgtagtaagaacaaaaacgtcatcaagtccttctggataagcgttgagaatttcttcgattgtatgtggtttcttgaaattgatcggtaaatccgcttgagtgatttgttcgcctgttggtagtttatcttcatctaataccaatagactttctgcttggacagccagttcatgtgtatcaatgtcacgtttaccattcccagaaaggttgaaataggcatgattggttggattgcagatcgtctcgacgggactgttcgtttttgtgatcatttccaggctattcgcagttagctgatacgtgatcgttgctgtgataggaccaggataatcggaaaaagtgtcttgtaaataaaagacaacgccgatcgactgtggatttttgaacacttcgacatcccaatattggaaagaccatccatttgttcctccgtggatatggtggttgccggcgtttttttcaagttgatgatttccccatgtagcatttcggattctgcctgctacgggaccgactgtggctccaaagaaactttcatcggttaaaacatctgaaagttcatcataagaaagtaagacgttttctaaatgtcctttgttatctggagcaaagatttggtgaagtctagcgccataatttagaagaacgacggtcaattcgtcgttcttcaatgtgattttttttaattcagtgttggggatagaagtcactgaaatagaaggttcaggcatttggctgccacgtttttttcaagtaatcgaaagtcaatgaagctgtatcaggtacgattggaatatcctccccaagatcttctgaacgtcctacgccgataggttgcgcaccactagcaatgatcgcagcgattccagcttttgcatcctcgattccgatgcagtcacgaggggtcaaaccgatttctttcgcagcaagtagaaaaatatctggtgcaggctttccattagcgacttttgccggatcagcaatcgcatcaaagtagctttctagacccatcttggcaagtaggaaagggccatttttgcttgcagatgctagtgaaatcttgatattgtttgcccgtaagtcttttaataattctaaaatccctggaaaaacatcttttggtgtgatcgattggatcatttcaagataatactcattttttcttttcgctaattcgagaaattctgtttttgagaattgctcttctttttttccgtgagcaagaaggagagtcagagaatcttctctgcttacacccttcaattgttcgttgaatgaccgatctaagggaataccgatctcatcacctagctttttccaagcacggtaatggaattcagcggtatctgtaatgaccccatctaagtcgaataatacacctttaaacattcgcttcaccttctcgtaatggaatagtcaaatgatcagtaaggacatacgctttttcgtagacttctagcggtaatgcttcgccagataagaggttcaatgttacctgttcatttgaaacggcgacaaataacaagcggtcgcgataattgatatggaatgaataagcagaccatgttttaggcaagaatggtgcaaatcttaattgttcatgatctgtcttcatttgcgcgaatccttgtacgatagcaagccaacttccagtcattgaagtgatgtgtaagccatcctctgtatcattgttatagttatctaaatctaaacgagcagtgcgttgatacatttcaacggctttatcttccatgcctagttcagcagctaagatagcatggatactaggagatagggaagactcgtggacagtcattggctcgtaaaaatcaaagttgcgttgtttttcttcttttgtaaatgaatcattgaagaagtagataccttgtaaaacgtctgcttgtttaatgaagcaagaacgaaggatcttgtcccatgaccaatgctgattcaatggcaattcacttgcagatagttccgctgctggtttgagatccttgtctaagaaagtatcgtgttggacaaaaatccctaattcttcatctactgggaagtacatattttcagcaatttcttgccaatgtgccaattcatcgtcgctgattttagcagtgctctcttctttgaacttcaaataattttctcgtgtgtaacgtagtacccaacaagcaatcgtattcgtgtaccaattgttgttgatattattctcatattcgttcggtcctgtaaccccgtggatcatatattgattgtttcgtttagaaaaatggactcggtctgcccaaaagcgagcgatttctgctaagacttctaaaccttcattttttaaatagtcgatgtcgccagtgtagttagtataattataaatagcgtaggcaattgcgccatttcgatggatttcttcaaaggtgatttcccattcattgtggcattcgacacctgtgaaagtgaccattggatataacgcgccctttagcccttgctgttgtgcattatggattgcttgtggcaattggttatggcggtacttcaagagattcttagtgacttcaggtttcgctaaagcgaggtacagaggcactgcataggcttcagtatcccagtaagttgcaccaccatatttttcgccagtgaagccttttggtccaatattcaaacgttcatcttcgccataataagtagaaaatagctggaagaggttgaaacggattccttgttgtgcttcatcgtctccttcaatgactacatctgccaattcccatcgtttagaccaagcggctgtttgctcctcttttgcttggggatagtgaacgttcaattcgttgaattctttaaagagatgtgtcgcttgttgcgcttcagggatatctcggcttgtgaaaatcaatacttctttgtcgataagaagtgtttcattttcatttaagtcaaaggtgaatgaaccttcgattgctaaggtgccctcttggtagcttggcgtatataattttccatcaacgtagtggcgcatcccagcggtcactgtaaattgttcgatctcaaaattattcgggatcgttttagtcgttaagtacgctatttcttccttgacgccatgatcgatgtcattccaaaagtgttcatcgtaattgctgtcttcgttttggacattgccatctagcttagaaataacttttacagttccatttccttccaacatttcaatggttaagcgaatataagcggcttcatttttgacaatacttaaaaagcgctcgaatgaaagacgaactttgtttgatgaggtagtgactgtataactacgtgtcaaaacaccgtttttcatgtttaattcccaataaaaatcttcagtagtaagtgtagctagatcaatcagctgatcatcgataaaaagatccatagcgataaaatcgactgcattgattacttttccaaaatattcaggatagccgtttttccaccagccaacacgtgttttgtcagggtaccaaacacctgctaaataggttccttggtgatgatcaccagaatatgcttcttcaaaatttccgcgcatacccatatatccgttaccgatactggtcaatgattcttgcaagcgtaaattttctttatctaatttattcgtgctgattttccaagggtcgatctgaaataaccgtttaatttgtttcattgttctcctcctagacgttgtcgtttatacgtccataataaacgcaaccgattgcgtaagtcaactagaaaagtgaaattaaattttgaagtggatgaaaaaacaaaacaaaagcgattgtatcaatatttactactataatatgaacagaaataatgtataaagaacgattgggtacttacagaaaaagcataaaaatacgaaataaagcatttacaaaaaaagaaatacacgctataataactaacaacgaaaccgattgcacaaaggagacgaggaaatgaaaaaaatatttagatttgagttttggcaaaaatttggaaaggctttaatggtcgttgtggcagttatgccagcggcaggtttgatgatcagtatcggtaaatcgattccgttgatcaatcctgatcttgcacctttagttacaacgggtggcgtgatcgaaaatattggttgggcaattatcggaaatttacatcttttatttgcactagcgataggtggtagttgggcaaaagaacgagcagggggagcattcgctgcggggatctcatttatattgatcaatcggatcacaggagcaatttttggtgtgactaatgagatgttggcaaatgaagacgcatttacgcataccttgtttggcacgaaaatcatggttaaagggttctttaccagtgtattagaagcaccagcactaaatatgggggtatttgttgggattattgcagggttcgttggggcgatggcctataataaatattacaattatcgtaaattacctgacgcattatcgttctttaatggaaaaagatttgttccttttgtagttattttgtggtcaacgattgttgcattgattcttgctattgtatggccgaatgtccaagcagggatcaataactttggattgtggattgcagagtcaaaagaaagcgctccgattttagcaccattcctatatggtacattggaacgtctattgttaccatttggcttacatcacatgttgacgatcccaatcaattatacgcagctgggtggtacctatgagatattatctggtgcgcaagcgggaacacaagtatttggacaagatcctttatggttggcgtgggcgactgatttggtcaacttgaaaggcgccggcgacatgtcgcaatatgaattcgtattgacgaactggacacctgctcgttttaaagtgggacaaatgattggttcttccggtatcttgatgggattaacactagcgatgtaccgtaatgttgatccagacaaaaagtctaaatataaatcaatgtatttttcagcagcacttgcagttttcttaacaggtgtaaccgaaccattagagttcatgttcatgtttgcagctgtacctctttacattgtttattctgtgatccaaggggcagcttttgcaatggcagatattctacctttacgtgtccattcatttgggaacattgaactattgacacgtacaccattagcgatcaaagcaggattaggtatcgacttgctcaattttgttatctgtgtcatattatttggagtattgacgtattttgtggcaaactttttgatcaaaaaattcaattatgctacaccaggacgtaatgggaactatgataacgacagtgaagaaacgccgtcaggttctgcaactaatgcagatcaacaaatcattaagatcatccatttgttaggtggaaaagaaaacatcaaggatgtagatgcttgtatgactcgtttacgtgtcagcgtcgaggatcctgggaaagtcggttcagaagaagaatggaaacgtgctggagcgatgggcttgatcgttaaggacaaaggtgtgcaagccgtgtatggaccaaaagcggatgtgttgaaatcggatattgaagatttactacaatcaggcgctgatattccagagccaacagttgaggcaacaaataaaaatgagaagaatgaagagaaacatgttttaggtatcgaaaaagaattattcactgtagcaactggtgaggtaattgctttaacagatgtgaatgatccagtcttttcacaaaagatgatgggtgatggctttgctgtcattcctgccactggagaagtgacggcaccactttctggtaaaatcgtgagtgtcttcccaaccaagcatgcaattggcatgcaaacagcagaaggagcagaagttttgatccatatgggactggatactgttcatatgagccagccagcgtttgagatcttagtttctgaaggccaagaagtagtagcaggaacaacgattgctcagatgaatctagatgcaatcaagaacgaagggaaagaaacgacgatcatagtagtctttacagatgacaaagtcaatgggctgaccatcaataaattaggagacactgaacgaggaacagtgatcgggaaaataaacttgtaaagaatcacagaagttcatgtgtgtatttcatatcgaaagaatgtgttcgatgtgtgtaactcctagaagtaagccgataatcccgaaattgcttttcctatttcagggattattggcttattttttgaataaactactttggggtctttacctatatggatccagaaggtgggagcaatgtttcgacccatcccattaagaaggagaattatatgaaaataatgacgttgaatacgcatagctggttagaagaggaaccacaagaaaaattaaaacagatcgctcaaaaaatctgtcatgaacaatatgatgtgatcgcattgcaagaagtcaatcaaacgatggacgcaaaaggactaaccagtgagcagctgaagaattttagtcaggtgcaggaacaaacgcctgtccgctcggataactttgcctattgcttgatccagctcttagcagaacaaggtgaaacttactattggagttgggaaatgagtcatatcggctatgctatctatgaggaaggcaatgcgcttctttccaaacaaccactaactagtcaaacgcacctagtctccgaaacaaaagaaaaagaggattaccatactcgaaaaatattagtaggtcaaacctctgtcaaaacacaatgtattactgtagcaagttgtcatttttcttggtgggtagatgaaaaaagcggatttgcatttgagtggaaagaattagaagcaagtttagcgcctcttacaacaccactgtatctattaggggatttcaacaatcctgctgaaggcagcgggtacgatttagtggcaaaaagtcagttgcctattcgtgatgcttatccaatcgcgcaaaaaaaacaagctgaagcaacgatcgaaaagagaatcgatggctgggaaaacaataaagaggggctacgtatcgactatatttatgtaccacaagattgctttgttacaagttatcaacgtatttttgacggggaaaatggcccgattgtcagtgatcattatggggtagcagtcacgttggagtgaagagaaacgaaggaatattgtcacaataagaatatgggacaaatctaaaaaccaggtttgctacagactctcgaataaacgacgggagcagaagcaactccttcttaaataagccgaaatgaacaaaaatttgaaaagcaattttcgttcatttcttcttatttctcagagttaaacacttctgtcctaacctctctcaaataaacgacgtccgaaaggcaggtttttcggaaatttaaaaaaaacgagcaatacaaaaaatgtattgttcgttttttctctaatttctcataaacgatttttgtctcgacctcatttttttatgaatgtatccgacttctaataaacatgatgaataaaatcagccaaccaatgaaggtcaacccgatgatgaaataaaagaagagcggcaagtcataatataaggtgatctcattgataccattatgctgtttgacgattggcgtaccgatgtctgtcaattcatatactatgtatatagttaagctttatataatggaactgtatattaagaggagtgtctttatatgattagaaatccatatttacctttaactgaaacaactttttatattctgctagttttaactacacctgctcatggatatgctattattcaagaaattgataagttaagcgagggatcagttaaggtagctgctggaactatgtacggagcgattgaaaatttacttaaacttaattggatagaagaaattccaagtagggaaaaaagaagaagagtttacaaaattactgatctgggagaagaagttttaagactagaaatagaacgtctaggaagtttgattaagctatcttctgattttggatattaggaggagataacatgaaaaaatttagaattttcttatccttaaaaaaagaagaagaatggattaattctatacaagaagaaggttataggttagttcagtggtgcctatatatacttttgaaaaattggctagtaaagaaacgtttattccttatgtgcgccttgattttagagaaaaaagtatgggaaaaataaaatatgaagattatgtaacattgttttctgatagtggttggaaactaataaagggaagtcgttctggtggcgctcagtattttcagcaagaatatcctgatgtaacaagggacatattttctgacactgattctcaagaaagtgtaaagaaaagatatgtaaaatatggttatacttatggaactctatttttattgtatttctttattttttttagtagtaattcttggaatttggataagatattgaactttaaatcatggtattttacccaaggtttatgggaaatggagggtatgtggttttggaaagcgttcatttttgaaactccgtttgttttactccatgtattaccgttatttttctttctgtttttgggtatctattatcttttacgttcacttataaatgatgattcaacagtgataacaaaatattttacactctcctaattatgggaaagaaggtctaataatacatgatgttttgaatgcatttcctcttcataatgatttaaatactattgcgatgaagattgcggtaattgatgtaacaaattcaacacatctttctcaatataagagcaggttgtctttatatgatttggctaaagtaattctggagattccaaattttgatgatcggttggcaaaaggagatcctcagttgataaatattatcgcaaggaacattggtgcagttaatatgttctcatttgcatccaagtactgtacatatcataatgtggaagtgtgtgggagagatgattactccatctttgatggtatcgttaaaaatactcttccacactatatccaaggactaactacgaataagattgatacgtggcgaagaagttttgattacgaggcatttaacgaatgtgttggaaaactacttgatgaaaataatatacatattccttttagaagaagaaagttagatcacttcttgtggtatgcgaataggtagaatataagaaaaaggcatcgtaaaagtgattctggataaaattaatgggggaggaaataatagtgggattatttgattttctaaagaaaaaacaaggaaaggttagtaaacacgttgattatcaactggcttctagtctatttcgtactggtaaagtttttgctgaaaaattggaagtggacatatcaaatgtagatgagtttcgtaaaacttttatcgcttttgatgtggaaacaactggcctaaattcttcttcagatagaattgtagagattggtgcggtgctatttaaagaaggagttccaattcaatcattcggaactcttgtcaatccaaaagttagaattgcagcctcagcttcggcaataaataatataactaatgaaatgctaaactctgctccaaatgagcaggaagtttacccccagttggtagaatttttaggagatgcactagatggaaaaatcactatgtgtgcacacaatgcaagtttcgattttggatttttaagtaacacattttctagacttgggtatgatgctaaaattaagtatgttgatactctgagtctctctagaaaacatataaaaggcattgtaaatcataagcaagagactgtagcggaatatttcggattaataaatgacactgcccatagagcggaatcagatgcagatatatgcggaaagattttttggggtgttttagatattattgaggagtcgttggaagaacaaaaaaagcaaatagaaaagatgactccagacataaaagaacttgaagtttgtgcttttattcaagatattattgagaaaaaaggatgcgacaccagttggatcaggtatcgaaaaaacagtaataattatgtcgatgtaacttgtctatatacattcttaaagtttaagtttgctaagaagggaaattacatcattattagaaaagatgctacaaatggaattgatttacctatagaaccttgtactgtaagtgaaggcggtacaacaaatgtgcgagtctattttcgtagcccctttgacttaacgcctctttcaaattatattttcagtgcttatagcgattgttataattctatgaatgaatatatgagtgttagtaattacactaaaaaagaagcagagcaaagccttagtatgctgaaatctatttcaaaatcagcgatgaaagagttattattcgatgcaaaaaatcgtggatatgatgagactgaagttaacctaaatattgaaaaagtgatatctagagaagatgtaattattaacgggttgcataatcgagtttcattaaacaagatacgaaatatagggaattgggagaaaggatttgatgcaggttatccatattgggaacgtggagaaactgctaggaaaaatggcaaagtagatgaagccattgcactttttgataaagctcgatataacggctatgatgctcctgcgctatatgattcttatgctaaagcttatcgaaaaattaaggattacgataatgaaattctcattcttgatgaaggaattatgcgtaaaacacggcacgatgttggtactttagaggctcgtagggataaggcaattaagctattatttgctaaacaagaggcagagcggatagctaaggaaaaatctgattttctaaaagcgaacaaaaaagaggatgcgattagtgagcctagcaagaggcgtggaagacagattattcaaatgactgatgatggaacaataataaaagaattcgatactatagcttctgctgtaaaagaagttggcgttaactcaaaaagtattagggatgctgcaaatggagttcaaaaacatgctggaggatactgctggaaatacaaagattagcagataatctaagataacctaggatcttcttaatagatacgttttttgtaacagaatgatgttcatctcatgtgaaaaatgatgaggaaattcacataatgcagaaataataggtttagaacaagagttctgatgagaacagaaatgtataaataacttgaaaaaaattgctattaatcatcattttatttacacattgcgtatattttttgtatttttgcttgagatgttacaataaaagaaaaaggagacggttccaatgagtaagagataccagaacatcatggtagcagttgacggatcaagacaatcgatcaaagcgttcgctgaagcccttgacttagcaaaggacaatgaagcccacttatttatcgtgtcaatcatcaacaaagttgagctgacccatagtgcctatgccttttcaaaaatctatgcagatgaaaaacaaagaacagaagtagccatgctgaaaaaaatcaatgatgccaaagagttcggtattgctgagatccatgcaatagttgaaactggagatccaagaaatttgattgccaatgtcatccctggacaagaaaatattgatttgattgttatgggagcgacaggaaaaggagcgatacaacaagcactagtaggatcgaccgcttcttatgtcgtttcacatgccccttgcagtgtattggttgtgaagtaattagataagggaggaatagaaaatggttcgccctcaagaagttcgtgcaccaaaagaaaaaatagaaattttagcaattattgaagacggcacacaaacaaaaaaaggatactcgattgctttaataaagtggaaaggaaaaaaaggtgttgctgtaaggtgggatggagataatcaacaagacaaaggattcccaatcactgcgaacggctaccatccagcgtggtttgttctgcctgataaatttacagaattatacagctatgattatgcgaaaaccgtcacatccctcaaagcattagacaaattagcagaagagcagcataaaatggatgaaaaataaaaaagacgaaccaatcagtctttagaaaactgactggttcgaggagtaaaaaatgaaaaaaggttatttgggatgaatatagaataatgcgtatagcttaaatcaaacttaaagccataaaaaaggcaagagggtgaggtaaatggaagcaggaaaagttttacaggaagtaaaagtattatgtgcagataaaaaatatgaagaagcaaaaagtctgattgaaaagaacaaagaaaatttggaagaaaaatatccgattgcacaagaatttgtagaattaaaacaaggaacgcttcttcaccgattcaaacatttttttggtatcacagaatagaaaaaaacgattaaagatacagcaaatctctgctgatctttaatcgttttcttttgaaactgctaggattcaattctgatttttatataaaaaataaatccaaatgattagaaaaactactgcaagcgtcaattcgatgatgtgtatcactaatacagatgttgtttcccaatgtctaaaagaaaaaatctgataagtaaaatatacggcaggtaaagaggccagtaaaactgaaaacttctttttcgtccattttatgtaatagaaaagaatgcttagcataataaaaaaaggaatataaaaaacaaactgaccgatcgcaatcatactattgcctccaataaataaagtccaagatacaaaataacactttgtgcgtgaaggcgcaagcagctctatggatttatccagtaaaatatgtattgtttttgaatttataggggaaaattgctataatcaaagtgaaagaaggagtggaattttcatggatcatgtagtgttagaaatcgatttgcatttaatcaataatattcgggtgatttactatgttgtaagcaatagtgtcgaacaacgtgtactgacgaataaaatcaatggtattttagcaaagaaagacgttcaccgattcaataacggtgaaggtagttattatagtatcccagtagaaaaaatcatttatacgacagtcaaagtcagagaagatctggatactaaaaaggcatatgaacctatttttacaacttattgattaacagcaaatggaggaaaaaaatgaatccatatgaacaacttatccaagatttgattgatggaaaaatcgaaaaaattgatgtaaaaagagaagaattgatggcttttcgagaagcatggctgaaattggagaatcgtaaatatgtggtaggaaaagcatcgctgaacggcaatgtgacttatcattatgatccaacacgcttattttagtaaggatgattcagaaagaagaagggactgtgacaaaaatcgtgtcacagtcccttcttctggacaaacggtgttcaagagacagcctatcggcaataaggctgaacgtctctttcacaacttctgattcccggtgttccagaaatgaaaattcctacttattaaatagatttttgaatttgtctttcacactgtcgatatttacgtcttttagaagattttgtgctttctctttgtaaggacctagttgttctttatgttcttcgataaatcgttttgcgccgtcgaagttgccgccttttatcatttccttgactttttgaaataattcttcttgattcattttgaacacatcctttgccatcaacttgattttttaacatggataaagtgagaaaaactacattatccacacctccataatatcaaataacgatcatttttactaaaaaaacacttgtttctcgcttctaaagtaggagaaaaatctccaacttaggtcggatggaatttttctaattgccccatatactgaatatataacaaggaggtagaaagatgaaagtgattaaatatttgataggattggcggcgattagtggtattttgctatttggactgaaatactatactgaaggaagttacggggaaatccctggtatacttgatcaactaaatccattagttgaaaaaggtgaggtctatgtaaaaacacaaaaaccagaggaagtaaatgaacatggaacggcaaggtatgttcaaaaagctgctaatgtcgatggggaagagcgtacaattgaatttaatggactttctgtgttaaaagaaaatcattatttgaaaatcagcaataaaggagcgcacatagaaacgtatgaagaagttcctagagaaaaagttccggaaaaagcattagcaattattggctaaatttactgtatgagtgctacagatttaattgttaattataataaaattatgtaaactatataataaataataaaaatattccaaaaacccctgaaaaaagattaatcttttttcaggggttcattttttatcaacaagtccatcaaattgggatggcagggttcgaacctacaattgcttgattcagagtcaagtgccttaccagtttggctacatcccatttattcaacaaaataatcatagcacttttctaaaaaaacgcaagttatttttcttgatcagatagttgttgttttactcgtaaaaggcggcgcaccagtttcttttccaatccagcaggaagggcaatccgctctgctactgacaagacggagtcaagcaagtgatattctttgacaggttcattcatgatatggtaaatgtttgctaaacgttcgatatattcaaaatgggtgtactccgttcgagcgatcagaaattttaataaatcgattgcttttccatactcttggtctccataatagacaagagcttgacgatacagtttgatttctagttcattgagggtagcaggtctgcaccgttcgttccactcattaatagaaactttaccttgaacatttcctttgcggtcacggacaaaaataatcggaatttcatttggatccatttttttatgagtgaatttttccattatctgtgctcccttcaaaggttcggtatctagagtataagggatttttactttaattactagcttttctccaaagttagcatttgtccacccattgcagtgaaaatagccgaaaaatcattgatcggtactgctcgattttttacgccataggggtcgttgacgtaaatattttctttgtcgtatccagtgactacacaagcatgaacaagtggagtgactcttacttctccgttgtttgttgtccaagtcataaaatcagtttcatcagggacttcaaaattgatagtcacggaagtccatacaggatttcctttagatagagcttttttgatatcatctagttgagcgtctgtttttggaaaagtatgataatccgtttggacgatttgttgagcaagagaggcaacaggagggacatagacgcccatagcccagtctccgccactgatatctccaacaaatccttcattaggatcgccgtgagtcccgtctgcattgaaaacaaggacgtaatccaattgttcagctaactggtttttagtcgtttcataaccataaaaagataaaagcatggaaagcgaagtgacctcgcagccattttctagagaaggagagtcaaactggctctctaatggaacatctagcaaaacttctgctttctcttttgtctttttcgttttttgtgttgaacttttttgtgtagtattcattgtatgttctggagaatggatatgtaggtaataacttgtaccgcttaataaaagagtagctgtacctcctagaaacaatagttttttaaatgtttttttcttcattggaaatctcccttttcagctgtttatctttcctattataagtgtatttttattgggaagggaagtattttatttaaatatgtaagaaataatcagtttttgaggaatattatttattattctagaaaaaattcttctagatacaacagctgttttaattgtgaaaacgaaaacagtacgctataatgcctgtaaggttgatttttgactgtaaacaaaaaatcaaataattaaatctccaaaaaatagcagttgtaatatggagaaaagttccagcagtttaggaggattttgatgacggaagaaatgattaatttaggagaacaatatgcatgcaaaccaattggctttacaaaaacggtcattggtgaagttgtatcaaaaatgacaaactgtgccgtggtcaaagttgcccaatgtgctgcagaggatcaagagttattagatgaaaaagcaagcatggttgttgcaaaatatgatacatttgaataaagaaaataattggacgtgcggcgtgctgcaagtccaatttctttgagaaggtaaatcagtattcttttcctgttttcaggagaagaaaaagcgaggcgagttgtcatggtaacattttttacggttctattgtttttattcgttgttgttatgttcttatttctttggctggttcgaaaagaaattatttatcggactgttcggaatcgatgggtttacttggtcataccattcttagtagtactagtcgtttggtacacactcatcagtcagcctacagcagatgaattggcaaaagggattttgtcagcgatgatttttattagttttttgttggacagtcgaggaattacagaagaagggcttgtcttgaatagctttgataaaaaaggtgttcctttttctgaaatcaataaaatcgtgttgtaccaaccaaaaggttctaaaattgtaaaaatgaattttttccgaaacggatggcggggaccaatgctgaaattttctgcatcattagaagaattagttccatttttgtcccaacgcttgaacgatgaggcggagattgatattatgatcgatccagaataaaaaacagaggttacgacaagatgtttgtcacaacctctgtttttttcaagtaaaattatccgaatacacggaagcgatctgcatcgttcatatattctttttccccagctggtgtttctggtgaaccgaatactaattgtgaacgtagtttccagtttgaagggatattccattcttttgcaactgcttcgtcaataactgggttgtaatgttgcaagtttgcgcccaatcctttatcaactaatgctacccaagtgttcgctgttgcgattccgtttgattgttctgaccaatctgggaagttgtctgcatataattcaaattgttcttgtagaccttttaccacgtcagtatctttgaagaataatactgtaccataaccatttttgaaaccagctaatttgttttgtgtatttggaaaagcttctgctggagtcaatgggcgaagtgcttcttcagtgatttcccaaagtttttcatgtgcatctccgaaaagaataactgcgcgtgttgattgagcattgaaagcagttgggctttctttaattgcttctttgatcaaagctgtcaattcttcattagaaagtgaaacgttacgtcctagatgatagattgaacggcggttttttaaagtgtcagtaaaagttgtcatattaaaatttctcctttgatttgcgttttgcatttttttaattgattacgaaatgaagtatatcatcttacaaaaagtaagtaaatagatatgctcacaaaaaataagcgaagttcaaaaaacaattttgataagggaaatcgttagaaaaggatttccttggttatcgctttcattgttgtgtttgaggaatttttgcttatttgaaaaaaacgtctgatatataattattaaatctctatcttcttttttttatgatattgccattaaaaattacttgtttttatagaaaattagtttatatttcttaaataagttttttagttaaatttttcggtaaagatgtataatattttctgaaaatttaaagaattggggtatagattatggaaaaacagcaagacaagggcttcttcgggcagccgaagggattgtcaactttgttcttcactgagatgtgggaacgatttagttattatggtatgcgtgcattacttatctattatatgtacgatacagttgccaacgggggacttggattaccacgagcaacagcattagctatcatgtcgatatacggatctctgatctacatgtctagtatcgtcggcggatgggtatctgaccgagtgttaggagcaaaacgcactgtattctttggtggagtcttcattatgcttggacacatcgtcttggctttaccatttggtgtaagtacattatttgtttcaatggcattgatcattattggaaccgcctttttgaaaccgaacgtttctggcatggtcggacatctttattcaaagactgatttgcgaagagatgcaggattttcgattttttacatgggtgtcaacttaggggcgttattagcaccactaatcgttgggacaatcggtcaagaatataactaccatttagggttctctttagctgctattgggatgttctttggattattacaatacatcatccaagggcgcaagacattagacggagtgggtacaacaccaccgaatcctttgacaactgaagaacgtaaaggattcatccgtaacttgatcatcgcacttgttgttatcgttgcagtattcggtggcgcacaattaactggtcatttgacaatcgacttttttgtcaatacaatcagtgtattagggattatcttaccgttgtattactttatcaaaatgttgacttcaaaagatgtaactgctgaagaaaaaccaagagtatgggcgtatatcccattattccttgcagcaatcattttctggtcattacaagaacaaggttcatctatcttagctttatttgctagtgaacgtacgcaatctacactatttggtgtgacgatccaagcaagctggtatcaatcattgaatccgattttcatctttattttgacgccggtattcgtaacaatgtggacaaaacttggcaaacgccaaccatctacagtagtgaaattctctcttggtcttttgtttgcaggattatcatacttactattgatgttgccaggtatgctttacggaacaagtggaaaagtaagtccattgtggttgttgggaagtttcttcatcgtggttattgctgaattgtgtctttcaccagttggtttgtctgtgacaacgaaattagcaccacgagcatttgaatcacaaacaatcgctatttggttcttagctgatgcttcttcacaagcaatcaatgcacaaattgcacgcttctatacaccaggaacagaatctgcctacttcggtattatcggtgcagtagcaatcgtcggtggtatcttgctatttactgtgaaagaaccaatcaaaaaactaatgggatctatccattaatcaactcatgaaaagacaggaattgcttatttgtagcgattcctgtctttttgcgtatactcaaaaaagatagaaatatcagaaccataaaagtatataatttgaagaatatagaacaaatgttcagtattttttgatataataaagaagcaccgtatcatgtgttgaaggaggaaaagcatgtctttacaatttattcttggaaacgggaaaaaagatcaccgtcaagtcttgattgacgaagcatcagcttggctcgaccaagatgcaagcaaccaagtatttttccttgttcccaattacagcaaattcgaacaggaacaagaaattttagcggagatgcgaagaagaagcgggaaaaaagctttcagcacaacaaatgttcaagtattcagtttttaccgtctggcttggtatttgctgcaacagacaacccttcttacaggaaatgaattatcagaatccggatctgcgatgatcttgcgacagattttagaaaaacatgaggaagaattaacgatctttcgcggagaaatcaataaaagaggatttattcgccaattgcaagaactctatagtgagttgcgcacagggaatattcaaccggaagacttgatgcttttatttggtgattcaccgaatgcagaagaccagcaacttaaaatgaaagacttgaagctgattttttcagcttatgacagcgaattgaccgaacgtgcactatcaaatgaagatgcactggctatactagcaaattatatgcagacacaagatttcaccaacgtccaatttatcgtcagcggtttttcccgaatcaatgggcaagagtatcaattactgcaggcaatgatggaaaaggggcaattagttgtcgatttattgttggatcgtccttatacagcggatcttccagaagtacttacgctctttcatgagactggaaagctttatttccgtctttttcaaagtgcgagagaacggaaagttcctatattagtagatcgttttgcgccagagcagaatcgtccgacagagcttcagttgctgcaaacgatgtgggaagagacttccagccaaaagaaagcaaccgtccgcaaattaggggaacaagaggctctccatttgtgggaagctgaaaatccaactgaggaagtccgacagctagctgttgaaatcagacggctagtcagtgaagaaaactaccgttatcgtgatatccaagtactgacaaaaaatatgtccttatatggaaatattcttcgaccaatctttcaagaaatggcgattcctttttatatcgatgaagaacaaatgatggaaaatcatccgctgattgaatgggtcaacagtctgttcgctcttgaccgatattcttatcgactaagtgatattatgcgttttttcaagacggaattgttcctatcgatggaaacagaaaccgaactggatgaatggaaacaagaacgagatgaattcaggaaaaaattggacatcacagaaaatgttgcacttgcttataattatcaaggcacttactggacgcgtgaaaaagactggcagtttgtggcgtatgattttgaagcagaacagattgaagacgtacagtatctggaagaacagtcaaatacgattagacgattatttcagaaatctgtacctgcattttttaaaaaaataaagaaaagtaaaacaggtcaagcggccgcaaatgttttttatcaatttttgattcaaagtggtgtacagcaacaattattgttttggcgtaatcaggaagtagacagaggaaacttagaagcggcaagaaaccatgagcagacatggggagcgctgattgatctgctggatgaatatgtagtcatttatggtgaatcggcttttgactggtctctgttccaagaaatcattacgagtggtctcgaaaatctaagttatggtaaaatccctaccgcaatcgaccaagtgcgaatcaaccgtttggaattagttcgaccgaatcaagctgccgtcacttttgcattaggtttgaatgatcaagtgtttccagaccgtaaagaaacaaaaggattgttgtccagtgaagaacgagaagtattaaatcaagctttgccagatggacagtttttattcgacccatcaaaagaaagtatctcttttgagcctttccaagcctaccttgtttttctttccggaacggatcgattatatcttagctatgcacaaagatatgacacagatggttcactgaagatgtctccttatttgcgcagaatcacagaatatttatcagttcccgtcgagagaaaagagcatttgacaatcgaaagcgatcctgattgttatgtaggaacttacagaagcggaatcaatacagtcaataggatttatcgattagctttagatgaaaagaaacctgtaccaaaacattggcaaaagctcaaagaattagtactgaattcctcatggcgcaattttgctttacaaatctttgaaagtcaggaacatttgaatgtgcctgtttcgatgccagaaaaaatggcggaagagctttatggaaaagaaatttatacttcgatttcacgtatggagaatttttataattgtgaatacaaatacttcatgcaatttgggttgaaattgaaagaacgaactgtttatggtttgactccagcagcaacaggtgatttttatcatgaatcattggatcgtttcttcaagctactgttttcaaaccaattatccttagtgaatatgaccgatgcgcagcgtaaagactttactgaaaaagtgctgcaagaagtgttcggagaacttcggtttgagatattggatagttccgcaagaatgaactatatccgctatcagttaggacagacgatccaaaaagtagcatgggctttgcaaaaacagagcaaaaatacgggcatgcatcctcttcagacggagattttatttggtcagattgctggagcaaaaggtatcacaggtctggaattaccgttgagtaatggtggaaaactccacgttcgaggaaaaatcgatcggatcgatgtagcttctgaacaagaagatacttggttaagcgttattgattacaaatctagtggacgttcattcgatgtcacagaagcttattatggcatggctatgcaattattgacgtatctggacgtagcattgatggatgcggtacgtttgactggaaaggcggctgttaaaccagcaggatcatattatttacatgttcataatcctgtattgacggagaccgatgatgtagagaagaatacattgaaaaaatttagttatgatggcgtttttgtcgatgatcccgctcttttagaagtactagatcattcactggaagcaaaagaacaatcactgatctatccagtgaaaaaaaatgcgaaagatgaataccaaaaaggtagtttcagcaaagataaatttttcacggaagaagaactgcaactgttcatggcgcataatcgggaaaatatgcggttagctggagatgcaatcacttccggagaaatcaaactgaacccagcttataaagataaacagcgaattgcctgtgaattttgtccattcagaagcatctgtacgtttgatgtgatgctgaaagaaaataattaccaccgtctggagaaaatagataaggaagaagcactgcgcagaatattgaaaaggagtgaagaagagtgaatcaaattcctttaaaaccgcaaaacgaacgatttacagatgatcagtggcaggcgattttcgatcaaggagataatttgttagtctctgcgtctgccggatcaggtaaaactacagtgcttgttcgaagagtgattgaaaaattaaaaatgggttttgatatcgatgaattactgattgtgacatttactgaagcagctgcaagagaaatgaaagaaagaattcaagaggcattacaagaagcggtcaacagcgaaagcgaccctgtacgaagacagcattttactaagcagttagttttattgcccacagcgaatatctcaaccttacatgctttttgtctaacagttattcgacgttattattacttaattgatattgatccggtctttcgcatgttaacagatgaaacagaaacgatcttgatgaaggaggatgtgtgggacgagctgagagaagcactttatgcagaaaatgatgaacgatttttccaattaacaatgaatttttctaatgatcgttcagatgacggcttgacgaatctggtattttcgctttatgagtttgcccgtgccaaccctgaccccaaaaaatggctagaacagttaagcgctaattatcgtttgactgaggggctagcgaaatctcgattatatcaagaacaaatccgtcctttagttttggcagatgtataccaatgtgtacaattatatgaacagatgactcagttagcacaaggtgaaggattagaaaaaatgcatgagcaagtagctggagaacaacagcagatcaaaaatatctatgaagctttctcgcaagatcggttagaagatgcttatgctagtttggaacaactgactttttcaacttttaagagcagtcgtaaagcagaattgaaagaaatatccaatgaagtcaagggcatgagggataaagcaaaaaaattgattcagcagataagtaaaagttactttcctgtttcaccaagccaaatggaagaattaacggaaaaagcactaccgttagtcgaagaaatgacaaaagtcacgcaaagctttatggacggtttcagtatgcgtaaacgggaaaaaggcgtattggacttcaatgatctggaacatctagcgttgcagattctcacagaaaaaacgaaagatgcatggctgccaagtgaagcttcaaaacattatcgaaaaaaattcaaagaagtaatggtagatgaatatcaagacgtgaaccaattacaagaagccattttatactggctaagagaacctgatgatacaaaaggaaatatgttcatggttggggatgtcaaacaatccatttattctttccgtttagcagatcctagtttatttatcgggaaatacgagaatttttcaaagaaagaaggcggacgtcggatcgttttggctgagaacttccgctctagaaaagaagtcctttcttttacgaatcttatttttgaacaactaatggatccagcagttggtcaaatcaattatgacgaagcagccaaactgatacagggattttcagactttccagagaatgaacagtttgagccagaaatcatgatctatgaaaaagaacaggaagaatcagagatcgagattcccactgacgatatactggaggacaaaacagaaggcgaactttttatgacaggactgaagattcgtcaattgattgattcttcctttatgatttatgataaaaaatcaaagaaagatcgtccgatagaatacagagacattgttctcttgacacctacaaaaaagaacaacttaacaattttagagattttcaaaacattggatattcctttggagatgaatgatgctcaaaattattttcaagcgacagaaattcgcacgatgatctcgttgctacaattaattgacaatccctatcaagatattccgcttgcagctgtattgcgttcgccagtcgtgggtttgattgaaccagaattagcaagtatccgattagccgaccgtgcacatacttactatgatgctgtgcttgcttatcaagcatcaaacgaagatgaattagcggttaagctggaacattttggcaaacaactagatcattggcgagaacttgctcgccgttcttcgatcactgacttgctatgggatatctattatgagacgggatatctagagtatgtggtcggtctgccagcaggggcacagagacaagccaatctttatgcattggtcgatcgtgccaaagcatacgagcaaagttctttcagaggattatatcagttcgtgcgtttcattgaaaaaatgcaagaaaaagacaaagacttagcagaaccagtcatttcaatagaagataatgctgttcgcgtaatgacgatccacgcaagtaaaggcttggaatttccagttgtatttttgttagatatgacgaaagaattcaacttacaagacttacgcaatcggtatgcttttgaagaaaaacttggagcaggtattcgctatatggatcctgaaacacgggtactgtatgatacgttaccatttcaagccatcaaattggcaaagcaaaacaaattgttatcggaagaaatgcgtaaattgtatgtaggattgactcgggcagaacaaaagcttttcattgtcggttcctataaaaataaagagcaaatgatccaaacatggtctgaagcagctgatcatgaggagttggtttttgatcctgagctacgtttgaagggcagaagcagcttgatgaattggattggttacggattgatccgtcatcctgaaatgcagaaatacttagaggaagaagtttcgacttctctccttcaatattcaaatgcacagttttccatttcatggatgaatcagcaatcaatcattgaacaaagacagttgcttgctgaaaaagaactggttaacttagatcagcaggtgaaagaaaaggaaactgtattagcagattcgttacaaaaacgtctagcctatgaatatccttatcaggcttcttcgcaaaccacaagttatcaatctgtatctgagatcaaacgattattcgaagatccagatgatacacaagaatcacgcttgactctggaaagtagtcagacaaaggcagcatctcgtcaattccgttatacgcaagaacaactagcagaaccaaaatttttacaaaaagatcggcaagtgtcggcagctgctgttggaacagctacccatgctttattgcaattgctgccattagagatgccaactacagagagcatcaatcaaaagttgcaggaattagtaaagaaacgtttaatagacgaaaaggtcgcaaaaaaagtagatgtttcttctattatatggttctttcaaacagaacttgggcaacagttgattgccaacaaagaaaacgtaaaacgggaacaacctttttccatgctgctttctgctgatgaagtatttcaagactatccaaatcaggaagatgagctattgatccacggaatcgtcgatggatacttagaagaaaaagatcatctccatatctatgattttaaaacagatttcattttacatccggatgatccagcagaaatagacgcgatcgtccaaaaatatcagggacagctaagactttaccaacaagcaatgacagaagcactgaataaacctgtagaaaatgttttcctaattttacttcgagtgaaacgaatcataaacattaataaataattataattgagcaaacttgacttatattttgtaaggattatgctatactctgggaagaggtgagtatgatggagctaacacagacagaattcgttttgtgtcctaaatttgaaaaaacgttctctattttaggaaaaaaatggaacggattgattatcgatgtactactcgaaaatggtccgcaacgctttgtcgagcttgcggcaaaaatcccgatggttagtgatcgggtattggtcgaacgcttgaaggaattggaaaaagaaggaatagtcactcgaaacattgcctgtagtgaaaaaagccgttcagaatatctcttgactgaaaaaggagcagacttgcaaaaagcaatgcgtcaaatacaagtttggagcgaaaaatgggtcacagaggaagaatgcggttgattttgtaaaaaaaatcttgtaaactatagtccatacgaataagtaaaagaacgatgacgaaaaagagtagtttggctaaaccagttcagggagatctgtcacagactgaaaacaggtcctgtgtttgaaaaatgaagttcactttccgagttcgtctgatcattatcagaccggcaactgtcgttaacgaagtaagagtgcgatgtaagtttatttatcgcaaattaggatggtaacgcgaagacctcgttccttaacaggaatgaggtctttttgttttgtatttggaatttaaaggaggaacaagcacatgtctttacaagcacaattagagagcttgaaagaagaaacaatcgtcaaaatcacggcggcacaagatttaaaagaattaaatcaaatacgtgttgaaacgttaggaaaaaaaggaccgatcacagaagtattgcgtgggatgaaagatctaagtccagaagaacgtccaaaagtcggaagtttcgcaaatgagatccgagaccttttgacagaagaaatagagcgaaaaaaacaagtgttagaagaagaagcgttaaatgcggctttggcaaaagaaacagtagacgtgacattgcctggtagaaaagtaaagcatggtacacgtcatatcgtgacacaaatcatggaagaaattgaagatatttttgtaggtatggggtatcagatcgtggaaggttacgaagtagagtctgaccattacaatttcgaacggatgaacctgccaaaagaccatccggcaagggacatgcaagatactttctatatttcagacgagatattgattcggacacatacttcaccagtccaagcacggacaatggaaaagcatgatttctctaagggtgctctacgaatgatctcgcctggaaaagttttccgcagagatacagatgatgcgacccacagccatcagttccatcaaattgaagggctagttgttgataaaaacatcacgatgggcgatcttaaaggaacattagaagtcgtaatgaaaaaaatgtttggggaagatcgtgaaatccgtttgcgtccaagttatttcccatttacggagccatcagtagaagtagatgtcagttgtttcaaatgtggtggtgccggttgtaacgtatgtaaatacactggatggatcgagattttaggagctggcatggtgcacccgaatgtgttgaagatgtcaggaatcgatccagaagaatattcaggctttgctttcggccttggaccagaccgcgtagctatgttgcggtatggagtgaatgatatccgtaatttctatcaaaatgacttacgtttcttaagtcagttcaagggggagtaagaagatgttagtttcatataaatggcttaatcgttatttggatttatcgaatgtaacaccaaaagaattagcggataaaatgtctgtaacaggaatcgaagtcgagggaatcacggttccagaagaaggcttgaaaaaaatcgttgtcggtgaagtcaaggaatgtgtaccacatccagattccgatcacctttctatttgtcaagtcgatattggcgaagacgaactgtctcaaatcgtttgtggagcgcctaatgtgaaggtcggaatcaaagtgattgttgcgcttcctaactcacggattgctggaaatgtgaagatcaaaaaagggaaaatgcgtggtcaagtatcaaatggcatgatttgctcgttacaagaaattggctattcagacagtgttataccgaaagaatacgctgaaggtatctattatatgccacaagaagctgtaaatggcgatccagttttttcttatttagatatggatgattcgatcattgaattgtctatcacaccaaatcgtgcagatgcattgtcaatgcgtggcgtagcttatgaagttggagcaatctatcgtcagacgcctacattcgatgacgagaaattagtagaatcatcacaacttgctagcgataagatccaagtgacagttgaagataaagaagtcgttcctgcctatcaaatccgcatcattgaaggagtaagaatccaaccaagtcctcaatggctgcaaaatcttttgatgaatgaaggcatccgcccaatcaacaatgtagtagatgtgacgaactatattttgcttttattcggacaaccactacatgcatttgactacgacaaattgaaatcaaacgagatccttgtccgacatgcaaaagaaaatgagacattagtcacgttagatggagaatctcggaaattgacaactgacaatcttgtcatcactaatggcaaagaaccagttgctttagctggtgtcatgggtggattagattcagagatcacgaatgaaacaacaacagtggcactggaatctgctttgtttgatccaatttcgatccgtcgtacagcaaaacaatttaatttgcgtagcgaatcttctgcacgctttgaaaaagggatcaaccatgcaactgttggagaagccagtgaggttgctgcagcaatgatcgtttctcttgcaggtggggaagttctacaaggcgcggtcaaaggttcagagattaaagcagaagacgtatcagtgaagatttcacttgaacgcatcaatcaatatttaggaacatctcttgtcgttaaagaagtaaatgagatttttgaagcacttggatttggctatgaagaaaaggatcatgtttattccgtagtcgtaccaccaagacgctgggatatccaaatcgaagcagacattatcgaagaagttgctcgtatttatggatacgaccagttgccatctacacttccaagtggagaaacggttgctggaagcttgtcaaaagaacaagaaactactcgtaaaattcgtacaatctttgaaggaagcggattgagcgaagcaatcagttatgcattgacaacagaagaaaaatcaagacagtttgttataaaagaaagtaatattacacgtttggactggccaatgagcgaagaacgttctgtattacgaatgaatttgatcagcggactattagatgatatcagttataacactgctcgaaaaaatacagagattgctttatatgaaatcggtcgggtattcttccaagaaaatgatccgcgcgcacatctgccacaagaagtaaaacatgcagcaatcgctatttctggtgtttgggaagaaaaagattggcagacgaaagcacaaaacgtagactttttcaccatcaaaggtcttttagaaaacttatttgaacaactaggtatccatgaagatatccattatcaaacagtgacagaaataaaagaaatgcatcctggaagaactgctgcgatttaccttggcgaacaatttatcggttttgtcggtcaagtgcatccgacaattgccaaaagttatgatattccagaaacatatgtagctgagtttgatttatctgctgtagtggaagctgctcaaaaaggaatcgtttttgaagcagtgacaaaattcccagcagtcagccgggatatcgctttgcttgtaaaagaaactgtgacaaatcaggaattaacagaagttatcgattctgctgccggaagatttttaacagatatccaattatttgatgtctatcaaggagaaaacatcgaaaaaggacataaatccatggcttatagcctgacattcgtcaatcctgaagcaacattgacagatgaagaaatcaataaagcaatggataaggtaacaaaagctttgacagaaacgcttggagcaagtattcgttaaaagttagaagcaaaatagttatcagtcgtccatgcttttgaaaatgtttttttaaaaacactttatatagagtagatacttgagcagatccatcttcggttctgctcttttttatttttcaggtagattccataaatttctaaaatcagaaaaataggtaggtatcgagccgtcgtattcacagtgaaagactatcaataacactgctatgtaagtatgataaaaaagagaagatgaaattgaaaagggagagttttattacacaagtaattagattttaaatgaacaggaaaatcattatttttatcgctaattttcaaagaacagttttggctatatactaataagaggtttattggataagaaatcatgacatttaatctgctgaatatggaaaaatgaccgaggtggtaatcccaaccattttttcttagtgtatcattaattgaatttcagacgttttgcacatggctacttcagagattaaaggaggtggtagtggtgttcatgttagttgttcttggtcttttattaataatcgttggtattcaacttagaagaggcaaatggtatggaatagttgctgggaatacttttaaagataaaccgattgaagttcaaaaaaaggtgcattaggagcttcatctattgctttttttgtaggaggctttttactaatcgtttatattttaatgttttttgatattcaaactagatttttaatcattccagtaattgtaatagcgatagtatattctttgtttaccttatataaatatcttaaacacttcattaaatatggagaataaaggaactatttagtaagaaaagaaatagtagaaaatctataaaaaactaccaataaaaatgagggggacacagcttttggcccttctttgacgacagttgaacaaaatatccgcacttgaaaaaaggaatgtcactgaagctgtggtcgccactcagccgatcaatgaatacgaagatgcattgaaaaaactgatcaactgtgaaaagcagtatacgacacttcttgaagaaaccactcaagtgatcgacaaacaagtcgtcacggactaagaactggccaattatttcaactaaagtgaaagtctctgattctgattttgaacatcaaaaaaccgaacgatagagagcgtacgcatgcaagtaagcagctactcaactattgttcggttttttgagtttggtaatgatgtcactaagatggattcaccggtgtattaatggaagtaattgatccccattgctgattttacttcagaaagtgtttgtgcagctactttagcagcttcttcactacctttacgtaagatttccataacagctgaaggatctttttccaattcttctcggcgcgcgcggatcggtgcaaattcagcttccaatacatcaatgaggtatcgtttgatctttacatcaccaagtccgccgcggcggtaatgagctttcatttcttcaattgcttctttatctgttccgaatacatccaagtaggtgaagaccatattcccttctacttgtccagggtcttgtacatggatgtggtttggatcagtatacatactcatgacttttttctttaagacatcggcaggatcggagatataaataccgtttcctaacgatttactcattttgccatttccatcgattccaggtaatctacccattccttttggtgggaatacgccttttggttccaccaagacttcaccatatgtatgattgaagctttgtacaatttcctgtgtctgctctagcattggtttttgatcctcgccaacaggaacgagattcgctttgaatgcagtgatatctgctgcttgagaaacaggatagataaaaaatcctgtaggcacgctttcaccgaatttcttttgttcgatttctgttttgacagtcggattgcgacgaacgcgtcctacgctgaccaagttcaaataatacatggttaactcagctaattccggaatttgtgattggataaataaagtagattttgcaggatctaatcccacggctaaatagtctaaagcaacttgcaagacattggatgaaaccttctcaggatttttagcattatcggtcagtgcttgcatgtcagcaatcatgacaaacagttggttgtcttcatctgcttgcatagccactcgggtttttagagaaccgacgtaatgccctaaatgcagcttcccagttggtcgatctcccgttaaaataatatttttcaaaaaagacacctctttacgatttgtaagtctgagcacttaatatcttaccgtttttcctgacaagaaacaacagttcctaaggaaaaaacaaggaaagaggataaaataactaatagattagaaatgaaagaaatatttatgggagaataaacgttctaagaaactttacaaattactaaactatcagatataatgtattttattatacatctttaaaagaaatcttactaaataataatgggagtgtaattctatggcaatgattaaatttgatcacgtggataaatattatggcaagttccacgcattaaaaaatatcaatctcgaattcgagaaaggagaagttgtcgttgtcattggtccttctggttcaggaaagagcacgatgcttcgctgtatcaatggattagagacgatttcttcaggcaagctactaattaatgatgctgacttgcatgataaaaggacaaaattgacagaagtccgaaagaatatcggcatggttttccagcatttcaatttgtatcctaataaaaccgttctggaaaatattacattagcaccaatcaaagtgttaaagcaagaccaggcaactgcaatcaaaaacgcggagaaatttctgaaaactgtcaatatgttagataagaaagattcttatccttccatgttatccggtggacaacagcaacgggtggcaatcgccagaggtttagcgatgaatcctgagatgctcctgtttgatgaacctacttctgctttggatccggaaatgattggtgatgtattggacgtcatgaaaaaattggcgcatgatggtatgtcaatgattgtcgtgacgcatgaaatgggctttgccaaagaagttgcggatcgtgtcatcttcatggctgacggagaagtattggaagatagcagaaatgtgagagactttttcgaaaatccaaatgaagtccgagcacagcaatttatcagtaaagttatcaatcattgataggaggaaaaagatgcgcaggtttaaaaagatacgcctgattttccttttaggcattgcttttcttgcactagccggatgtaaaggaaatgggttggcaaatgaagatattttagagcgaagcaaatctaccaatgaaatcatctggggtgtcaaatatgatactcgattatttggaatgatggatattgagagcagaaccgtacaaggatttgatgtagatattgcaaaagctatcactgaaaagatccttggtgaaaatggaaaagcggaatttgttgaagtcacttctaaaacgcggatcccgttattgaaaaacggaaacatcgatgcaatcattgcgacgatgacgatcacagatgaacgaaaaaaacaagtcgatttttcagatgtctatttcgatgctggccaagctttgttggtaaagaagggaagccgaatcaaaagtgtagatgatttgaatgcttctacaacagttctagcagtcaaaggttctacgtcggctgcgaatatccgacagcatgcaccagatgcaaacattctggaattggaaaattatgcagaagcatttactgccttacaatctggccagggagatgcgatgactacggataatgcgatcttgttagggattgcagatgaaaatccagagtacgaattagtcggcggaacgtttactaatgaaccttatggaattgcaatcaacaaaggacaagaaaacttcttgaaagctgttaaccaggcgctagaggaaatgcatgcagatggcacatacgataaaatctatcaaaaatggtttccaaatgaaactgaaggaaaagtagagtaagggggagaggcaatgagcgaattgatacagacttatggaccaatctttgtcgacgggttcaagatcacattgttttcgagtgtcttagcacttgtgtttagtttgattatcggaacgttgatggcaatcttccaattatcaaagaataaaatagtgagtgccttagcaaaggcatatgtagaattttttagaaacattccattattgattatcgtgatgtttttttatgttgtcgtaccgatttattggtttaatctagacggatttcaagctgggacgattggattgactatctatacatccgcttttattgctgaaacggtacgttcagggattcaaaccgtaccaaaaggccaaacagaagcaggattgtcttctggatttacctatccagaaattatgcgttatattgttttgccgcaagcattcaaaatcgttattccgccattaggcaaccaatttattaatcttgtgaaaaactcgtctattttagcaatcgtagctggtttggatttgatgtatcaaggagacttgatcgccagtgaaacattcaataccttcgatacgtatatcatcgttgggttattttacttagttatcacgctgccgttatcttacttaatggtttatcttgagaaaaaatgggcggttcgttcatagaaggaggggaaatacatggattttagcggcgctttttcatggatgaatgtccgttttttattggaaggattaaaggttactgttgaagtttcattgttttcgatcattttcagtttcttgattggtggtctggcaggtgtgattcgttttgcgaacatccctttcttgtccaaaatccttggtattgtgatcgatatcatacgaaatcttccattattattgatcattttcttcacttattttgccttgcctcagattggtattcagatgaacatcttctggtccgctgttgcagcattgacgatctttgaatcagctatgctgtcggagattttccgagcaggacttaatgctgttccgaaagggcagatggaggcaggattgtcaacaggactgacttatgtagaaacgatgcggacgatcgtcttgccgcaagcattcaaatcaatgattccggcaattgtgagccaattgatttcactgatcaaagatacttcattagcagtaatcatttctttacctgaactttctcatcaagcacgtattatttatggacagaataccaattatgtgcttccgatgttcatcatcatgacacttatgtatttcgtggtgtgttacgcgctttctctgctttccggttacttggaaaagagacggtacagttattaatagatgattcttttagcggttgtggcagactaaagtcacaaccgcttttcctctttccattcgaaaaaagagagtttgattgttttaagcaagtgagagcacttgaaaattcaggctaaaaagtacacaatagggaggatagaatttattgaaaaaaaggatgatacgattgacagataatcgccctatcggatttattgattcaggtgtcggcggcttgactgtagtaaaagaagccctgaaacaattaccgaatgaaaatattttatttgtaggagacacagcacgctgcccatatggccctagacccgcggaacaggtaatccagtatacttgggaaatgacggattatctggtggagcaaggaatcaagatgctagtgattgcttgcaataccgcaactgcggttgctttagaagaaatcaaagctgctctttctattccagtcatcggtgtgatccttcccggtacaagagcggcagtaaaaaaaacacaaaataaacaagttggcattatcggtacgattggtacggtaaaaagtcaagcttatgaaaaagcattgaaagagaaagtgccagaattgactgtgacaagtcttgcttgtcccaaatttgtttcagttgtcgaaagtaatgaataccattcatctgtggcaaaaaaaatcgtggcagaaacattagctccgttaacgactaaaaaaatcgatacattgattttgggatgcacccattatccattattacgccccatcattcaaaatgtagtgggtgaaaatgttcaactgatcgattctggagcagaaacagtaggtgaagtatctatgctactcgattatttcaatttgagcaattcaccgcaaaatggacggacattatgtcagttttatacaacaggatctgctaaacttttccaagaaatagccgaagactggcttggaatcggacacctaaatgtagatcatattgaattaggaggaaataaggatgcgtcatgacgggagaaaagcccaagagcttcgtaaactggagcttcaaacaaatgttttcaaatatccagagggatcggttgtgatccgttttggtgatacaacagttatttgttctgcaacagtagaggattctgtaccgccctttttgagagaaacaggaacagggtgggtaactgctgaatacagtatgctacctcgagcaacgagtacgagaaatcgtagagaaagcagcaaagggaaactttctggtagaacaatggaaatccagcgtcttattggtcgctccttgcgtgcagtaatagacttggaaaagctgggagagcgtagtatcatcatagactgcgatgtgatccaagcggatggcggaactagaacagctagcatcactggggcattcgtcgcgttgagactagcaattgaaaagcttttaagagaaaaggaattgtcagaagatccaattaaagagcatcttgctgcagttagcgtagggatcttgccggatgggacttgcgtgacagatttggactatcaagaagattccgcagcacttgtagatatgaatctcgtgatgacagaatcaggaaaattcgtggagattcaaggaactggagaagaagcaacgtttgatggagaacagttgaatgaaatgctcttttttggaaaaaacgcgattgaagatttgatcaaagagcaaaaacatgctttgctaacagaatttgctcaagataatgagcggatagaagaaacaaaaacaatcatcattgcgacaagaaatccaggaaaagcagaagagtttcgaaatatgttcaaagaagcgggatatcatgtaaaaacattacttgactatcctgaattgccagatgtagaagaaactggcagcacatttgaagaaaatgcccgattaaaagcagaaacgattgcacaattacttgatcaaccagtcttagcagatgattcaggtttgaaagtggatgcattaggcggtatgccaggaatctattctgcacgttttgcaggggaacaaaaaagtgatgcggggaataacgccaaattattatatgaattgacagatgtaccagatgaaaaaagaacagcacaattccattgtacactagtattcgcggcaccaaaaaaagatagccttgtagtagaagcggaatggcccggtcgagtagcccgtataccatctggtgaaaacggctttgggtatgatcctttatttatcccagaaggtaagaaacaaacagcagcagaattatcgagcgaagaaaaaaacaagatcagtcatcgggctcaagcaatgaaaaaattgagtgccgagtggaaacaatggctggaaggagagagatagatgcggtatttagtagtaagtgataatcatggggacagagatatcctcgttgacttagtagatcgctatcgttctgaagtggatatctttttccattgtggtgattcggaattagaagcttctgacccattatgggatacattccaagtggttcaaggtaattgtgattatggaccaggattcgaacagaaaaaagtgatccaaactggtcaggatacagtattcatgactcatggtcatttatcgaatgtccgatttggtttgacacagttagcaatcgaagctcgagctgcaaatgccgatatggtattttttggtcatacccatcaaataggctgtgagatggatcagaaaatcctatttttgaatcctggaagcatttctcaacctagaggcccgatccaaatcccatcatatgctcttattgaaagtttagatgaccaaatttctgttcaatactataaccgtgcccatcaggcagttgaagagttggccttttctttttcgagagagcgctgaataaaaaaactctaatttttaataaaaataagctttattttgtgaattttgcatccggtttcggtaaaatagtagtgttgaatgaaatagaaatggaggccatcagatgattggacctatagtaagagaaatgctgctggaaaatcaggaaacgtttttgattcctgcagaaaatgtggcaaatgttatgtatcatcatccattatcccatggtttacttgtcttatcgaaggtcggttattccaaaattcctgtattaggaaaagatgatcactttgtaggactagtaagtttatcagatgtggtcaataaaatgattgacttgcaaacaatcagcatggatcccttagaaggactaacagttgctgatgtaacagaaacggatgttccgacgattgatgaaaattgggaactagaagaagtactccatttgttagttgattcgccttttttaccggttgtcacagaagaacgggttttcaaaggaatcatcacaaggaaagagctgcttaaagccgtaaacttcatggtgcatgaattagaacgtcgcaatatattgtctccaaaaatcgaagaattaaaagaacaaatcgatattgtgagctaaagaacgagaaactgaaagataatcaaaaaataagtagaaacaaaagcgtaccagttttgactttatcttgatgtacaaaaaagaaattttcacctaacagaaaaattttccataaaaatacatatttaaatatgaaagtacaattacaaataaattaaaacgttaaaataaaattgtcaaaacgtcagagaggatggtggagaatgaatcaatatgtaaaaaagctgattgcgtcgattttgtttgtcttccctctcttgatggtgacatccgtttttgccgatgtagagaaaacaagcgaatcaacgcaatcagagaatcaaagttttgacaagactactttttcagaaaaatcaattacttctgaaactacagaatcccaaagtgaggcgcctacttctaatacaaggcaagaagaaaataagacaagtgagacctcagaagtagctgaacaaacgtctgataagcagtgaagaggtacaggttagagttgtttcagcggatgggtacagcgaagctgccacaacagaagaactgacgcagcttctcgcagacgaatcagtagctaagattcgtttaactcagcctttgactttagacagggaattggagatcaagtgagatatcgttatcgattttggcggacttgctcataatttcggcacacatcacatctatatcaatgagacacctcagtcgatcgagtttcagaattttaaaggaacggcagctcatccaggtgggttgataccaaatatcgatggaaatgccattatcattgcttatatgtccgatttttggggaaacagatatcattttacgggagaaataaaatttaccgggacacttgacttatatgatggttctaaattaggcctgatttacgcccctcgtgcaactgtcacattagatggtgtttccggtgtattggatgtccaaccagtgaaagaagggatgaatgccgctccgggtaaagcttatttttgtagaagctatcagctaaatgtaatcaatggtagtcagctttatggaccatatctaggaaaattctatggttttctagattcaggtgatgagacgggcagtggaaaaacagcaccaggactccatatcttgagtggttcaaaggtctctcttgactatgatcgggcagatggcgtcagcgatgaaggagaggctgtcgatacgctacccgggaatgtcacatttaaagtcagtggctcaggaagtgaattttcggtaaatacaaagatcaatattaccaacgacaacaatcgcggaattatccaaatgagaggctcaggatcaagagtcgctgtgtcgaatgatgggaaaatcacaatcaatacagcgactactggcggatttcgcctgcaaggagattctagtcaaatccatgtatcaagtggtggacaaatctcggtcaaaatggctggagatggcgaccaacctggaaacaatgggatgcgttttgtagggaaaggactttctttgatcgtagaaggagccggatcagtcatcgatattgataagcaaagtggtcgttctagcgcagttcgttttgagaacggtacgcaaaaactaacagtaactaatggaggctcattgaaggtaagaaatgcaggggatggcaaatcttatgtgaacagactcaatcaaggaaaccaagcgatccaattttatgacgcttctggttttctagaaagtccagggtcagctgattttacggttactggagaaaaatcaaatatcgatatacgcgcagattccggagctaccgtagatacaactggagatattgatttgaactttatggctggcgaaaaaacttatttagtcatggtcgggaaaactggggaagataagactggcatcatcagtggggatgtgttgaatgtagacttagaatctcctacctatttcgatttccaaaacaaacggatcggaagcgagactaatggcataggtggctgggtatttcaaggaaatggcgattcttctttgaagatcgctcattcagaaattgctttatggcgaaaggcaggagcaacgttcgataactttgaaaaagatccggattatttttctgatatgacagacttatcgatcaatggaaccgacttaggtaattttgtatcaagccctagtgcaggtttaacaaatgaatttgctcagacaggtgccggaatgaaaaattataatcgaatcagtgccaataaccagcttccgatgattgaatccttaagagtaccaacgaatgcagataaaaaaatctatgggcatgtcgttgttcccgaaggtgtcgaggcaaagccaagagatgcttggacaggcgaagtagaagtgactttacatattacttatgcagatacgacgaaatcacctgtagaaattactgctctcacacaaggacaaacagatgaaaatgaaggggcaggatataatccgtggggagaaggcgaacaaggcggtttgtttgaggttcaagtacccaacgaagaaagactaacaacgggggatcaagtgcaaatagttgctgctaaaaaagtaagaggcggccaagaagtgacagaactggactctgccaaaacgacagtcgatgtgattcctcctgagcctgctaaattaagtaccacattgatcaatgcagcttctcgctcaatcacaggtacaggcgaagcaggagctttggtttcattgaaaaaaaatcaagctgttttgtccgaaacaactattgatgatacagggaaatttgttctttctatcccagaaaatcaactttttgcaggagatgtattagaaattgtattaaacgaccaagcaggagaagctgctgctaagggtgtgcagaacaagccaagtaccaacgatgaaattgggaatcacaatccaagtgatacgccagttgtttatcatgatgccccgccttttgcacctgctacgaagattgtagtagaaggtggtctctcatttcttgccccttccaaactcgattgtggtcagatcaaagcaactgggttgacgcaagaagcatttggccaaatgaatatacaggaaaaattatggatttatgatcagcgagaaacaaaaagtccatggatcttaacgataaaattatctcagcctttcacaaccgatgcaggattttctatgcaggatgtcctatatttcaagaaagctgaggagtatcaattagtgaatgaagaagaactggaaattgtcagaggacaaaattcaacgaatgtgcaaacagattattcagaatatttaaataatggtcgggcgtttaaacttgtcttaaccaaagaaaatcagatagctggtaattactcagcagagatgacatggacattagcagatgcgccgacagaataaagatcaaggaggatgattgatgaatcgaatatggaataaaagtcatcgaaacaactgctctttacttctgatccttctccttggattcatcctttggcagacacctgtccatgcctccgaattcaattttgcggtagattttgaattaccggctaatcagattgataagaacaaaacatatataaatgtaaggatggagcctgggaaaacacaggaaatcctctacacggtctttaaccgaacagataaatcagtaacagttgagacattgatccactccgctacgacgaattcaaacggtgtgatcgaatatggagaatcaaaaagtaaatttgatgaaacattaagttatgatatgaaaaacttagcaaaaacagtgggagaaataactgttcctcctcaaagtgcggtcactgagacactttcactgaaagctccagaaaaagagctggctggtgtggtcgcaggaggaatcacatttcaagaaaaaaaagagaacgtttctaacaaaagtacagttggtgtcgtcaatcagttttctcaagtgaaagcaatcttgattcgaaatagcgaaaaagagtcttccccaaatttgaaattaaaaaaagcttatgcggatcaaagcgatggaagaaatgtgattaaggcgaatcttcaaaatccaaatgcttcttatatgttcggcttgactacatcggttgaaatctacaaaaaagaaacaaaagagccttatctttcaataaaaaaagaaaaaatagatgtagcacccaatacaaattttgatttacttgtcccattagaaggaaaaaaattagctccgggacattatcaagcggttgtgaagggtgcttggaaagaaaaacgctggaatctccataccgattttgaaataactgatgatgcagcggaccaattgaatgaaaaggatattgatttaaaaaatcagccagaaacatttgactggcgatggctgatacttgttggagtcattcttattggcttatttgctggattatttattttaaaagaaagaaggaaaaagaaatgaaaaaaacaattgcattaagtaccgttctagctggaagtctattattatgtacacaaagtgtttttgctgagaataagagctcagccactacagaaggaacgatttctgtaacaaaaccagatgccgcaaatcctgaggacgttgttccagttcctcctgttgatccaaatgatcccgatacgccgtttacacctgacgaaccaaatcagggaacatccggattactgacgattgaccaagctccagatcttgattttggaacaatcaagttaggtacagcaaaaatagtatatgctgcattacaaaacggaacggacagtacagggacagcaacacaagtacagaatttcgtacaagtaacggataaaagcggaatttatgccggttggaaactatcagtcaaacgaacagaatttattggtacaacatctgatacgaataaactaactggttcaaaggtgaaattcaaaaacgccgtgattcgaaatagcgcaactaatagcagtggaacgccatctactatttctggtactggcgctgaaggaattgagatcccagcagatcaggcagtagatctagtaactgcaggagcaaatgaagggattggcacatggatttattcattaggagagaatgtggaacaagggagacaatcagtggaattatttgttcctgtatccaattatgccgtagacaactacgtttcaacattcacatggtcgttaacagatgctcctacagaagggaaagcgtaaaatcaaatcaatgacttcagggagtggagccgattcaaggccaactccctgaaatctgctatgcttacgtctcagctcttattcatcaactcgaagcagttttttggaagtcatggaaacgttcctttgtcttttcaaagatctttcgaccaacgagtaaggagtcaccattgaaaaattctaacacataatgagcagaatcaattttctgcaattgcgataagttgatacagtaagattttaatagtaaaaagtaagcatacttttccaactctgtcttcaattgttttaaagaagtattcactaatttatcttctgtagttgttttgaccataacttggtttttcaaacctttgatactttcaatatataaaatttcccgaggatacaggacgagacttccacctttttgatcaataaagattttatcgacatttacgatttgctgttctttccaattgatctattctagcacttgacgaatttgttcagataaattcctgtcttttctgatatatccaatcggaaggattttccgattgatgatctctactgcaaaattcgtataagcggtgaaaaaaacaatattactatgtgcattttttttacgtatttgttcggcgacatcaatacctgtgagtgattgcttcaagtcgatatcgataaagaaaacatcgtgattatcaatagtgcccaactggatcaactgattgatttgagagatagaagtgagctgcacgatattctcgatatgatgattgaccaattctttgatgatccattcgctgtgaaactggttatcttctatgataaaatactttttcatatgcaggctcctattaaaaaaatatgtgtacattttgaaacaaaacaatggaggaataagatggtcgcaacagtgacactttatttgacctttactttgattttagatttaggtatctatttattcttttcgaaacaactgctagtaaaaaacagctttggttgtatagctttgatggtggtgacacttttatttcctatccctaaagtgagctttccttacctagttggcttattattgatgtttcttttttattttactacgaaaaacctgtttatcagctgtttgatcagtaatcttttttttgctatcactggactcagcttttttctggtttttgatctgatggattatttaggaaagagatgatggattatttaggaaagagacatcttggaacagcaagtttttttgcactacttatcgcatttattttctatctattagtaaaaagtatagacaaacagacgagatttctcaacttgctttttacttatccaactgaacactattttggaggtatttgtattttattaagctggggcgtgatttacttggtattgggaagtgttcacttccgctcatctaattatctgcttctatctcttttgtcgatagtcatcagttttttttctttgtttttttccattatgttgatcagtttccaagtaaaagaaagacaacatcaggaatcgcttcaactgtatcaaataaatgaagaatattaccatcatctagaggaattcaaacatgattataaaagtctactgttttcattaaaaattactcttcaggaaaataaaaaagaaacgttggaatttttagaaatcttagaagatcattctgcagctatttttgaaaaaccgcaaatacaacagctaacaaatattgtatccccagctgtcaggggtgtctttttaaaatttctagaaaaagcagaatcggagaaaatcccgatccaagtagttattcctgtcgaagtgaaaacaatcccgattgatctggttgtttttattcgctgtttatctatttttatttctaacgcattcgatcatcgtgtagccgatcagagtccgattacgatcaatctgctggaagaaaaagagggattacgttttagtatagcgaacaaggcaaatccgacgaatttgacgctatcggagatggtcaaaagaggaaaaacctctaaaaaaaatggcgggttaggtctatacagtgcgaaaaaaatgttggatgtttacgaaaatgcagaactaaaaatcgaattttcaaaacagaatcactatttttttgtagaaatgtatctggcatctagaaagagcaaatcagcctactgacttactgtcaaaggataagcttgaggaaagtctacacggagatagagacaacaacacagcatattcaaaagaaacagaagcgtgatgaccgttgtcacccttctgtttcttttgctatgtagttaaacaaagtagttgacacttccgctacttagtattagtacgaaagtatacttcatgatactaagtagataagaagtgaaaagcggaacccacgatcgtcaaaatgctaactgctttgcttacaccagataaagggaagagcaatatcgcttattttaggcgtggagaagcaagaaaatccctacgatcacacaaaaaatgctgacccagcagttaagagagttagaacaagatggcattgtccatcgaaaagtctataaccaagtcccgcctaaagtagagtactcgctcaccgaagaaggaaaatcattaagagagattctagtagcgatgtctgtttggggagaagaacgtatcgaaaaacaaaaagcctcaggggaagaagtcacattactgcatacacatggtggctacctaaattactgatttctatgacatttattttaaataaaagaaaacaggagtttttttaaaagcatcatctattttttatgtaaaaaaatggtatgattaatcaagtaagaaatgattggaagaaggcaagcaaatgaatagcatggaaaaagttaaccagtttagagatgaacgtaattggcgacaatttcataacgaaaaagatttggctatttctatttctttggaagcatctgaattgttagaactttttcaatggaaaacgccggaagaagtaaaagaaacacaattagaacgaatcaaagaagaactggcagatgtattgatctattcatacatgatggcagacaaccttcagatggatctagatgagatcattgaagaaaaattgatcaaaaataatttgaaatatcctgtagaaaaaagcgcaggtgtacgaaaaaaatacacagagttgtagaaatgtgtcattcggctgttggaaagagcaaaagaaaaacagtaaaatgagtctggagggagagaaaatgaaaaaaaaaggaaaagcagaaagatggctagtcaatatcctcttgttcctcttgttattagtaggactagctttgattttcaatgaacagatcaaggattatcttgtcagagagacaggagataaatatgctatagcgaatgtaacaaaagaagatctgaaaaagaataacgataaagatgtcagttttgactttgatgcggtagaaccaatgacgacagaaggggtcatgaggtcgcagatgagaggaacagatctaccagtgattgctagtatcgcagtcccttcagtttcaatcaatttaccgattttcaaaggcttggataatacgtcactactttacggagcaggaacattatctccagatcaagaaatgggaaaaggaaattatgccttagcaagccatcgtgcaacgaaccctgaattgctgtttacaccgctagaaaatttagagatgggtgccaagatctatttgacagatttagaaaatgtgtatacatacaaaacattttttaaagaaaaagttgctcctacagatacccaattactgaatgaagtcgagggaaaagaaattgtcacactaattacttgtggcgacatggacgccgtcacgcgactagttgtacaaggagaactggaaagtgttacaccgataaaagatgcgacagatgatatgagatctgctttcaatctagagacaaaaacattttaggatactgggacataagtcgttacagattaaaaacagccaaaggatatgaatcgataaggaaaaacaatttgctgaaaaaaagaggaacgcaaagaggtgcatctctgatttggttgttttctagatagacttgtgttccagtttttttattttttatatgaaaaggcttgcataaataaaaattcgatggtatgatgattttgaataagaaatggattgttactgtacggcaggcaaaaccagaattcagctaagaaacagtaggcgaattctaggtttttttatttttcttgagagggcgaagcaaaatgaaaattgataaaattttgaataacaatgtcgtcatttcgaaaaatggattcggggaagaagtcgtttgtatgggaaaaggactagcttttcaaaaaaagattggggacgagatttcgccagaagcggtccaaaaagaatttgttttaagagattcttttgctaaaaaccaattccagcagctgatggctgatattccggcagaggagatcgaatgggtcaaacaagtagtcgaactggctgaagataaactaaaagttgaattttcgcctaatatttatctgacattgaccgatcatcttcattatgcgatcacacgagcaaaagaaaatatccaactgcctaatccattattatttgaaacaaaaaaattttatccgaaagaatatcaagcagcgaaagaggctcttttgttcgtgaaacaaaagacgggtgtggaactttctgaggatgaagccggttttattgcctttcattttgtgaatagccaacaaggaaacgaagacatgcaagtgacgatgaccgctaccacaatggtaagagatatactgagtatcatcagtaaattcttcggcatcgtgttcgatgaagaatctttgaattatcagcgtatcattactcatctgcagttttttgcccagcgttatctcaaaggggaaggatctgacgagcaagatgaatttctctacgcattagttcaaggaaagtatccaaaagcgtttcattgtgtcgaacggatcaatgagtatcttcgacaaacgcaaaaacaggaaatgaggatcgcagagcagatttatttaacgattcatattcaaagagtagtaagtgagaaaaaaagcatctaatcataaggattgttactgtatggcaggcaaaacctggattgaaaaaataggttcacgaatgtttgtgactgtttttttcaatctgggtttttattttttaaataaaaaagaaagaaggaaaaaacaatggataatcaagcagttggtcgtcgtgtatgggaagcggtaggaggacaaaagaatgtcaaaagtttagtacattgtgctacgcggttgcgattcagattaaaagatgaatctttagcagatacgcaaaagttaaaagaagacccggacgtgatccaagtcgtacaaagtggcggtcagtatcaagtagtgattggcagtaatgtagcagatgtttatcaatcgattgtggatgaggaaggtcttgcagtttcggaggatggaaaagaagagtccaaaaatattttgaatcgtctgatcgatattatctctagtatatttacaccttttctaggggcgatggcagctgccggggtattgaaaggattcttatcattggcaacggtgatgggctggctgacagctgatagcggtacttatcaaatattgtttgctgcagcagatggtgtctttaccttcttacctgtcatgcttgcttttacagcagctaaaaagttcaaagccaaccagtttttagcagtagcaattgctatggcacttgtgtatccagctatcacagcagttgctggtgcaggagaagctatcagtttctttgggatcccagtgattctttcaccatctggttatacttcttctgtcataccaatcattctagccgtatgggttcaaagtaaattagagccattcgtaaaaaaagtgattccgcaatttctgcaaatgattttagttccgcttgtcgttttagtagtgatggttccattaacatttcttgctttaggaccaatcgggacggttgccggtaatgctttaggcggtctcttcaactcgatttatggatttagtccaatcgtagcaggtctaatcatgggaagtttatggcaagtattcgtgatgttcggcatgcattggggattcgtaccgatcatgtttttgaatatcgaacaatatgggtttgatgtattgatgccaatgcttcttccagccatcttggcacaaggtggggctgctttagctgtagcattgcgaacaaaagatacgaaacttcgagcattagggatttcttctacagtgacttcgttatttggaatcactgaaccaactgtgtatggtgtgacattacctttgaagaaaccattcattgccgcttgtatttctggaggtattggtggagctattatcggattttccggagtaaaagctttctccagcagtttggtcagcttattgacgattccgactttcattagtacggtggatggtgtagagtcaaatgtgacagtagcagtaatagctacaggaattgcttttgttcttgcattcgtaggtacattgattttaggatttgacgaacaaacacaagacaatcaattagaaaacaaacatgcgaatgcaggagaaccgattacttcagcacggcataccttaaaaagtcctttaacgggtaaagtactgccattgagtgaagtaccagaccaagttttttcttctggcgtgatgggaaaaggtatcgctattgatccagaagtaggagaactagttgcacctgcagacggagagatcacgactatttttccaactggacatgctgtagggatcacaacgactgacggagcggagattttgattcatatcgggatggatacagtagaattaaatgggaatggctttgagatcttagtcaaacaaggggatctcgtccaagcaggagatttattgattcgttttgacatcgaagcaattagagcagctggctatagcgtaatcactccagttgtcattacgaatactgatgcatttgccgatatacttgaattagaccaaaaagagattattgcaaacgaagatgttctggcaattgtaaaataaggaggaaatcaggatgcaatcacgtttttcagaaaaatttttatggggtggagcaactgctgccaatcaattagaaggggcttatgatcgagacggaaaagggctatccgttgcagatgctatgcctggaggtaagcagcgctttgcgattatcggcagtgaagaatttgactggacgattgatcaagaaaaatatatttacccgaatcatcgaggaatcgatcattacgatcgtttcaaagaagatcttgccttgtttgcggaaatgggattcaaatgttatcgtttttcgattgcctggacacgaatttttccaaatggagacgaaggtactcctaacgaagcgggattagaattttatgataagctgattgatgagtgcttaaaatatgatattgaacctgtgatcacgatttctcattacgaaatgcctcttcatttggcaaaagaatacggtggctggaaaaatcgaaaactgatcgacttctatgaacgatttgctcagacagtattagagagatacagcagtaaagtcaaatattggatgactttcaatgaaatcaattcggcctttcactttccagctttaagtcaaggattagtaaaaagcaatggagcaggagagtaccaaaatattttccaagcatggcataatcaattcgttgcaagtagcaaagccgtaaaaatcggccacgaattgcgttcggatatccaaatcggctgcatgattatctatgcaacaacttacagcatcgatgccaatccagtcaatcaggcagcaacaatgatccaaaaccaagaattcaattttttctgcacggatgtccaagtacgtggagaataccctgcatacacagcgcgtacccataaaaaatatggagtcgatccggaaaaattagagcaaacggaaaaagacttccagttgctaaaagaatatccagtggactacatcggatttagttattatatgtctacggcaatcaatgagactgatccacaagcagcaacttcagaagggaacttgctgggaggagtaaaaaatccgtttcttgaggcaagtgaatggggctggcagatcgatccagaagggctgagaatcgcattgaatgaattatacaatcgttaccagaaaccattattcattgttgaaaacggtcttggagccattgatcatatggaagaggatggcacgattattgatgattatcggatcgattatttacgtcgtcatatcgaagcgatggctaatgcagtagcagacggtgtagatttgatgggctatacgccttggggatgtatggatcttgtcagtgcatcaacaggagaaatgagtaaacgttacggctttatctatgtagatctagacgatgaaggaaatgggacactgaatcgatcaaagaaaaaatcttttgattggtataaagaagtaattgcctcaaatggcgtaaacttgtaattaaagcagctgaatgaaaaagaacacacttctcacatgtgatttgtgttctttttttattttttatgtgctattcttttagtaatagtaaagcaaagggtgacgttatgaaaaggacacgtgtactatacttggaagtcgcagataaaattaaagaagatattttctcaggaaaatatccagtcggttcgatgttaccgacagaaagtgaattagaagaactgtttcaagtcagcaaaatcactgtccgaaaggcaatcgaactgctggcatcagatgaatatgtcgcaaagaaaagtggtcgtgggacgacggttctaagcaatcgtccttacaatcgattatccaaagcggcaagctttacgcaaatcttggagaactcccgatatgaagtccggaaagaaacgctggatttgcaattggtccatataaagaaggaagatcctttgttttcctttttcggtgagcaagctgtttgttttaagcgcttatattatttgaacaatcagccttatatttattttgttcattatcttccacaagaaatgatgcaattcagcagagaagaatttggcaaagaatctttgtatcgtttgctgacgaaaaaaggatatactattgactcattttctgatgatttctcggcagtatttttaacagaagaagaacaaggaattctgaaaacagacgcacagatcggcatcaaacggatacggaaatcgtctacgcaaattggggaaatgattgaatattcggaggcggtctaccatacggagctgcatccttaccatattgattatgaaacataaataaaaaaagaggttgtgaaaaagctgccctgcatcaagtaataagaacagccaaacaaaaatagcttctcatatttttcgtttggttaggcttattaccgcagatacacggctgtttctggattaccatttattctggataagggggtgtggcacgattttcagaaggaatctatgaaccaatcactgtattgattttagcttcgatggtaaccccattcggcttgacgatcgcttatttcttagggaaaatcattcgtaaaaatatattcaatcgtcaagaaatcgatacattgaagaccgcttttcctatggggatctgtcagatcacagagggatgtttccctatcgtattgaacgacttggcacgcaatgtcatagcaacgggagtcggtggggcagtcggcggtggattgagcatgttttggggcgcagatagccgtattccggcatcgggaatgtttgcagtcgctacgatgaccagaccatgggcattcattggtgcattgttagctggttcttttgctacgggaataactattttattattgaaaaaaccagttgacccaaatgcagaagtcatccaagaagaaaaagaggaagaagagatatcttgggatgacttgacaatcagttaggaggaacagaatggattacaagaaaagagtacaacaaatgttcctagattcaggagtagtattgaaagaaacagaattagaaagaatcgaatatacagattttggattaggagcaatcgagactgaaggattgaatttatttgtttatgaaaataatgagcgatactgtgggaaagaactggtattattgccttatcaaacttgtccagagcatcggcacccacctcgagatgagaatgaaggaaaaaaggaaacctttcgttgtcgaaaaggcttagtatatctttatgtcgaaggaaaagaaacaaaaaaactttcctgtattattccaaaggggcaagaacgttactatacggcaaaaaaagaaatcatacttcacgctggagatcagtacacgatcgaacaaaatattaaacactggttccaggcaggtgcaacaggcgcggttatcaccgaattttcttccagcagtgatgatccaagtgatagttttacgaatccagctatttatcgttaatacaaaggtttgggaacaagctgatgaaccaaaatgatcaaatttcgattatttggttcgtcggcttttttatttagagaaacatcaggcgttggtgaaacataacacgagaataaaatggatttttcattaataggagaaacaagtgtgtgactatttaaataatgcgtgttattgacatgcaggacgaaatcccaatttcttctataagtaagtcgtttcaattttatatttactagttatttatttttttggttactgtaaaatagctgaaaaattatttttttgcaaatactatatatagtggtgtttgatctatataccactaaaaaactacaaaatctagtcttttattttaaaaaaacacgtgtagaatgaagatagacttttgagttagggagtgtttttttatgaaacttactgttttttgcggttcccgttttggcaataaagaaagttacaaatttattgcgcaaacgttaggaaaatatatggcacaagaagaaatcgaactggtttacggtggttcatactccgggattatgggagtgattagtaaaacagtactggaaaataacggaaaagtcacaggtatctatccaaatggcctttttgaaactgagctgcctgggaaagatgttactacatttattcctacagagacaattgatgaaagaaaggtattattatttgaaaaaggagatgctgtcctcgttttccctggaggtctaggtacattggaggaattttcgcaacttctttcttggatagcgatcggcctgacacctgataagccaatcggaatattgaatattggcggttattacagcggcttgcaacaattattagaaacttttgcaaaagaggattttatggataaaaaatggttggatcaagtgatcttttccaacaatccattggaactggtcaatgaattacgagcagtatctattaaaaatcagttattattgaaggaggcaaaataatgagtcaaatatatttagcaggaccatttttttcagaggagcaaatcgatcgagtaagtcgtatcgaaaaagcgttggaggaaaacaaaacagtcacaagtttctactctccacgtcatcaccaagaaagcaattatgaactattcagcgctggatgggcgcaggaagtatacgaaaaagatatggaagagttgacaaatgcagaatttgttgtggctatccttgactttgagcatcaaacaatcgatccaggaacggcttacgaattaggtgtggcaactatgttgaaaaaaccgatgatcatcgtacaagaagagacggtacctacgaacttgatgattacacaaagtcttcacacgtatttaaaatcagaccaagctgtacgtgaatatgattttgaaaaattgcctgttgaaacttacgtaggcgagtacttatagaagaggaagggttgtatgtcagtgattttgatttcaggaacgattggtgcaggtaagagcagtttgacggatatgcttgcaaaagagattgattctaaaccattttatgaaaatgtcgaagataacgaagtattgccgcttttttattcaaatcctgagcagtacgcatttttattgcaaatcttctttttgaataagcgatttttagcaatgaaaaatgctttagtgaacgatgacaatgtgctagaccgctccatctacgaagatagtctgttgttccatctaaatgctgatttaggtcgggtaacggatatcgaagtacagcagtacgatagcttattagatacgatgctaaacgagttagatgatgttgctccaaaaaaacgtcctgatttgatggtccatatcaaagtttctttggacacgatgctagaacgtatcaaaaaacgcgggcgtgactatgaacagctagaaagcgatgaaacgttatacacctattacgaaacattgaacacccgctataatcaatggtatgaggattttgatgtatgtcctaaaatacaagtggatggggatacattcgattttgtagaaaatccagaagatgcaaaaaaggtgattcgtcagatccaagaaaaattagctgaattggaaggaaagcctgctggaaaatattttacagataatcagcatgcgaaaggtcaagaattaggctaaaagtaaaaaaccaaacgacgggaaagaaaaattactacgtgatgtagaataagtctttctatcgtttggttattttatattcaaagatgtgaaataaataaaacgttactctttgatttgtgaactgaaatgatccactgtttgttttactgattccagtttttgaagcttgatcaaaggaagaagctgagtttgaagttcataaaaatcagccatagtgagttttgcttgattttgcttatcttcttttgctttttacataatttttgacaggataagattcaaacgatttaaaagaatctttgactagtttgtggcaattgtcgcatatactcaaacttccttgatcattaaattctgtatggatatttttgttgttattacatgtacaataatcaggactatcgatcatccatttcgtctcctttacagtcatcttgcttctttactatagcagaaaagaaggggagaaacaaaagaagatccaacagatggcactatagactgtagatgttgccatccttatccttcaaacggtaattaccgattttggtaaatgtgactgttgcttcttttttattttcttttcctgaaataatatattcgtcatctttggtagtaatcttgatatctgtcagcactgttttttcttcagatgattcagaagaatcagctccttgtgtctgatacgtgcgtgtccattccatttttttatctgtaaatgtcaactgtcccgcggataaatccatatctttacgtacttttagcgtatatacactgttggtgatatctgctttttccgcttttaagacagaagaatcggttgtttcgtccgaggattggtcagagccgccaaacaaatcacagccagtcaatgtcaaaagtcccgcagacaaaataaatagtacgattaatttcttcaaaatacttcccccatttgataggataaagaaattataccattggaaagtaaaacttcaaacggatggaagagaaaaaattcacaaaataccattaaatagaataatttttcaaaagtcataaaaaatccaccacctttagaaagcgttttaaaaaatgtgttgcaatctttaaaaaagtgctatattaaaaatgaaccggttcaattttagaatctaggagatgaaataatgaaagtcgtagacagactatctgaaaaaatgctaccaatcgtatctaagatgagtagccagcgacacttgctggccattcgagacagttttatcgttactatgccgttagtaatggctgcttctgtcatggttttgctgaatgctctgattttttcaaatgcaacagtccaaagaatacttgatctaagtccattggctgaacttgcttcaatcgtgaataatggtacgatgagtattttagctattatcgtgtgttacaatatcggctggaatttggcaacccactatatccaaacaggcgtgattgatgatccatcatttagtcctgttcatgcaggaattctaagtacagccgtaatgtttattttgatgcctttatcaagtacagtcactttgatggacggaaatacagcagaagctacaggggttttcttacaaagtctgacttcttcgtctggcttagcaacggcgatgattgctgcccttgtcagtacagaattatttatcaaattagcgaaaatgaagagttttaaaatcaggatgccagaaggagttccaccggcagtagctacgtcatttaattctttagtaccagaaatagttgtcattttatttttttcagttgtcgtttttactttaaaccatacgactggtttgaatgttccgcaattaattgaattagcgattcagacaccattgaaagcttttgttttatccgtcccaggcatcttatttttacagtttttctctgatttcttatgggtgtttggtatgcatggttcgagtattttggctcctatacggcaagcacctttgttacagtctattcaggaaaacatggatgctttttcagtaggaaaagaaattcctaatattattacggagccctttaccaatgcatttggattgatcggaggtggcgggtgtattttaccgttagttattgctatcttgtgggcttctaaacgtcaagaacagcgatcaatcgctaaatttggtctgactacttgtttatttaatattacggaaccaattatgtttggattaccagtagtcatgaatccaatatatatgattccatgcgctattataccatctattaacttggttattgcctacgcagccacaagtcttggaatcatcagtaaaacagttgctgctgcaccttggatcactccaccggttatacaatcttttattgctacaggaggcgatatacgagcagcagtcttaacagtaatacttatcattctagatgtatttttattcctgccatttgtattagccgctaataaggcaaaattggcagaaggaggatattaaggtgtacgattacccgtatcaaaacccaaagttaaccatccgccaaagagtagaagatttactttcgaggatgaatattgctgaaaaagtaggacaggtaaaccagcatttgtatggttgggaatgttatgaaaaaaacggagacaagatcgaattaacagaaaagttaaaagaacatgttaaatggggaggcggtctgggtgccttatacggtctgtttcgctctgatccgtggtctaaaacagattataagaatgggattcctgcaaaagaaagctggaaggtggctaacctagtccaagaatatgtactacagcattcgcgatggaaaattccagttttgcttgtagaagaatgtccacatggtcatcaaggcttggatgggatttcttatccaacgaatatcggccgtggaaatactttcaatgtagcattattagaacaatcgagtcgattgatggcaaaagaactggctgctaaaggtgttcatttagcgctggtgtcgactttggatctggcaaaagatcctcgttggggaaggacagaagagtgctttggggaagatccgattctctcagctcgtttttctgaagcggtcgttcgagggttccaaggagagattatttcagaaaaagtttcttttcttgatcagacagtagaggaaatcaataagaagaaggatcagatcggtgttgtgttaaagcactgtatcgcacaaggagaagctttaggcggtcataattcaggcacagtaacgattggacgcagagagttctccgatatttacggaccattattgaagagtacaagaaatgcagtaggtgtcatggctgcttataatgacatcgacgggataccttgtcatatcaatcgagcgctttttgagcaaacattaagaaaagagatcggttatcaagggatcgttatggcagacggtgtggctttggatcgtttatccgatgtttttacagataaaaagactgctgcagcatatgcattagcggcaggaatcgatctcagtttgtgggatgagacctataccaagattgcagaagccattgataatcaagtcgtagatgaaaagctactagatcaagcagttcgccgagttttatctgtcaaatttttattaggtttatttgaacagccatttgcaaacgatccaaaggagtattgggatcatctcatggaggaatcagagcacttaaatttagagacagcaaaagaaagtatcactttactaaaaaatgacggtatattgccgttggatcaacaagtaaaaaacattgctgttataggtccaaatgctcacgatgtttaccacttgttgggagactactctgcaccacaaacagaagaccgtttgaaaaaaacgatagtacaagagataaaaacagagtttccccaatcaaaggtttcttatgcacaaggatgtgaagtaagaaatcaggaggatcaggaagaaaaattattagaagcggtgacccttgctcaaaactcagatgtgatcattgcagttctaggtggatcaagtgcgcggaactttgatatggaatttcttcgtaacggggcagtttcatcgaaagggatcaacatggattctggagaaaatgtagatgttgcttctctttctttaggtggataccaagaacagctgattgaacaattgtatcaactaggcaagccaatcatcacgatacttgtgcaaggaagaccctacgatttgatgaaaatcgagtcatttacgaatgccattgcaacagcatggtttcctggacaggagggtggaaaagccattgcgcagatgatttctggaagaaataacccaagcggacgattgagtttgtcttatcctagaaatagtcggcaactacctgtttattactatcagcgtgctgcttctaaacaagagaattattatgatttaagcggaagtccattttatccttttggacatggtctaagctatacaacatttgaatacagtcagatggaagtcaaaacggatattgacaaagtaataatatcaattaaagttaaaaatacaggaagtgtttcaggtaaaacaagtactcttgtctatgtccgattaattgacggcgctgtcatccaaagaacgaaattattgaaagcttttcgtaaagatgaattgcggtctcaagaggaaagactgcttgtttttgaactcacttctgaagactttagttatatggatattgatgacaagcggcattatgcaaagaaagcggtcatcatggtcgaacaacaagaaaaagaaatcaaatgtaactggcaggagtgaaaatgtatggcatcgatccgtgacgtggctaagatggctggtgtttcagtgggaacagtttcccgctatttaaacggtcagcagctgaaggaaaagaatatggaaaaaatatcagaagcgatttcagcgttggactataaagaaaacatcattgctaaaggattgaagaataatcgaagtttctctattggactgttgataaacgggatatctagccgatttggttcggaggttgtttcagggatcgaaagagtagctgaagaaaatgggtatagcttattattaagcgggtttgccgatcagccagaaaaaatcgaacaaaaaatcgaatacctgatgaagcatgcgatcgatggattgatcgtcttcttatcagaagaagagtggtctggatttgaaatgctgacaaaaatgagtatcccagttgtcgcattgaattgtccggatgggccagcaggtattgatacaatagtagtgaatgatcgagaaagtgtagcaaaagtgattgctcatcatggcggacaaggacataaaacaataggatttattgctgccgctcaaacagattacgtagcaagagaacgtttagctggagccaaagaagcggtacaaaaggatccgtctatccatttagagatctttacaggagactattctagaaaaagcggctattacggggcaaaagcattattagaaaaaggggcaactgctatttttgtcagcaattacaacatgtcgattggtgccatcgaatgtttcaatcaagaaggtgtcagaatcgggaaggatattgcgttcagtcactatgattatttagataaaaacgatctgagtatccttccaaaaatcacgatcacgccaccaacagataaaatcggggaacgagcagcagaacagctgttgaaacgaatcaaaaaagaagaggaagaaaatgaaaaagtgattgtgatggaaaatatcatacatggaatcaactaaaaaagaaaaagaggtgctttgatgaaaagatatcaatttccaaaaaatttttggtggggctctgcagcaagtggtccacaaacagaaggaagaatttcaggcgatggaaaaggagagaatatttttgattattggtacaaaaacgaaccgcaaaagttctttgatcaagtaggacctgaaaaaaactcgcaagtttatacgaagtatcaagaggatgtacagttgatgaaacagactgggcataattcatttcgaacctctatccaatggagccgtttgatacctgatgaatctggaacaatcaacgaagaagccgttcgtttctatcatcactattttgatgagttgattgaaaacggtatcgaaccttttgttaatctgtatcatttcgatatgccgatgtatctgcaagaaaaaggcggatggttgaaccgagaaacggttgaagcctatgaaaaatacgcaaaaagttgttttcaattgtttggctcgaaagtaaaaaaatggtttacccataatgaaccaatcgttccagtcgaggcaggctatttgtatcgatggcattatccggaagaatcagatatgaaaaaggcaatccaagttggttatcatgaagcgttggcttcagcattagccatcaaagcttaccatgaaatggatcaaagcggtgtgatcggaatcatcttaaatttgacaccgagttatccaagagacgaatcaaatcccgaagatgttaaagcagcacgaatagcagatgcgttcttcaatcgttcattccttgatccagctgtaaaaggcgagtttcccagtgaattgattgagagaataaaagaactcgatctaatgccggagattcatccagatgatttgacgatcattaaagaaaacacagtagatcttttgggaattaattattaccaaccacgccgaataaaagcaaaagaaacaccaatcgatactaaaagcggtcctatgcctgaggattacttcgacaattatgaaatgcctggtcgtaaaatgaatccttatcgcggatgggagatctatgaaaaaggaatctatgatattttgatcaatgtacgagatcattatgggaatatcgactgttttatttctgaaaacggcatgggtgtagaaaatgaagcacgatttatcaaggaagatggtatgatccacgatgattatcggatcgaatttgttcaatctcatctgaaatatgtccatcaagccattcaagaaggtgccaattgtttaggttatcatatgtggacatgcatggataactggtcgtggaccaatgcctataagaatcgttacggttttatttcagtagatttagcacaagatggaaaaagaacgatcaagaaatcgggtcattggttcaaagatgtatcagacagaaatggatttgaagcttaaagaatagccaagagagaatgtatgaaaattcccgttcttaccgcttcaggaaaaagaagttcaattatttacgatctttttcaacttttttgtctttctatttcattttttgtatataatagaatagtcaaaattaaataggagtggaggaaggcatgaggaaaaaaagaccgtttcttctcttttggttattcggttttttcttactgcttattttatccgcagcattttcaggaaaaatgacagcagatcttgctcagaaagaaacagaaaaaatcgtagcaagcaaagaatcagtagataatttcaaaaaagaattctcaacttattggtgggaggaatataaattaactgccaattacgaaaaaggtgaattggacatctatttgccaaaaggaaaagaagaaaatcaatttatcaatatcgatgacgtacttagtgcgatttctctcagacaatatcaattcaaagacaaacatttggtcgttttgcttttgactcatgatggcgacaaggtagcacgtttgaaaaatggaaaagtggttacagcttattctgaaaaagtggacaaaaaagtggtggccgatcgactagcggaatggaaaaagaccaacgaacaagtcaagaaaacaactgcttcttctcaaaaaaacgagtcgacagaactaagcccttcagattctggcagtggacaaacgataacgggaaatgaagaaaatcaagcctcaatcattacgaatgagtcatcagaaggacaatatcaaacctatggacaatgaaaaacagaagttgtgacagaagtggtcagcttcaagaaataagaagaaatttacgaaaagtgcttctcaagtttttgtaaaatttcggcttatttccgaagaagctacttctggaacaccgtgaatcagaggttgtgaaatcagcggtttgacctgagtattagagaaaaaaacgggaaaatagctcctcatattttgccgttttttgagctaataccgaaggtcagctgattgaacaccgtttagtggagaggttgtgaaaaagctgtcctgcatcaagaaatagggagctgcgacaagaattttgtcacagcagtataaatggtattcaaacagctgaccctcgatattcactcaaaacgctggtttcgcaacttttcttttacttcattattttttgaaggcttcttctactatttcttcatctttttttaaaccattaaagatcagattcaatatgatagccgtaatactactcattacgatgccattgccagtgaacatttgcaatgtttgaggcatttgactgaatagtgtcggcgtaatattgaaacctagcccaaatccaacagaaacagcaacaatcaatagatttttatcattactgaaatcaacttccaacagcatacggattccttggactgccaccatcccgaacatgactaacattcctccaccaagtaccggctcaggaatgatttgtgctaacgcaccgattttagggaataatcctaaaacaatcaagaagaacgcagagaagtaaataggttttctcgttttgattcccgaaagttgaaccaatccgacattttgagaaaagcctgtgtaagggaatgtattgaaaataccgcctaagataacggcaagtccttctgcacgatatccttttttcaattcttcttctccaacattctttccagtaatgtccccaagcgcaaaatatacacccgttgattctaccatactgaccatagaaatgatgatcatcagtaaaatcgaccatacatcaaaagttggcttaccaaaataaaagggttgtgggacatggaacaatggtgcatctccaatcgcactcagatcgatcattcccatgaaagcagctaagatgcttccaccgactaaaccaatcaataccgcgatggaacgaatgaatccttttgccaacatttgcacacctacaatgaggagaatcgtcacaaatgcaagtagtagatttgttttgtcaccaaaatcagccgctgttgcattaccgccacccattttttcaattgctactggaatcaatgtcaaaccaataacggtgataaccgttcctgttactaaaggcgggaataatttcttgattttagaaaagatacctgaaactaacacaacaaagatacctgaagcgataatagatccataaatagctcctactccttcattagttccgatcaagatcagcggagctactgcttggatcgcacatcctaaaacaacaggcaagccaattccgaaaaatcggttaacggtcaattgcaataatgttgctaatccacacataaagatatcaattgaaatcaagtaagtcatctgttcttgattaaagcctagtcctgtaccgatcaaaagaggcaccgctactgctcctgcatacatcgctaacagatgctgcagccctaaaaccgcggcttttccattttgtgtttctttttccacgattatgcgtcctcctcaagaaactcaacttgtccattcgtcaaggaagcgatacgtgcaagagaaacgactctcaatcccatttcttcaagcaactgacgtccatcttggaaagacttttcaatgacgatcccaattccttctacttgagctccagcttgctggcataattcaatcaatccttttgccgcttgtccgtttgccaagaaatcgtcaataatcaatactttatcttctgaagacaagaatttacgagaaatagaaatcgtacttgtcacttgtttcgtaaaagaataaacagaagccgtcaataattcttcatccatcgtcaagcttttggcttttctggcgaagatcattggaacacctaattcttttgcagcaaataaagctggtgcgatcccagaagcttcaatggtcacaactttcgtgattccttgttctttaaatacttctgcaaaccgttgccccatttgttccatcaatacagggtctacttggtgagtgacgaaactgtcgacttttagtacgccctcgcctaatatacgtccgtctttttgaatacgttcaactaattctttcactttatttgctcctttatcatttattaataccaaaaaaccgcttttgtgcaaaaacctactatgtttctgttaaagaaaaacaccctccactttatcataagaaaagaagggtgaaatagccaatcttttacttatagtccagcatttacggtactggctagaaactgtcatccatattatgacgatatataagtaggtatgtaaaactaataatagtgtaaaatcattttcttgcaactgttttgcacgtgaaggcagtttgacatatttgaataaagaatgttgtttcaaatattgaaaatagtctaacactactttctgaaactgacaacgtggtttacttatttttttgtaaaatctaatgttttttaatgcattactcttttttgttcgggtttaaatagttatttttattttcatttatccaaaaattctatttcacacaaaaaggattgtgaaaaaaaacgtgtcacaacccctttttcgaataaatagtgttccaaagacaatctacggcaatagcgcacagatttataacgtacaggaaataattttcgtaaattctttcttattccttgaagttgacaagttcgtcaatcgccactgcttttcctgaagcaatagagtgattcgctgcgattcctgtcaaaatcgacaggataccatctacgtgagttgctgctcgattccacggatcttcttcctttacttcgccaaatagatcatccaacaaacgtggatctcctccgccatgtccacctgcttcttgttcaacgattacctcatagggtttaccgaacatcggatagacctggatggactgaagaacggctgctccctcatcttttttatctccaccagcgttgatataggacttttcgatcactttcatttcgatccgtcctttgctgccattaaaagaaacattgaatccttcccacggcatatacgcatttagcgaatacgtcaatatcgtaccggtctcgtatttgaccgtcactcctaacgtatcttcaatagaaatatcatcggaaaatacactgcgatcacgaatgtatccactgtcttcttctgcttccaaatacatttctcgtaattcctcattggctgatagatctatagcaaatggatcatttttggctagttcgcttccatagcatcgactgtaaaatgtttctactccgcgtttttccgcattatgcattccataaaaattcaatccaccaaatgcgaataccttttttggctggctactcaaccaaaagttcaccagatcaaaatgatgggtagatttgtgcacgagaagtccgccactattgtgtttatttcgatgccatcttctgaaataatctgccccgtgctgcgtattcagcaaccattcaaagtggatagagaaaacatcgccgattatgtctttttccagcagttcctttatcttagtgtgatatggcgcataacgataattgaaagtgactcgcagattccttcccgtttgtttttggacagttattatttcttgcgctttttcctcatcaatagtcagaggtttttcgcaaataacatcatacccttttctcattgcacgaatgatataatcatgatgcgttcgatctactgacgtgataatgacttcatctggccgtacatcatccagtagctgttcaaattgcgatggcatacatgtctttactttcttctgtccatacttattcacaagtactcgatttgcataatccattcttgtttgagacacatcacaaaaaccgaccagttcacaagttcgatgatacatagaggcaattgcctcataaaaaaagcgcgctcttccgccaagaccgacttgtacatattttttcttcatttgaactcattctccttttcttttaaccagcaggctgtgacaaacggcagtccgggatacaacaatgcagtaagtaacagatcatattgtatacaccaaaacagcccatacaaaagacaaaaataccacagaaaccctttgacgttttttgacaacagccagatatttcttttgatcaaataaataagactatctgctttttcttctttgcagacatcaattagcgtactaaaaaaaccatgggatacaaaaagcaacagacacaatagaaaaggaatcagataccaagcatcagccttttctatgaacaaataccaatcagctgcaaaaataagaacgaacagctgaaacaacgcaacaatgaaacatgaccttttgattttttctttccgccaacctaccttcctttccgccaaataatgggcagatagataataagcaggatacatcatcaaaaaataaatcagatagacaacatgagcagaaagcgttaatcctaaagtgaaaaaacatcctaggaaaaaagcgaaaagaccatgactgataagactggttaaaaaaatccgacagaaatagtagttgatcttgtaaagaaacatctcctctattggctttttcatcttcagcctttcaagccgcttgtactgattccttggacgagatatttattgaagaataagaaaatcaaaaaaaccggcagcagagacagcgtagacatcgcaaacatactggcgtaagtcgtgctagatccagcatctgcaaataatttgatggcaatcgatacggtataagatctcggcttgttcaaatagatcagcggtcccataaaatcatcccatttccaataaaactggataatgatcgtggtgatgatcgaaggttttagcaaaggaaaaataattttggtaaagacactatatttgctgcatccgtcaataatcgcagattcatctaactctttagggatgccgaccatgaattgcatgatctgataaataaaaaatgcttgtccaaaaaagtgcggtaaaatcagcggcacatacgtaccaaccaaatttagccgattgtaaataataaactgcggaatcaaaatcacttgtgcaggaatcatcatcgttactaacatgacgacgaaccaaaacctttttcctttgaaatcgatcctcgataatgcgtaagcaatacaagtcgagctcagcactgtcccaatcgttgataccgcagaaatgacaaacgaattcttaaagaacgtgaaaaatgagattccagcaaaacctgcccatccttctgcgtaattttcccatcgaaaagtttctggaatcaaattcagtgaaccactcagaatctcttgatccgttttaaaagaacctgcaatcatccacaagactggataaatcatgactagacctaatagcaaaataaacccgtactggaaccatttcattactgttttattcattttttcctccccccgttcacacaacgacccatttttttgatgatttaaaaatcagaaaggtgacagcacccatgatcaacagcatgatccacgaaatagcactagcataccccatagaattaaaagagaatgcttggttatacacataaagagcataaaagttcgtggcatcattcggaccaccttgggtaatgatgaacgcttgcgtgaaagtcataaacgctgcaatcgtctgcatgactaagttatacaaaatgattggcgaaagaagaggtagcgtgatcttgtaaaacgactgccatttattcgctccatcgatctctgccgcttcataatgcgaggctgggatctctttgatacctgcagcaaagatgatcattgccgaaccgaattgccaagcagacatcaaaacaagagggatcatgaccaatttttgatcgccaaaccaggaaagtgctggtgcgcctaggcgttctagaaaaatattcactaatccatttttagaaaataattctcgccacactagagcaatagaaatactgccgccaatcaaactaggtacataatacaaagaacgaaagaaagtcgtccctttgatatttctcgttaaaagataagcaatcaatagaccaaagatcagtttcacaggcacagaggcgaatacatagagaaaagtgactcggatggagttcaaaaaacgagcatcacttagcatttttatataattatccaagccgatccatgagactggattccccagccgataatcggtaaacgaataataaagagacaagatcatcggtattaccgttatcaatagaaatcctagaataaatggagaagcaaatacgtaaccgaccacgttatcttgattcatgaatcgttttagtttttcttttttcatgctttcctcctgttactattccagaacgtttgaagcaaactcataaaaactctctgctgcttcttctgccgtcatttcttcatagataactttttctactaaaagattgtattgatcttggatttctggatttaaagcgctatcaaaaacatttacttcaccgttgtccatatcggatatcatttctaaatagtcgaatgtcgcttgtaaagttgtatcatctgtctgagcgagttgttctcgaatattggacatgattggtacaccgcgttctccttttaaaatctcattggcttcttcactgttttggaagaaatcaataaatttagccgcttcttctttgtgtgctgaattttttgccatactcagcatttgcgaagaacgtaatggaataccagattctccatctgcttttctgcgaggaggattaatcaatcgaatttccatatcttcaggagcgcctgacaaaatttctgtcaactggttacttgatagaaaaaccatcgctgcttcgctatctctaactgcctgaaaagacagatctgtcgtacttgcagctccaccacccggttctggatgggcacctttgtctaccagatttttacgcagctggaaaaaatctgttaaataatccggattttcgaatcccaaactgttagataaatcctcctgattataaaaattcaatcctttctcaacttgcggtatttgaataatacagccagctataaaatcttcgaaccttgaaatagcataaatccctaattcttcagtaatttgatagctgatttgttcaaattcttcccatgtccaattggaagcaggttcagggatacctaattgttcaaatatatttttattgtaagcaatcgcaaacgagttcaccccgttggacagtccaactaattgcccgtcgtaaatcgtcgttgccaaataggattcatccgcattagaaacatcaattatccctttttccacatattcatctaatggttcaatctgattgatgtattgaggaaattgattatttaattgaaaaatatcccagatatcatttgatgctgctagcgtacctaattttgtgtaatatccttcataatcatagaattcatactcgatcgtcacatgaggatttttttcttcgtaaagctcgattacttttaccgttgcatcgtgtcgaacttgtgaaccccaccaagccatgttcaacgtaattttttcgtcgtcctcttcttgcccacaagccgtcaagaataataatataacacttaatgctaagatgattctcatttttttcttcatttcctacacctctacttccattgacatttttcaatatactgtattcttatacagtatatatttataaaatcctcttttttaaaggcgaataaaaaccaaggcttgcctttttgttctgcctaggatgaacaactcaatactttcaaggaaaattagatagtgctgatttttttccattgctacaaatgcttcttgcttcaatgatgggaggataattgcgcaaagaaaaaggatatcagacaaccgtccaatatccttgacatagctaaataagcgtgccactctgcgtatattattccctaaaaaatcagaaaaaataactagtaattctgtatgaaattaggtacaatatacacgttgatgcacaagcattgactatggcaacttgattggtcagttcccgctgacttttcaagccccggtgatttagctgctactaaattgccgggtgccttttttagtttttattcgtttttcattctatagaaagcgcttcaataaatcaagacatttttttgttagaatgctaataataacaaaagattttaactattcttatgtacattacagataaaaaaacaaaaaaatttctctttttttgaattctgaacaaatagtactggagtacaaaagacgaggaagagccactatctgctcttcctcgtcttttgattctcacctgttattcatgattctttttctcagtttcccgatatttttccattttacgactaaaaagctctccgctacttggcggcgtatacgtgatggcatttgctcctgcttgaatggtctcagcaatactttcttccgttggaccgcctgtcgcaatgataggaagttcaggatactttttacgaaaatgacgtactgcttctacagtttcttttcccgcactgatattgataatcgaaataccagctgctaacttttcatcaatttccgtatatttcgatgttaccgtactgataactgggatatcaactactcgacaaacttctttcactgtctctaaaggcgtaggaccattcaaaacaacccctaaagaaccttgcgcttctgcaaacatgctcatgtaagaagaacgagcaccttgtgtcaatccgcctcctacaccggaaaaaactggaatatcagctgcctcaatgatacttttagtaattgctggatgtggtgtaaaaggatacacagcaattactgcatttgcatttgtatttcgtatgattgcgatatccgtagtaaagatgatcgaacgaatcaattttccaaatatcttgatcccgcttgcttctaaaatgatttccggtactcttacgatatcttttctcaattccgtcatgatttccggcgtaaattgttctgccatcagccacttctcctttgctatctccggtcatactgattcaactggtacgtctcgatgacctggatgattttttgcgcataaccggggtctgtcgcataacctgcctcttgcaatgcttgtgcggcttcctgataattggtggccgtaatcactttttcatacagtgcaggattccaatctactccttggacgaacagttgtgtatggtcatccatggactgttcccatgaatcatacactttgaagtctccttggatagttatccattcttcattaacaaattcctttgtttccaggcttactttcttctgatccccataagccttgatcccgaaaagattattgtatttgctagccaaggtactttttccccaattcgattctaatatagcttgtcctaaaatgatactaggaagcactccataaccatcttgtagttcttgggcatgtggaacaagccgttcaataaattgctgatgggattgcgcttcattttcttgctgattatcagtaaaaggagaagacagattcttcaaggaaaaaacaaaggctaggagtatcactactacaccggcaaccactgctggccaacggatgttcttgcgcttttgctttttccacttttttttcgccatgatcaattcctacttttcatttaattcattcagatattcttctagcgtcaattggtgtttggtgatatactcagcattttctttaccgacataacgtaagtgccaaggttcatatgtgattttagttatatcttcgcgtccttttggataacgaacgataaatccatactgggcagcattatctgcgatccatttagctccaggctgatctccgtaacttgcatccaatacagtagaaggataactgttgtaccagttttgatcgacgacatcgactgccagacctgtgtggtgttcgctgtatcctggctccgtaatcgtttctttagtgatttttgtcgcctcctcttctgatacaccttgacgactcatcacatcttggacattttgttcgaaaacttgttgttgggatgatacagaccggtaagctgagaccataactaacggaaacccagctgcttcggcagccttagcaaatgcttcatattccggagcaatgcgtttgtcgatcaaatatccattactcaatgatgccaattgagtagactcatcgatttctttttctaatttgtgatctggaccaaccaaaactagttgccaatcgtctgttttaacatctggcaattgtttggatgtacgatcttgtgtttctttgtcctttgccttgctgcttgttgtttgactgttcttttctttactagcagttgttttggtgcttgttcgttcgaccgtttgattgccggcttgaacatgcgcgtcatcctcgctaaaaataacatagcccattgctgcgatcataatcacaactgctccaaatcctaaaaatttattcacttgaaaaatcctttcgttgttcttcacgttccccgttcgtatcatgaacgtaagtttcttccagattttcattcacccaatcaagaagttcgattttttctccttcaatctgtttttgaacatctgctggcaaacgaaaattcaaaatatcatcatagccccattcatcatattgaatacttactttcaagtcaaggtatctaccagcctgctgattgtttttcaaagggatcagctcgacttttgctgctttgctgcttagccatttttgcgcgatacgtgttttaatttgtttatactctgcaacagcaatatttcgtttctcgggaaaaataatcgtttgacgcaaaatcttttgcgtaagcatccattcataatcagtgaaaagattttttactttctgcatcgcttcagaaggcaaatttttctcgccatctttccatttttgccattgttctgggctgatcagcaagtattcatctaaaaaatttttttcagtttcaaactgttccaataatacactcataataagatcaatatatacttgatgcacgtttatcccctccttttaactattctacttaagttttagtcaaaaagcacctgttaaatcgctgctttcattttttttaatgtttcaagtcctctccccttcattcttcgtgatttttgttataataatagacagaaaagaatctcaatctaactatgaaggagcattttcagatgaaaaaatatcaatggggaatcgtgggtctcggtaccatcgcacatgagtttgccgaaagcttcaatcaagagacaagtgaactaacagcggttgcttccagaacttcagaaaaagcggaaaaattcgcacaccgttacaatattccaaaagcttacggaagctatcaagaaatgttagacgatgctgaaatcgacatcatatacattgctgtaccaaataaacagcatatcgaccatatcttggcagcattggaagcaggcaaacacgtcttatgcgaaaaagctatcacgatgaacaaaaaagaactagctgacgctatgcgtttagcagaagaaaagaatctgattttagcagaagccatgactatcttcaacatgccgctttatcagcaattacgttcaataatggatacagaaaaactaggggctttaaaaatgatccaagcacctttcggcagttataaggaaccagatccagaaaaccgattcttcaatcctgaattagctggtggagctctattggatatcggtacgtatgcggtatcttttgctcgtttctttttgagttctcagcctgaagtagttgcctctacaatggtcccttttgaaacaggcgtagacgagcaatcagtcactattttgcgcaacaaagaaaatgaacttgctgctgtcagcttgacttttcaggcaaaaatgccaaaagtcgggatcgttgcctttgaaaacggctatgtgacgattgctgattatcctcgtgcggatcgtgcggagatcctatttacagacggtacgaaggaattcatcgaaagcggaagtacttctgaagccatgaattacgaaataaacaatatggtacacatgatcgaaggtgacttgccaaatcgttctctcttcttgacaaaagatgtcatcgacatcttggatcaaatgcaagttttatggcaaaatatgtaattttaaaaggtcgtgaaaaagctggtctgcatcaagtaataagaacagccaaacaaaaatagctcctcctatttttcgtttggctggacttattccagtagatgcaagcttgtttaccaagaggttgtgagcctgccgttcagctccgagtcacaaggagcaatttcaaaaaacagcttctcatgtttgttgaatattgtgacttgtgaccgaggagttggcaggagaacaccgtttaaggaagaggttgtgaaatcagcgctttgacctaagtattagctgaattcaaaacctctattttttgattttttgttgggagaattctgccttgatttcaataaaacttttaaaagactgcaaaaactggaacaattctgctcggtcctcgaattcagggcggctagtcggcagaggcatttgccgatacaatacataaacttcttcaatacgtgctaagatttgtctgccatcatttgactctgaaaatgtttctgccgtataaatcaataaaccgtagatatgttttccataataagcgggttgttggatccgctttagattttccaacatgtctttaatcacattgacctgtgctcgtctcatagagaaataagtttcatagtatagcggctgtctgagccagtagttttcttgatgttctctggcatcttcttggctttcgcgaatgaatgtcagcaaatgttcgcatttgatctgcacatctcctttattttccgataaaagaaattctgccatttgtctcaagatattccgaaattctttttcgatctgtatttggttttccttcagctgtttcgtacgatctggcatatagacattcgcaagcaaagcaaatactaatccaatcgccattaaacccgcttcattgccgatcagctgccaagacatgttttcctccactaaataatgagtgaccaaaaccgaatttacgacgattccttcagttaatttgaagcgagaggcaagcgggatgaacaggaataaaaaaagactgaagccaaaaatagtatacccaacagcaaaaaaactgaacagcgctgttgctgtagctagtataaaggctgcgattcgattcatccctgtacgcaatgtagagcgttttgtatttcccacactcaataatgcaatgattcctgctgctggccaatacaacagcgataagctacccgctgtgaccatcgaaaagaagacactgatcactgttttgactgttcgcattcctatacgcatttacttccccctttttttattttaattatacttgaataatgaaaaactagctatcagacaaaagtttaggtatgatagtaaaaagaccaaaaaggagaatctctatgcaatttggccgttttcgactaggtatgcgtacgatcaaaagtgccttagctgtttttttatgtatcttgttttttcatttgactcaacgaggaatcccaatgattgctgcattatctgctgttttttctttgcgtcaggacttgactacaaccgtttcttttggaaaatctaggatcattggcaacacattaggtggtacactagctatcatttatttttttgtcaaaagctattttcacaatgattttttggtagaattgatcctgcttcctattctagtaattattgtaattgtcgtgtcagatggcatcaacaataattctggcatcatttccgcaatcgctacgttattgctgattgcattgagtatccctcaaggtgaatctgctttgtacgcgatccaacgagtactagatacttttataggaacattcattgcgattggtatcaatttctttcttcgtccgcctgaaacagaaaagaaggaagaactatcagaagatttggtcgaactccaaaagaaagaacgattgctgcgaacaagtttacaagagatagaagctaagatccaaaaacaaaagaaaaatagcgaggactgattttcttttgaaataacataaaaaatggagagaagaacttgaaaagtcttcctccattttttattgatcggtgaagtgtactactttattcttccttcatcgcgtgttgttctgcctcttttggcgcttcatacatatttacttggctagtagtcccacgtgtcgacaaattctctacgatttccttcaagtcaagtcctgttgtcgcttttaatgtttcttgagtagtagaaagcaagtttgtggcataatttgtcactcggttcgctccactggtttctcctgagctgtttcctgtatcgacaacagagattttttcgatatttcctagcggctgtgctgcttcgcgcatcaattgcggtagcatatcgataaccatactcaagacagctgcttcgccatattccttgaaggcattggcaattttttgttttgcttcggcttctgcttttccttttgctaatgctgcttctgcttctgcctgtccagctaaccttgtcttattggcttctgcttctgctagtgcttccacacggaaacgttcggcttcggcttcggtcacttctttgactttttgagcttgtgcttcttgttctttagcgtaacgatcggcatctgcttttttcttcacttccgaatcatattgcttttctcgacgtgtaatttctttttcttccaattcgatttgtttttgacgttctatgattttgatctgcatttcttgctcgattacttgttgttgtgctctggcactttccaagttgtaggcttggtctgctttcgctttagcaacatcttgttcttgtttgtaggttgctagtttcaattctttttctttcaatgattctgcaatttctgtttgtcgttgtaattcagctgcttgtgattctttttctgcttgagcttttttgatacgcgtttcttttaaagcttctgcttctgctatatctgcatctcttttgacttgggcgattcttggtttccctaaagagtcgagataaccatttttgtctctgacctctttgatagtgaaagaaacaatgatcaatcccatttttgcaaggtctacagaagcgacttcttgtacgctttgactgaacttatcacgattttggtagatttcttctacagtcatagaacctagaatcgagcgtaagtgaccttccaatacttctcttgcttcattctccaattcttctctagtcttacctaaaaactgttctgctgctgtagcaatctcttctacagaagaaccaattttgatgatcgaagtaccgtcacacatcaccggtacaccttgttctgtatacacttctggagtagaaacgtccaatttgctggataatagactgattcgattcgaacgttggaaaaccggcaagacgaacgctccgcctcctcgcacgattttgattttgttgttactttcatctttgtgtacatttttgcttcctaaataacttccactgatgatcaacgcttcatctggttttgctgtttggtacttcgctacaaagacgatcagtagcatcagcaaaatcaacgctgcgattgcgatcgcgataaaaacaattggtattcccatttaacatacgctcctttaagcttttatcatgctttcataaggcatgacataacagattctttccttgatctcaatgatcaatactttcgttccccgctccgctatctgttcttgggggctgtagaaacaagcaggacgactgatggaaccggtaacactttttaattggatttctcccatgccccgtacagggattggtgtgatcacaacagctacttgcccttccaaagtcttttcagaagacgacatcgttgattcggcatgtttcatcggcatcaatagatagaaattaagcaaaaataccaaaactgtcgatatggctccactggcaataaataaaaataaagaggattgatccgttagacgctcaccaagaaaaccaaacaaacttgtaaaagttagccagggtataataagcattggatcaagtgggccatcaaaatcgaagacatctccaaaaataatcaaaagaactgccaaccccgcacaaatcagcaatgtataccaataaatcgtctcaagtgcgattccccctatcatatacacgcctccttccatttctacgtctatcataccaatgtttgaaaattctgtatagcttctttcaccaattcaaaggtatttattcatagaaagcatctatttatcaatgccaatttgttaatttttgtttttcatgttaaaattttcacaataaattctttcgaggtagcctatgtttcctttccttaagaaaaaaccattaaagctccaaaatacgatcattcttgtcgtttgtttctccacattcgtttctttgattgtttctgccatattgattaggaattttattctttcgatgaaccgatcgagtgtgtcagatagaatctctagtatcgctaaaatcgttgtcagcgataaactcatccaaaaaaagcttcagactggtgatccgacacatgtgattcaaggaatcacaaatgaaatcatggtagcatcgaatttagattttattgttgtcatggaccctgaaggcattcgatattctcatgcagacccaagttacatcggtcttcctttctcaagtcatgaagatgtgaaaaaagtgattggaggacaagaatttttctctgaaaaagaaggaatgttagggttcggcttccgttatttcgtccctatttattatgatcaagagattattggtgcagtttgtgttggcttgacgaacaacacgatcgacaatcaggtcaaagatggacaaaaaatgattgttttttcattgatcatcgggcttatcgtaggcatcataggcgccgtttttcttgcccaaaaaatgaaaaaagtactgcttggacttgaaccgcaagaaatagcggaacagttaagcgaaaaaacgattatcgaaaatgaagtagatgaaggaatactggccatctcttctgataaaactatcctcttgatcaatacacctgcaaaaaatattttctatcaaacaaaacggctgtcggatttcgaagtaggaaaaaaaatcagcgataatctatatgacgtattgtttaaagagacaatcgatcatcaaacgactgttcggactcaatccatgtatttaaatgggatagaaactatttctagcgttacacctctttttagcaatgaccgttttttaggagcagtcgcaactttacgaaatcgatcagaagtaatgaaattaatggaggagctcggagggacgaaacaatatataaactctatgagagcccaaactcatgaatttatgaataaacttcacgtcatttctggcttgattgacttgaagaagtatgaagaagtcacccattttatccaacagctaaatcaaaattataaaaaagagatcggtcaagtctcaaatctgatcaaagtccctgcgattgccggttttttattaggcaaaataaatgaagccaaagaacaatctgttgaaatgttgttagaaagcgattcttttatccctaaaatggagatggacgactccatccattcacttttgcaagtgttagggaacttacttgataatgctaaagaagccgtacttcaaatgcctgaaagaaacggacaggttcggctccatttaaactatgacacagaagcggaagtattcatcgtgaccgtctgcgatgacggtgtcggaatatcagaagaaatctcagaaaaaatatttacgctaggtttttcgacgaaaggaatcaatcgtggatatgggttgaatatcatccattcaattgtcaaacgtcacggtgggatcttagaattttccaaacaagcaaatggcggtacaatcgtctatctagaattaccaaaaaaggaagatcaaaatgatgacaaatgtcttaataattgaagatgatccaatggttgcagaattgaatcgtacgtttgtggaaagtatacctaatatgaacgtaatcgaaagtttcagaaatgtagaagaaggaaaaaaatatttcagacaaaaaaacgcagatctgctgttgcttgatgtatatatgcctggcgaaagtggtatccattttttatcttggctgagacagcaaggaaacgatatcccagtgatcttgataaccgctgcagatgatatcgaaaccataaaaaatgtgatccgatatggtgccttagattatttgatcaaacccttcactttgcaacgtttccagttggcgattgaaaaataccttgctttctctcagacgatccaaacgactgaaaaagcagatcagaaattgatcgatcaagtattcaaccataccactcccattcacgaaacaccttcattcattgatttgcctaaaggtctgtcaaaactgactttaaaaaaaatcagtgcatctatcctaaaagaagagactattttttcaacaaaagaactggctcaaaaaagtgcactttcacgtatctccgtcaagaaatatttaaattttttggtggaacaagatatactgaatgaaagaatcagatatttggagattggtcgaccactaacctgttatgaattgacaaagaatgggcgaaaaaaactcacggattattgttgagtcatcgagttatctaatactaaataaaggctgtgaaaaaagtcttgtcacagcctttttccaacaggccgaaggcgagctcgaacaaatgctgagtcaaccgatggagaattagaaacaatctacagtagggaagaaccatttacacaaaattattgacgctcccaagctaaaactcctattaatcgatctactaaaaataaataaaaaaattcttttcaatttttatttatggtatgacataaataaagtaaagttattcttctaggttaatcttattaatactctttctcactagtgttgcatgcaacactagtgagaaagagtattaaatatactgcaaggcaagacatttggtaattgaagaataacaagcaaaaaaatagcagtcaggtctcttgacaaagtatagttgctattctttttttaggccctactttaatgaaatttttgtttggagggaacgacttcattcctttgattatttcagttgaatttaatagagaagcctggcgtctattaagaaatacttttcttgatgagcgtcaatttttttaacggaaatctatcctatactaaattcagtaaagaaaaaggaggaatcaaagaaagctattttaaacaaaccaaaattataggaggaataaatcatgactgaaaataaagctactcaagaaagaacaccccaagaaagattacaagaagaacaagaacacaaggaacatgttcatcatacgaaaattaatgcagcggccattgcggatcatcttttaggcaacatgcatacattacatgtgaaactgcaccaatatcactggtatgtaaaaggagccaatttctttacgttgcatgaaaaatttgaagagttgtataacgaaaatgaaaaatggttcgacaaacttgcggagcgtctaattacttctgggcataaacctgcttcgacaacggttgaatttgaaaaatattcgatgctttcggaagatgcagttaataaatacgctaaagcagaagacatggttgaaaatattatcgaggacttcagaagcacccgtgacctaactattcgcgcgattcgtttagctcaagacgagggtgacgatgctttagaagatacattgattgcttttaaaaatgacttagacaagaacatttggatgctgcaagcgttcattggtaaagaagcattagaagatgatgacgctcttgatgaggatgaagattaaggtaaaagtagaagctgatttagggattggaattctttccagtcctttttctattttcttgatgtgcatcaatttttttgtagtaagagacttatataataaaagcagcgaatataaacaaaataaataaagggggagaatgaattgactaaacatacccatcatgaaattggcgaccacgcagcctgtatccgcttggttccaatattcaatcacttagaggatagcgcgatgaattacattgctgaaaaagcccacacgaaacagtatcaaaaaggagagtttctgtttcgttcacaagaaaaagaggatactttatatattatcaatcgtgggaaaatccgtatttatcgattggcagactctggcaaagagcagctagtgcggatcttgaaccctggtgatttcaccggagaatggaccttgttcaacccggatgcagtacacgaggaatatgccgaagcaacccgagataccgttgtctgtatgattcagcaaaaagatgtccaagattttctggaacaatacccagctatttctttaaaactattggcggaaatgtctaaacggttagaaagttcagaacgtcaaacgacacaagtagccgtggagagtgtcattacccgtttagttttgtttttggcagaaaatgtggaacctgaaatgggcaactctcccaccatcaccctgccgatggcaaaaaaggacattgcttcctatttaggaacgacacctgagaccatcagtcgcaaatttggagaattggaggacgagggattgattcaacagctgtctgggaaaaggatcaagattcaggatttagatgatttattgttttacagcgaataatcggacacacttttttctacacgttggtgttctgtcgctcttcattaataacgggacagaactcagtgcttttgcttccatctgtccgtttttggcttttttaagacagaacgaccttcattcattggaaaaataaaagcacaaacatgataatcctcaagtttctttgttttatttttctttaagatagggttgccgaacaaaacgtaaaaaaagtagaggtgaatgtgcattatttttgggtgatagttgccatcacgttgtcagcagcgggtgcattctttgtcgtccctttcaccaagaacacgattggcggcgaagcaaaaacgtctaacgttgttgaggcagataggttagctatggaaaaagaagaggaagttgtaaaaggagccggcgtaatcggacacggaaaagtggcgtattacgaagcgagtgaccagggagctaaaagtgaattcactgtttggtttccatggagcttagccggaatcttgttcagcatcaccatgactagaatgacgcgaaaaattgaagaaatggagcaaatagaatggaattcgtattaggcgttttgaatccccatgtggtggagattggttctgttgtgattcattggtatggagtcattattgcagcgggcatattagcggctctccagttgagcaccaaggaagcaaagaaaaaaggactggaagaggataccattatcgatatggccttatgggcaattccaattggactcctcggcgctcggctttattatgtgttatttgaacttggttattatctgcaaaatccaggacaaatccttgcgatttggaatggcggcattgcgatttatggggggattgattgcaggagggggtacgctatattggtatgcaaagaaaaaaggtacttctttggcactcgttcttgatattttagcgcccaatgtattgttagcccagtccattggtcgttgggtcaattttatgaatcaggaagctcatggtgggccggttactcgtcaattcttggaaaatctttatttacctgaatttatcatttgaacaaatgaatatcaatggtacctactaccatccgacttttttatacgagtcattgtggagtttgttgggctttgtcctcatcgtcactatacggaaccgaaaacagcttttgcgtcaaggagaagtcgctttgagttacgttttgtggtactcagtgggtcggttcttcattgaaggtatgcgaacggacagtttatggattggcgagtggatccgcgtttcgcaagccttgtctctggccctgtttattggcgcgattgtagtatagtttatacgcagacaagattatccaccaatttcttattattctgatggcaataaggggcagaaaaagactattaagatggtgaattgagcaaaaagataaaaagaagtgcaaaacttgatatgcgtcaattttcgtttgctaaaagggagctatactacagttgtaaagaggaaaaggcagtgttcattaatctgctgccgataaaataaaaacacataaaggagataggaattatggaaaaagctatattgcaattagaaacgttgtcttgtccaagttgtatgcaaaaaattgaaggtgccgtaaaatcagttaacggtgttgataaagacagcattaaagtattattcaactccagcaaagtcaaagccaattttgattcagctgtcacttcgattgaagagattcaaaaagctatcgaaaacgtaggctatccggtccttaaagcaaaagtcaaggccgcttaacagattaaatgaactaggcaattctggaagaaaagctatttttccaggattgctttttttgttgcaatccgattcgaggtgcctagaaacgataaaagagaactttctaaacttgatgtcagtcaattaattacttaggcaattatcttatactgtgtttatcaataaaagagaaattaaatttggagggaaaaagcatgcaacaatatatattaagcaagaaaaatgttatcaccgtcatcagtggattgttaatcgtactcggtttcttcagtcactttgttttagaaaacgtaggactttcagagtggtctttgatcatcgcctctgtctttgggattacgccaattgccattcaagcgtttcaagcaatgaaagtcaaagtcatcagtattgatgtcttagtcagtattgcagcgattggtgcgctttttattcaaaactatgaagaatcggctattgtcacgttcttattcttattcggacactacttggaacaacgaacattgaaccaaacgcgatctgctatcaaagaattgactgaaatggcacccgaaagcgccttgaaacaaatggataatggcgaatttgaagaagtagaagtggatgatatagatgaaggggatatcttgctcgttaaaacgggtgcgaaagttccagtagatggcatagtccttacgggtgaagggcatatcaatgaagctagcattacaggtgaagctgttccagtcaacaagctagctgatgcagaagtttttgcaggaaccattttagaaaacggaacgattcaaatcagagctgaccgagttggtgaggacaccacatttggaaaaattattgaactcgtggaagaagcacaagattctaaatccgaagcggaacggttcattgatcgcttttctaaatactacacaccagctgtcttggttctggcaattgttgtatgggcgttcagtcaaaatattgagttagcaatcaccatcttggttctaggttgcccaggcgcattagttatcggagtgcctgtctcaaacgttgccggtattgggaatggtgctcgtaacggtgttcttttaaaagggagtgaagtcattcaagacttcagcaatgtggatacaattgtatttgataagacaggtactttaactgtcggaaacccaaccgttgcagcgactgaactgtatgaaaaagatcctgctgaaacgcttggctatctggccagtgtggaacgggaatcagatcatccattagcaaaagcggtcttaaatcaaattggagaaacaaacttttatcctgttgaaggaactgaagtcgtgaaaggcggcggaatcgtttcaagtgtagctggacatagagtggctgttgggaatgtggccttgatggaaaaagaaaatgtcactctcagcaaaaaggtgcaaaaagatatcaaacggtttgaacaacatgggaactctctcgttttgacagcggtcgacggtgaattaaaagtactgatgggcattcgcgatcaagtccgtccgggtgtgaaagctaatttgcaggaattaaaagacttgggcgtgaaaaatctagtcgttctttcaggagataaccaaggaaccgttgatgtggtcgccggcgaacttggtttgaccgaagctcacggccacatgttgccggaagacaaatcggcttatatcggaaaacttcaacaacgtggtcaaattgtagcctttgttggagatggcgttaacgatagtccgtccttagctttagcagacattggaatcgcaatgggaagcggaacggacgtagcgattgaaacatccgatgtcgttttaatgaactcgaacttcagcaacttgcctcacgcattaggattagtaaaagccaccgcaaataatatgaaacaaaatatcgtgatttcaattggagtagtgttggtcttgttgaccagcgtcttcttcagcgaatggatgaatatgtctatcggaatgttggttcatgaaggtagtatcttggtggtaattttcaatggcatgagattaatgaagtataagttgaaaggtcgaaaagaacaaaaagaagtatcagcacctgcagagaaagtaaaaatatcttaagaataaattagaagaggctgagacaatagtccatccttgaaatgacaaaagcggaaactcagatttttaaatctgggattttccgcttttttgagttcttgaaaaaaaataagagtatagagtatgttctttataaaattaattttcgtgtaaatgattaaaaaatttaataataaaatttaaattcctattaagttgtaacacatgaaattgcttataatagtgtattgaaattaaggtagattgacaaacgagtgatcaaatagatatactaccttcaaacgaccgtttgaatgtgaggtgagatgaatggaaaaagtttgccaagtgactatcgtacataaagaaaaagtaaatgtaataaaaaaaaaattggatcaaaaagatttttcaaacttacttgtgttagggaaatgtttcagcgattcttctagaattaaaattttttatgctttagaaacctataaggaaatgtgtgtctgtgatttagcagaaatacttaatgctagtgtcgctacaacgtcacaccatttacgttttttaaaaaaacatggaatggcaaaatcacgtcaagatggaaaagtagtttattactctttagcgaatgaagacatcctttccgctattcatgtttttttaaagttatcagaaaatctatctatgaaatcttagtttggaggaagttattttgttacaaagtattttttcagctatcgctgtttatatttctaccagcattgattatttgtttatcttgctgattattttttctcaaagtcatacaaaaaaagggctccgtcagattttttggggtcaatatctaggaacaggtatcttagtagccgtaagtttatttgcagcatatgtgctgaatttcattccgcaagattggatcattgggcttctcggtctaattccgattttcttaggaatcagagtggcattggttggcgaagaggaggaagaagaagaggaagtcgttgaaaagcttgaatcaagaggaacaaaccgcttcttttggaccgttgccttaataacaattgcttctggtggcgataacttagggatttatattccttactttgcctcgttatctttttcagagattgtcaccgctctaatcgtatttgctatttctgttgcggttctttgctatatcagttacaaattagccaagatttcttttgtttccgaaaccttagaaaaatatgaacgaatccttgttcctatagtgtttattggcttaggaatttatatattgatcgaaaatggtacgattcaaacactattaaattttatataaacaactacgatagtgaagttcaaataaaaaaagacagcgagattttaactcgctgtctttttttatttgaactaatgaattgtaaaatcattttaaccttgtagtttgtctttatttttctttttcttattcttcgatatgagttgaaacttgctcaagaatactaaaaatatgaagatcgtcaaggctataaatcatatttttaccagctctttttgattttactaatcttgaagtctttaaagtttttaactggtgagaaattgctgattgttccatactcaaagaatgcgcaatagctccaacgctaagttcttctttctgcagaagaaataaaattgaaagtcgggtagggtcactgatcattttaaatattttacttacctcttggatagattcattttttaatggagaagttgataatgaattcataagaatttctctccttcatatgtttgtttattcacatttagattatcataatatttttataaagcaagattttttgtataagggtagctattttagagtcctattttttttatcacctaaataagataactatttttttgacaaattagatagagcgatataaaatgaatgtatagacatatgaatgttcgttcaaacgtaattcgtaagcattacgatttctaaaaaaaagttttattaagaaaggtgatagaaatgaaagagattcaagagcaacactcacacgaaaataatagtcacgatcatgggaaaatgccaattattttgtactttattggtttagcattgtcgctcattgcgttatttgtaaacggagaaaataatttaatccaaaacactttgttttcaattgcttcaattagtgctggttatcatgtcattattcttgaaggaattggagaaacgattgaaaactcaaaaagacaacacaaatttacccctaattctcatattttaatgggaatagctgcaataggtgcttctctgataggaaatttttgggaaggaacgttattggttcttattttctctggagcacattttcttgaagattatgctgaaggaagaagtaaaagagaaattaccaagttattagaaatgaatccaacaacagctaggctaatcatgcaagatggcaatacaacaatcgttaatgttagtgagttgaaagtaggagatcaacttcaagtgttaaacggtgaccaagtaccgattgacggagtaatagtatcaggctctacttcgattgacgaatcttctattaatggtgagagtatacctaaagagaaatcaaagggagacggagtttttgggagtacaattaatggaacgggtacctttactatggaagtcacaaaagaaactaacgatactgtcttttcaaagattttacaactagtgaatcaaaatcaagagaatcaaacaaaagcgtctagtattatccaaaagtttgagcctaagtatgttaaatttgttttaattgcaatcccactcttcattttacttgctcctatgctgtttgatttgacatggtcacaaagtatttatagaggattagtccttttagtcgcagcttctccgtgtgctttagcagcagctaccgtatccgtaacattgtcagccacttctaatctagcaaaaagaggcgtactttcaaaaggaagtgcctatttgtcccaattagcggatattcaagccattgcctttgataaaacaggaacattaactaaagggaaaccggaagtaaccaattattacttttctgattctgtgaacgaggaaaatatgattgatatcgtagtggctcttgaaaaagaatcaaatcacccgttagcaagtgctattttagacaagtttgaaccaaaaaataaactagctattgaagtggaaaatcagattggaaaaggtttaataggcgattataacgaaaacacttatcgtataggtaaaccaacttcttttgaggctgtatcggatgactatacacgtttgaataaagaatgggcttcagaaggtaatacggttgtatatgtatcagaaaatgaaaaagtaatcggcctgatagcattaatggatattccaagtgaacatgcgaaagcaactatagattactttaagaagtgtggtatccataccactttaattactggggattctgaaatgacagggcaagctgttggtaaacaattaggagtagatcaagtaattgcaaacgtcatgccagaagataaatctaacattatcaatgaacaaaaagaaacctatggtataaccgctatggtgggagatggtataaacgacgcacctgctcttgtgaaggcagatgttggaattgctatgggagagggtacggatgttgcagtagatgtatctgatctagtattaatgaaaaatgatttgtctaaattggtaaaagctcatgaaatttctttaaaaatgaatcgagttatttggcaaaatattattttctcaatggtagttgtcgcttttctaattaccgtaagcttagtaggattaacggatatagccattagtgtgattgttcatgaaggaagtaccttagtcgtgatattaaatggtcttcgattattaaagtctaaataaatacatgaaattggataaaatcatgtatctaaagtttgcagcctctctaattttgtattacaatgtatatacaaaaagaagggggtgattctaatgactgtcatatcgctcagaattgatactcaggaagataaattaattaaagaatatgctaaggcgaagaatatttcggtttcggctctgattagaagttctgtcttggaaaaaatcgaggatgaaattgatttgggcctatataatcaagccatgaaggatcataaagagaatccgaaaagtatttcttttgaagacatgctaaaggagctatctgattaaatgagctcaggttatcaagtcgagtttgaaaaaggagctcaaaaagcgttaaaaaaaatggacaaataccaatcccttttaattatgggatggattcaaaagaatctagtgaattgtaccgatcctaggcagcatggaaaaggattaaccgtcaatcgatcaggcgaatggcgctatagaatcggtgattatcgcttaatagctgatatcaatgacgagaccgtaaccattttaatgttagagattggtcatagaaaaaatatttacaaataaaccattcaaattgagtgcaagcatgtttaataaaaaaggattctactgctttttaagcggtagaatccttttttgatacgatttaattatctatattaagcacgtaaggcaacaatcgcatcttcaataatatcttgctgcgttgcctaaatgagcaattgcgtttctaaatagtcttttatttcttcaacctccactagaatagagctattaattggcacgtagacgtttgctgatgtcataatcttcaactcctatcgttatagataataacgaaagataaaccaaggtgttaccagctactacaagaaactaaatagaaatattaacctgcacaacaagataatttcgaaatatctttatcaaaggctagagctgctaactttaagccttctgacattgttagataaggcgctaaagtatcttttaaatcagctacggtcaatccaaatttaacggctaaggatgctccataaataacttctcctgcattttcagaaacgatatgaactcccaaaatcttctgtgtttttctatcaaccacaagtttaaacacccctgtcgtattatgattgacaatcgctctaggaacattttctaatgacaataccgctttttttacttcgtatcctttttctttcgcttgttgttgtgttaacccaacagttgcaaattgcggactggtaaatgatactccaggaactaccgataaatcgattgctttatttaacccaccaattgcatttcctgctgcaattcctccttcataggctgctacatagacaaactgaggtcctaatgtcacgtctcctgctgcataaatttttctattacttgtctgagcaaaagcatttatcttgatttcattgtttggcccaacttgaacgcctgctgcgctcaagttcaatacttctgtattcggttttcttcctgttccaactagtagctcgtctgactcaatgaccttatttttgccgtttacaataatatgaacttttttaatatttccgtcttgctctactcgttcataagttgctccggaaatgagctttattccttgttcgattaaagctttctccattgcttcagaaatctctggatcatactcttttaaaagtcgtttgcttctttgaataagggtaacctcagaacccagattgtggaagagctgtcccagttctcttccaatataacccgatccaataattgttaatcgttttggtacttttcttagttcaaggagggttgtgctagttaaataatctacttctttaagtccagtaatacgaggtaagagtggagaagcacccgttgcgattaaaaaccgttgggcagaatatgtttgcccactaactgtcacagtgttttcgtcaatgaattttgcttctcctttaattaaatcaaaaccatagtcgtcaattaaattagtgtatttttgtttgcgtaaatcatcaactagttcatttttttgatcgactaagcggtctaattctacttctcccgtagaagtgtgcaatccttcaaaaatatttacatgtgctgattgattgatttctccagctcgaagcagcgtttttgaagggatacaaccaatgttcacacaggttccgcctacagttccgcgttcaatcatgcccacctttgatccatactcgactgcttttatagctgctgaaaaagctgctccaccagaaccgataatgagcaaatcataatcttccttgttattagtcatcacgcgtttttgaacaggtaacttttctacttcttcgggctgataatttatttttttaactgcttctatcgcgttttctattgcatagtcgtctggtaattgaaataccgcttcgctttgactgaaatctgctttagcgttgagagctcccatgctctcaagcgctttttctatatgtttttcacagccagtacaggtcattccttgaatgcgcattctaaattgattcattttcctacccccgttaattttctattaatacttctatgataggacacgcgtatagttctttttcatctggacatcttgctcgtaaatcttttagcatatattctattctattcaaattctcgatttttttttgaatttctctttctttcttagagacaaattcaaacataccttcacaacgaatgttgtctttatctacaacaccaagtaatttataaatttcatttaaagaaaagccaatttcttgtaggtgtttaatgaattttactcgttttacatcttcctctgaataaactcgataaccggaattagtccgatcgggttctggtagtaagttttttcgttcgtaatatcgaatggattccttatttacaccacatttttcagagaaggagctaataaaataagccatgctatcacatcctttttttaattataaaccatgtacttaggtacatgtccaaccaaaaataatacgaaggggggaatatcattttccttcttatttactttcaaaaatgaagtgaaaattaaatgtggtaccaataaattttgagacttcttttataataaataatatcggacctaaatacatgaaattacataaaatcatgtatcaagaatcctatccttatagggttctttttttttactccccctaaacacacgatttcgtgttgtaataactataatcatgtattcgaacagactaaaaaggagggattgtcatgggctataatgttcagccactacggtcgcaacaggagattaatgattttttattttgcctgcgacggaataaaaatgcggaacgtgacgttttcttgtttctaattggaattaacagcggtctgcgcatgtccgacatcgttaaactcaagaaaaaagacgtgattacctcaaaaaacccgcgcatcgtggagcaaaagacagggaaaacacgcattttatacttaagcagcttacaggacttgattcacggctataccgcacccttagatccggaggcttacttgtttcccagtactaagggcggccatttagaagtcaatacggtctaccagatgtttcaaaaggtcgcgaagctgttaggaagggacgatatcggcacccacaccctacgaaaaacctttggttaccactattacaagaaaaccaaagacgtggccaccttaatggaaatctttggtcacagcagcgagaagattaccaaacgctacatcggaattaatgaagatgaaatcagtgaaacgttattaaattttcggttaggtttttgattgtattatataatagataagcacagtaagacggttataatcacccacagtattggacaaatcaacctttttttggtatattatatatacaaatgagagcaggctcatagtcaacttgatataaatccggaacataagggtccggcgggtggcgagcaccaaaactaaactcgatacaaatccggaacgtaagggtccggcgggtggcaagcaccaaaactaaacctgtacaaaaggctgctcttttgagcagctttttttattgggaaaaaggagcattcttcgcacgcggcaaaaaaagaatacaaacgcatgtctataaaagagacaacccaaattaccagacagttaaacgcgatttataaggctgctcatctcttacaagaacattttgtagataaaaaagtatcctttgtcggagaagtctcaacggtagcgattattttttcgacaactaattttatgcacctctgtggcattgattatcgcagaggcacacacttgttttttcaagatgccttagacaggaaaataaatttacaggatattcaaatcaaaacggatgggacgacctttcagaaattacaagtaataggtagccttgatttattattggggaagcatatttctattgttggcagaggtgtttactcttctcttcgctatgatgcagctattcgaacaaggaaaaaaatattggctctgtctttgaaacaaaacggattaatctatatccctatctctttgttaaacctatcatcaaaggaaattggacctggacaaaaagttactggcatttttagcgaggatttaacatccggggaacttaaaatgattatggaagtcatcgattaatcattaatagtgatatgcgacgtcattttgaagtaattattctattttgggttataaaataaagcattttaagacgatttcaaatcattcatgtgggttatttatcacggatgagcttgaaatcgtcttttatacgtatcaaattgaaatgttcggcatacaatctatcgttgttactacattactaattgtcacttgttaaggaacttggatcctttctaaacattccctagagataaattttactttatccctccgttaatatccaatttaagcacctttccgattcagggttaatttgcatatcaagtgcagcttgtgttctagtaagattagcccttttagtccggctgagttgacttatggatataagatatggtcatagcaaatagatactacgtatagtctgttaatttagtgtcattaatcttaagtaatttcgaaagaaagtagcaaggttattgattgtgactgtaaaagtggggtgttcctataagcacattaaactatcttctctaatttatcatgctatttaaattctgttttttcatgagaatttttgtccaaaacttgttaaaatgattttaaaaaatacttacatacacaatccccaaaagacactaatgtcatttcagtcaaaaaagataccgcagaaaatttccacctgagattcaatacgatattactctcttgacagccagcttaattccttagttgaatagattattaaagtgcacaaaaaaacaatgcggcgtttgttatattttctggtataagcgacggtgttataaacttttttgcagattaaaaatcatatgaatttaactccagtaataagagtttaagtgccaatgcatgcatgattctttcaatttccgttttatgagtagacagaacgattccttcattgcattggaaaatgagtttgtttctcgtaatatgtatgctctcatttttggttgcatagtattctctccattcgtcttcatacataagaacgcctcctttgatcatactatatttaagtccttcgttattaatatacgtaaaaagttggtattttatttttattttctctctctttaaaaaaactgaaaaaagagcggtttacaggcgttttcatggatagttacccatagatcaatctgaaatgagcgtagaacttccctctcaaacactggttttttagagaaatacgaaatattagggttatttgcagaatagctacttattcttacaaagcaacaagcgagcaaaagaaaaattcctttcaagcgttttttggcggtacactattttagcgacaggcaagatagcaaatattttttacaactggtttgactgtcggcgacgacagcccacagccaaaaataaagaagtcaaggactgtgagggtggagattttttggtggtctgccaaaaaatacttacccgttccttgacttatttaagtgttattcagttttaggctattacaactgggtgactgagacgattttgggggcttgccccttttttccaaaaggggcaaggtctagatcttgtgtttttatttttttggaaattcaaaagctaatttcatttcgtcattcagtgttaactttgccgagaaattgcttccttttttacttttgaaccctttgattaaactcgtttctcttttgcttaataaatcttggacatttttctttgtgagtgctttttggctccatcttttaggaagcgtaaatttgcaaccgtctttgtagcccgaacagccataaaattttcctttgtctactacgctgttttgacatttcggacacgtacccatcacattttcttgttccatatgaccggctacatctgcaatgttttcttttttgtcttggaagttttgtggcacttttcaatgaggtgctgcacaaaccgctcgatactgcctaaaaaagcttcttgtgtgccttgttggcttcggatctttttcaaatagcgcgttcccattgggcagtcatgccggcattggcgatttcgtcctctgcaattatgcggcacaacaattcgcttttttctgtcacatagattttactcttactgatcgtgatgtagtcctgtttcttcaatgtttcaatgatactggctctagtggcctcggttccaatcccttcggtttctttaagaatgtctttgctgtctttatcgtccattgcccgtccgacatgtttcatggcggttagcagtgtgccctctgtatagtaattgggtggttgggttttcccttcctttgtttcaagggtgaaagccactgaatcattgacggttacttctggtaaaagtgggtcgtccttgtctttttcttcctgtttatatagtcgtttccatccacgctctttttctgtcttcccttttgattggaacagaacctgattgatcgctgtatcaatggtggtttcgtcatagatatacggcttttcaaaaattgcgagggtacgatacaagaccagaagataaatgtttttttcgtctttcgttacatcactgagcttcggcaatgtcttcgttggaataatcgcatagtgttcttgtactttgcttccatctacataccgtttattttcgtttagctgcggttcggaaatgcccactcctgctagttcgagataccgactgaggttgcttttcaggtagtcaaattcggggctaccaatataattggtatcgcttcttggataagaaagcacctttttttcatagagtttttgagcgatcgaaagcgttttgtcggcactgtacttaaagcgtttgttcgcgaaagattgtaaatcagacaagctaaagagtttcggcgcatactgccgtttttcttccactttgacatttgttacttcggcattctccgcttgctctagctgattggtttctttgaacccgtcaaggttttcgagtgtatcaaaccgctctttgtatttccctttgtacttaccattcgagtgtgtgaaagtggcatacaactcataaaatagcttgctgacgaaatgtttgatttcttcgttgcgttagtaaatcaagaacaaagtcggggtttggacgcgtccaacgctaaacacgcctctcatgccgtttttctgcatataaagcgtgtaaagacgggtgagattgattcctaccagccaatcagcgatttgtcgggtttctgcttctttgtaagtggaataaaacgcctgtccgtccttcagattttgaaatccttttttgatttcgctagtttcaagcgagttgatccataaacgtttaatggttttccggctatttcccgaaaggttgataatcaagcgggcgattgcttcaccttctcggtcgctgtcggtcgcaatcacgattgtttccgcttcatctaaatgctttttgacgatcttgtatacctgtcaatacggattgaactgttgttaatgctccggaaattcttccttgaatatctcctgcagctgcacctaaatataaagtttggaaattattttgtagaaaattcatagctcattctcctttatttttcttcttctctttgtaaagctattgtttgttcttgcttttgttctctatgttggtcttgctgttttttaagctgttgagccaattcctctttatcatctttatatggagtgagtcgtttcaacttatcgctttgaaatgtaccgataaaatattttttatctccgttttcgtcttctctttcaagcacgtatcatagatataaatgtaatggcatagtgcgggttttattttcagcctgtatcgtagctaaacaaatcgagttgtgtgtccgtttttggggggtctgctagcttggatttgagtcaatatcttggacacattttagtagagacggttaagccattttttcttttgctaattcttcaaattcctgtggggttagatagtgaatcgagctatggattcgatttcggttataaaatccttcaatgtagctaaatagcgctcgatttgcttcttcaaaatctgagtagctagtcgtgtagacttcttcttttttcaatgaggcatggaaagattcgattccagcattatcataaggtgttccttttctactataagaatgccttattttgttggttttaagccattgttccacttctcttgctgtgtattggctgcccaagtcagtgtgtagaatcattccttctggaatgtgataatgtatttttgctttattcaatgtttgaatgacacaatccacagtcattcgttttgaaaatgtataactaataatttttttcgtgtgtaaatccatgattgaagataagtaacaccaaccatttttcttagtaggaatgtacgtaatgtcagctgcccatttctcacagatcgtttcagtagaaaagtcctgatttaagagattctcttttgaaatgatcggtttattagacctttgaggtctatattttttaactacaatcgaccttaaatttaattgtttcattagcttttggacatgtttaagagatactgaaatcccttcttttaataaaacttgatggatctttgtggcaccatagcgttgtttattcgtaaaaaaaattgttgaaatcttctttttcaacttattatttctgatttctgtagctgtcaacggtttattcttataaaaataatagacacttctagggatttctaataaccgacacaacaaagaaacagtgtaatccttacaccatttttcaataaattgaacaagcgaatttaggttttccgagagaatatggctgcggctttttttaagatttcaagttcctcatttaaacgagcattttcttttctcagttcagctacttcttttccagtcagtcctgtggactgatcaggtaaatataaattcttccatttgtaaatcgttgcttcagataagccatattctttcgctaaccctcgaacagaacgtccagtttgattcagttcaacaatcatttgtttaaaattttcttcatatcgggtcataaaaattcatcctctcgtagataagtttaatttattcttgtctctacgaaaagctgtctaagatttgatactaacaccagttcgtctatggtaagatgtttgtaggtcatttatggttacactcctttgttttctttcgtcggaaatacaatttgagtgtaccataaatgcctttttatttttctaacttaattttacaattcgcgtttcattaagtattaggcacaaaaaatgtactgacatttaaagatataaggaagataattaattggattattgtaccttattaatgaaagaatctagctctaaataaattaattgtaagaggctagcattaggaacattatctgagcataaataaacttcatttagcaaagaattgaaatattccatattaggcatcataacacggcgctgatgtcaagattatggacaggttttagatacaatgtattcgctttacctgtctttttatcatgaataaaggcggtatttttgaccgaaccatcaagattgtagacgtctgatttctttaacgtcatgacatcactcacccgtagtagtgtagcttttccaacttgaaagatggtgtagtttacgacgaccagcccgaaaactatctagtaaggtatcttgaaccatttttaagatatttgaatctttgatgggtagaacgatttgttgaaccatattagtattcctcctttaacttaatatatgactaatccaatcagcaacgtaagtttcggtgaaagctgcgataacaattaatgggagaacatatttaatataagggcttaataataattttaactctttcaatagatttgtatcagcactttttttcttagatattttgtatctaatccatttattaaattgatccaaagctaccatccatacgcaaaatgcgaagacctcaaataaaatatgagggagcgaggagattaaaataacgaatccttttgccaacgaatatctaaaaactataccaaataatattccaggtagtatgactgtaaaaagtggctgaatccaatataaaaatcggataggtataattgataaaattaacatacctatcgggactttaaacccattattaaaaatatacgcaactactaattgtaatcctgatttttgtgatacggattttgggacattgcttgatacagaatttaatgtatctgataaattaggattgataatataagttattacagctgaaataacaataacaaccgtcaagatccctaaatatttaatgggtttaaaaaatctattcattagcctactccttttagggttattatatcattaaaataaataaacagcccctttattctgacatttagattaaaggggctgttttaatagttttttataggggttattctaattatagaccctgagttaaggaatgtactgatgttttctagtatagtccctagtctgataatatttgttgtatttttctgttccttgagtaaatctaacttacgttgatgaagagcgatagtggcgtctaactgtttgaagaatgagcctattttttcttgtccaaatttatcttccgtcatctaactattcttcttttattttttagttgttacgacttcccaaaccgccaccacttttttggtttggttttcgcttctgctggttgagtttctggttccgattcacttggtgacgccacatcttcttctacctcacgactcggcatcgctaaggccttcaaatctttaatttctgctttgtactcctccagcagctttttgtcttgcaaggctaatcgctgttgctggtctagtaagtattgcatttgagctatttgtgaatctttattttctaactgcttatccttaactgccaattgtttatctctatttttcttaacttcatcaagttcactaattaaatagttgtgaatatctcatttagtctctttgtctgtttgtttgtctaccttagaccttataaatcgctgttcttcgatagacaaaacaacaattcctctatcatttttttgtctacttttatttgtcagtgatacccgtggtgctagttaatttttcctagaggaaaatgtctaaacatgttggtaattcaacaaaaaaacgcatatagtagtctcaaaactcccaagaaatgaggactatttaacaaactacgatggttacgtcgtgacaactgaacattttgacttagccaatcctgttactaaagtcgatgatatccccgattatgaaatgtacagtcaaacaatcgatagcttaaataagcgttttggcaatcgtgttttaaaaggcatcgaaatcggttacatcgcttctgaaaaggatcggatcatcgactatttagccgataaagattacgatttaaaattactcagtgtgcatcataatggtcaatttgattatttagatgacgaagtcaaagatatggatcctgctattgtgattcctcagtattttgcacaactttcagaagcactagttgttatagaagcagatgtctttgctcattttgactatggttttcgggtatttggtctatccgttgctgaatttaaacaatacgaagcgcagtttttaccgattctagtagctatatctattactacaataatgaacggataaaacagaaattaaactgtcaaagtcccgtccaatttcgtaaaacaaccgttacggttgtgtaaaaatatcattttagagcatgaaaaaaagagtggatttctccactccaaaaaggtctaacttttggaggtcactacatttttgatcctttttatttgattaattatatccagctggataataattttgggggcaacatttctatcttactattatcttcctaaagtagtagactttcttattgggaaaaattacaacaaaaaggagtggcttagttgacaactcctttttgtttacaaatcaattggatatctacaaattgtattttctaacgaattttatagacattaaaaaattaatttgacgttaaatactttctccagaaagtattgagattggtaaaatataatccttatttgtcttttcgcctttaatttttttcagaagaatatcaacaataagacttgcaatttcatcaattggttgtcttattgttgtcaattgtgggaaaaatttctcaatgaaagaggtaccatcgtatccaataatttttaaatcttctgggatattaagtttaagttgatgagcaattttcatagtgagaatggctgttaaatcatcagaaacaaaaataccatctggtttgtgatttataatagttgactttatttccatttcacgacggatagtagacagattattaggaattttgaaaatttttccatttggattttgaaaagaaaaacctagtgcacgtaattctgtgggagaatccgtgttatcatttcctgtaatcataatggtattttgacaaccatttttttgtaaagtcttagctgcaagttttcccccttcaaagttatctgaagaaacaatggaaacattaggagctaaatttctatcaaaagcaacaataggtgctctcacacgctcataatcagcaattccaagattatggcttgatgagattatgccatcaacttggttggcttcaagcatttcaatgtattctctctctttagcagaatcattttgactattgcaaataatcgttttatatccatgtttaaataactcgatttcgagatactcaatgagttcagagtaaaagatattactaatattaggaaaaataagaccaataagctgaggtgactttccttgaagtccacgtgctaaattatttggtttataaccaagagttttcatagcttcatgaactttttgttttgttttttctgataaatatcccttattattaatgacgcgtgaaacggttgttgggctaactccagctaagtcagcgacatcagttaattttgctaccattttaatattttaattcaaagtattttccagtcggttcgcctgatttgatttgaataccattttggtgattttcagggaatacacgactagtaaacactttttctcctttattaataaaaatctcaatgattgagttatctacaaaaatgttagcagttgtttctttagtatcaattgagcattcacgaatcgtaccaaagtcagtggcatattgaatgcctgctttgctgcgatctaaaataatttttccttctttggtatctacaatcaagctaagtccatttcctttactatcagagaaaagaagtaactccgatttctgatttggaggaaaagttagttcaagctcataagtattatttgtttctgcttttgctgtaaattgttcagaactagcacgtaatgatgtaatagcttctactggatattggtaaagtttaccatcttttattgaaagttcttttacaagactcattgctccctgataatcatacttatcagttggataatcgatatcaggtagtccaatccaactgacaatcagagcacgaccatcaggagtattgaatccttgagtcgcatacgcttcaaatccataatcaagattttgaatttctgaagcgcccacaagttttactttttctatgtcaagcgattgacagatcttaaaagtattcggatagatattcccataatttagctcagatttatccaacccttgaggacaataaatgagaacaggttttttgtctacaaatactagatttggacactcaatcatgtattctgaaccagtgccgccaaaatcaaggttgccaacttcctcccatgtttccacgttattgtcatccgctttgtaaagtttgataaagcctgatttttctaaattttgtgctccaacaatcgcatataattgtccttcataattaaacatttgtggatcacgaaaatgatcagttacatcagcaggtttatgaataagaacattctcacctttcgtaatgttgtagtctttatccatccatgctccgatttgaagtgtatcacgttcccaattttcatttcgaaggtttcctgtatagagtaagaatagattcccctctatttcatatgcagaaccggaataagcgccgtggctatctcgttttgtgtctggaagaagttctgctcctgttacatgaaaatgaactaaatcatctgattcattgtgtacccattctttcaacccatgagcagctccaaatggccaattttgataaaaaagcgtatattttccgttaaaaaaagaaaaaccattaggatcgtttaacaatcctgttttaggttcgatatgatagctagcacgccaaggtgatcgttttacattatccttaattttatccatctcatctttagtccaatcagaataagcacgatatcgtatttctcgaggtaagttcatattttactccttcaatttatctttttacaactagtatggtaaacgttttccgttgaaaaatcaatcatttcatttaaaaaaataaaatatatgacaaacgtttgacatatttttaagatatgctaaaataaatttgcatttcagtgaaccgttttcacgtaaaaataaaaaaggagtgattcgaatgaattacagtaaagtagcttccgacgtaatacaagcggtcggaaaagataaccttattgcagctgcacactgcgctacacgtcttcgtctcgtactaaaagatgacacgaaagtgaatcaaaaagctttagacgaaaatccagatgtgaaaggcacatttaaaattgatggacaatatcaagtgattatcggtgcaggtgatgttaatttcgtttatgacgaacttatcaaaaaaactggactttcggaaatttcaacagatgatttaaaacaaattgctagtaaagataaaaaattcaaccccattatggcattaattaaattattatcagatatttttgttccaattatacctgcccttgttgcaggtggtttattaatggcattacaaaactttttaacagctgctggactttttggaccaaaatcaattgaagaaatgtatcctgcgattgaaggtatttcctcaatgatccaactgatgtccgctgcaccattcatgttcttaccaattttagtaggtatttcagctgctaaacgttttggagcaaaccaatttcttggtgctgcaattggtatgatcatgacaacaccagatcttggtggctcaactgaatattggaatatttttggttatcatgtttcacaaacaaactatgcttatcaagttattccagttttagcagctgtttggatattatctatattagaaaaattctttcataaaaaattgccatcatctattgactttacattcacgccattattatcagtaatgattactggatttttgactttcacagttattggccctgtaatgttattgttgtctaatggaattacagacattattgtttggctatataacactactggatttattggaatgggtatttttggaggaacatattcacttatagtcatgactggtttacatcaatcatttccagctattgaaactcaattactttcagcgtggacaaatggtatcggacatggagactttatctttgtagttgcatctatggcaaacgttgctcaaggtgctgcaacatttgccatttggttcttaactaaaaattctaagacaaaaagtcttgcttcctctgcgggtgtctcagcacttcttggaattacagagcctgccttgttcggagttaacttaaaataccgctttccattcttttgtgctttaattggttcaggaattgctacagcagtagcaggattacttaaagtagttgctgtttcacttggttcagcaggtttcttgggatttctttcaattaatgcaacatctattccattttacgtattgtgtgaattgattagctttgtagttgcttttgcaattacttacttctacggtaaaacaaaagctgctggtatctttaaagcagaagaaattgctgaacaaacaccagttaattcttcaaaagtagcaacaacagatccaatatctactgatgttgaatcaacacaaacaaaagtttcatcagaaacaattgttagtcccatttctggtaaagtgattagtctttcttcagtaaatgatccagtcttttcatcagaagctatgggaaaagggattgccattaaaccaaatggaaacacggtccattctccagtagatggtactattcaactcacgtttgaaactggacatgcttatggtattaaatcaaataatggtgctgaagttctaattcatattggtattgatactgtatcaatgggaggaaaaggatttacacaaaaagttactactaatcaaaaagttagaaaaggcgatattcttggagcatttgaccgttcaatgattgagaaagaaggtcttgatgatacaacaatgattattgtgaccaatacttcggattattcagaagtaaatatagtagctgaaaatacagtcactgagggtactgatttacttgaaatcaaataaatatatttccctgagtaaagatggaattttctttccaaaatcaaataatatagattaatcaaatatttgagaataacattttatttaatcttttcatatatcaattgtatgaaaaattattagaattttaaaaaatgataaaaattcaaaaagaaaaaatagtagttatttacttgtcatgttactaaataaaaaaataatttaaatatgatatatagtcatttatttagtgatttcattctaaaataaagggagaaatgtctatgctatacggtgcaattgaagcaggcggcacaaaatttgtgtgtgccattggcgatgaagaaatgacgatcaaggaaagagtgagctttccgacaacgacacctgaggaaacaatgcctttagtcattgacttcttcaaacaataccaagcagatttagcagggattgggattggctcatttgggcctatcgatatccatcgcgattccgccacttatgggtacattacctcgaccccgaaattggcatggcaaaattttgatttcatcggtaccatgaaaaaagaatttccgatcccgatttcttggacaacagatgtcaatgcggctgcctatggtgagtatgtcttcggcagtggcaaaggattgagcagtgtcgtttactatacgatcggtacgggtgttggcggcggtgccttacaagaagggcgctttatcgaagggtttagtcatccagaaatggggcatatgctcgtcgtccctcatccaaaagatgactttgctggcagctgtccatttcatggcaactgtttagaagggatggccgctggacccgccatcgaaaaacgcttagggaaaaaaggacaagaggttgcagaagatgatccttattgggaaatcgaagcctcctatattgctcaatgtgcctacaatacaaccttgatgttttctccagatgtgatcatttttggcggtggtgtgatgaaacaacgccatatgctgcaaaacgtccacgacgcatttgcaaaattggtcaatgggtatgtcgaaacacctgagttaagcaaatatatcgtgaccccagcattagaagacaacgctggaacgctcggttgtttggcattggctcgagaagcggtcttacattcataaacgaaaaaaggctcttcgacatttagtgttggtagagaaagatacaactgaaaatttagtcataaccagttaggcagagtgcttaactggtttttgttttacttggaagatcaagccttgaatgagataaattcttgctcgaaagttatggaaatttcgatagccgtaggccacttgtattgtgcaatagttttttacaaaaaaaagggggtgcggatatttttttggacctttttaacaaatatatctttgcttcttccgatattgaagagggcttagccctcctaaagataacttaattcgttgattattataccaatgaatataatcatccaatttgtttataaactgattgattgttgtattcttccagtcacgttgataaaacatctcgttttttaatcgtccaaagaaaccttcgcacgctgaattatctggtgaataaccctttttagacatagagtgaagcaagttggctttgttccaatagtccaactaacaatagcaccatcgtaacaatcgacaagtggtgataagtagattttccctgcgggaattctaaattcagtaatatctgttaaccatttttcatttggcttctttgctttaaaattccgatttaataaattggggtgtgcaggagaaatttccccagcatacgaagaatacttttttcgtctagaaaatttaacaaatagattttcctcagtcatcaatctacgtacaactttttcagaaagctttttacccatattttttaaagcttggtgaattctacggtaaccatacgcacagaagttatgattgaaaatcgccataaaaagaagtaaacaggttgtggacccagcacaatgacataagggagatgagttattggatacaaaaattatgaagtccttgcatgatattttatcaacttttggagataagtacctaactggtaaagagttgaataaagcacgaatcattcacgacactgatcgttatgatgaagaaataatcatggcactgctaaataacgatttaattaaaaagcactacgcaaaacaaattggagaatacaccattattgaaacaaacaaactcattgaaacatttgagatggatgattattggatggattcctatacaaaatatacgaaaaaaatcggactcacagctaacggtcgtttcttggaagagtcaacagacgttgtcctagactttccatataaagatactgttttaaaagcaggtatgtccaaagaagatgtggcgaatgaagactttgttccaaatgaaccattttttaatgaagtgattgcggcagaagaaattgacatgttattggataagaaaatactggtgaacgcgaagcggtatactgcaaacgccatcgaggaagccattggtttaagtaaagaggacaatttaattttaaaaggaaataatcttttagcacttcatactctaaaagaaaaatattcacagaaaattaaacttgtatatttagatatttccaccaccagaatgatacaatgaaactatggggtaaagcccgatataaaggcgtttgtgggactagcggcggctaggcttttttgttttgtggaggattttgttaggttttagtagaaatcggctttgaaaaattacccccgggggtagaaaaatttaccccctactctgagattttacccccctatgaaacgtaagattgttcaaattttaggacaatcgcatcaacttacatgcttacaagattatcttgagaaaacgtgatataataaatacagttgattatcttccagataatacgaactatcagaagttatgagaggtgattggatgcccattacttacaataaattgtggaaattgcttattgatttaaatatgacgaaaacagagttaaaggacgctgcgaaggtcagcagcaacgtcatcgctaagatggggaagaacgaacccatctcaattgattcattggtaaagatttgtgtcaccttgaatgttgatataggtgacgtgatctcgattgattacgaaggaaggagagcaagctaaatgagtggacatttaattccaaaacaccaaatgtctgaagaggacattaaagcaaactttatcactcctgcacttgaatctagtggttggaagaatggcaaggacattctctatgagtattcatttactgatgggcgaattgaagttcacggggaacgagcaactcggaacaagaagaagtttactgactatcttttgtactacaagaaagattttccaattgcggttgtagaagcgaaagacaataatcactctgtcggtgcgggtatgcaacaggcaatcaactatgcagaaatgttggacgttccatttgcttatgcatccaatggtgacggttttgtagaacatgaccgaattacaggaaaagagaaaaacatttccattgatgagtttccaacaaaagaagaactttggcaaagattaactgaacaagagaatctgtccaaagagcaacagttaatcatcaatgaaccctactactatgagatgggtgcaaaacagccgcgttattatcaacgtattgcgattaaccgaacggttgatgcagtggcaaaaggcaataaccgcatcatgtttgtcatggcaacagggactggaaaaacatttactgcttttcagattattcatcgcttgatgaagtctggtttgaagaagagggttcttttccttgctgaccgcaacatcttggtagaccaaacgttgattaatgacttcagaccttttggcaacaagatgaccaaagtggatcagagattattaaattctcctgaagcactgaattcttatgaaatctatcttggtctctatcaacaacttgctggggaagatggtactgaaactcattatgagaagtttggtaaagacttctttgacttaattgttattgatgaagcacaccgtggctctgcaaaggaagaaagtaattggcgtaagattttagaattcttcggctcagctactcaaatcggtatgactgcaacaccgaaagaagatggtgtgacatcaaacgctaagtattttggtagcccagtctacacctattccttgaaacaaggtattgaggatggctttttagctccctatcgagttattcgagtgaacctagacgtggatattgatggctatcgtcctgagcgagggaaggttgattctaagggtgagttgattattgaccgtatctataatcggaaggacttcgataagaatatggtcattgaggataggacgctcaaggttgcgaaatatgtatcggaatatcttaaagatcgtaattctagatttgagaaatcaatcttcttctgtattgatattgaccatgctgaaagaatgaggcaagccttggtcaatgaaaactctgacttaactgctattgattcacgatatgtaatgcgaattacgggggataatgctgaagggaaggctcagcttgataatttcattgaccctgagtctaaatatccaacactagtgaccacatctaaattgcttacgactggtgttgatgcgaaaacctgtaaagtgattgtacttgatgccaacattggctcaatgactgagttcaagcaaatcattgggcgaggaactcgattagatccagctcgtggtaaggaattctttacgcttattgattttcgtggtgtaacaaatctttttgctgaccctgactttgatggggagccagttgatatcattgatggcaatgaaggaggagaccccaaaggtggaaacaccggtgggggaggtgattctggcggagaagtggatcctcctgaaggtggaggaggcggagaaccccctgtaaaatactacatcaacgataaagaggtaaaaatcgtcaatgatcaagttcaggttattgatgccgatggaaagcttgtaactgaaagcttgaccgattatacgaaaaaaaatattcttggtcagtatggcacattagacgaattcatcaatgcgtggtcaacttctgataagaagcaagctatccttgatgaacttgagaaaaaaggcgttttccttgatgaaatacgtaagaaagaacatatttcaacttcagaaattgacgactttgatttactattgcaattagcttatggccaaaaaccattgactaaggcagagcgagtaaacaatgtcaaaaaacgtggctatctctataaatactcggatgaagcccgtgaagtccttgaagtccttcttgaaaagtatatgaactctggacttaaagatgtggaagatgtctcaattctgaaacttccagaatttgagcggttcggtggaatgttctacatcattaagaagtttggcaataagaaaaaatacacagaagcagtccgtgaattagaaaatgaattatttacggctgcataatgaggagaagcgaaaataatggcgacaaattcattcgttaaacgaatacaagatattacccgaaaagacgcaggggtaaacggtgatgctcaacgtatcgagcaaatgtcatggctactgttcttgaaaatttatgatagtcgtgaggaagtgtgggaaattgaagatgatgattatgaatcaatcatcccagaagatttgaaatggcgaaactgggctcacacagaaaaaggtgagcaagtaatgactggtgatgagttgttggactttgtgaacaacaaattattcaagggacttaaagagattgaaatttctcctgatatgccagtgcgtaaacaaatcgtgaaggcggcatttgaagatgccaataactacatgaaagatggtgttctcttacgtcaagttattaatgtagtcgatgaggttgatttcaatagtcctgaagaccgtcatctattcaatgatatctatgaatcaattttgaaggacattcaatctgcgggtaacgctggcgaattctatacgcctcgtgcagcaacagatttcattgctgaaattcttcagccaaaacttggtgaacgcatggccgattttgcgtgtggtactggcggattcttgacatcaacattaaacattcttgctaagcaacgtgagacggttgaggatactgaaaaatataacaatgcggtatttggaattgaaaagaaagcatttcctcacttgctcgcagtcactaatctttttctacatgaaattgatgaccctgaaattattcatggtaatacgctagagaaaaatgttcgtgattatactgaagcagacaagtttgacatcatcatgatgaatcctccatttggtggaagcgagcttgatgctataaagaacaacttccccaccgatttaagatcatctgagacagctgacttgtttatggcggttatcatgtatcgcttaaaacaagatggccgtgtcggtgtcatcttgcctgacggtttcttgtttggtaatggtgtgaaaaacacgttgaagaaaaaattgattgaagagtttaatctccatacgattattcgcttgccacacagtgtattcgctccatatacaagcatccatacgaatatcttgttctttgataagacaaagaaaacagaggatacttggttctatcgtttggatatgccagaaggttataagaacttctcgaaaacgaaaccaatgaagtcggagcattttaatcccgttcgtgaatggtggacaaatcgggaagaaatcatggaaggcaactttccgaaagctaaaaaattcacacctgctgagttagctgaattggattataattttgaccaatgtggtttccctcaagaagaagaagaaatcctcgaaccgacggaactcattactagatacaacactgaacgaaaagagcttaacgacaagattgactctgtcttggctgaaatcatgcagatgttggaaggtggtgagtagggtgacgccagaacaattaaaagcctctattcttcaacgagcaatggaaggaaaacttgtaccacaagatccaaatgatgaaccagccagtgagctactgaaacgtattaaggctgagaaagaaaaactcatcaaagagggtaaaatcaagcgtgataagaacgaaaccgagatttatcgaggtgatgatggtttacattatgagaagttcgcggatgggactgtgaaggaagttgaggttccgtttgaaattcctgattcttggcaatggtgtagaatcgaccagctagcacttgctaagggtggaaaacgtgtaccaaaaggaatgaagctgcaggaggaagcaaatagctacccttacctacgagtaacagatatgaagaatgagaccattctggaaaataaaattcagtatgccccaccccaggttagagaggtaataaagaattacacaatttcttcagaagatttatacatcacaattgcaggaacaattggtaacgcaggaacaattcccacccaatttgatggtgccttgttaacagagaatgctctcaagctcatgatctacccgttagttaataaaatgtttctcctgaaggcaattaattccccggcaattcaaaaccaatttttagaattatttaaccaggttgcgcaaccgaaattatcaattagaagtacaaactcgacattaataccattaccaccaagtactgagcaaaaaagaatccttgcgagacttgaaggtgtattcgaggtacttcctaaatatgaagtttcatacgctgagcttacgaaactgaacaaagagttcccagagaaactccgtaagtccatccttcaatacgccatgcaaggaaagcttgtaccacaagatccgaatgatgaacgagttgaggtattgctagaaaagatcaggcaagaaaaacaaaagttgtttgaagagggaaagcttaagaaaaaggatttacaggaatctatcattttcagaggtgtcgataactcatattatgagaagaacggaaactcagaagttaagcttgatgatattccagaattaccgagcacatgggagtatgtaaggttcaaagatattgtaagctactatatggggaaaactcctccacgctcagcaaacgaatattggggtgatgatatcccatgggtatcaattgctgatatgccagctaatggaataattacatctaccaaagagcatgtgtctcatgaagcaaagaaattattcaaagataagatttctcctgctggtacattattgatgagctttaaacttacggtaggaagagtatctttactcggtattgaggcgacccacaatgaagcaattatttcaatattcccttacgctgatacagatgaatccttgaaaatgtacctgtttaaattcttgccacagatagcgaacggtggagactcaaaagacgcgataaaaggtacaacactaaattctcaaagcatcaataatttattaatccccatgccaccacttgaagaacagagtaggattattcaggaagttgcgaaatttgaagatttaatccctcaacttgggtaacaatttttgcttgttctggtaatggagggacaagcacaagcattttaccgagtttatcatttgagatatgaacaataatattgccggttgcaacagaggatttttgcgaaataatttgtggtgaatttaaaagtaaagataaaaaaacaggattcatgttatgcccagttaatttcgtcaaatcgccacccattacaattttttcttcggcaagatatacagttgcttttcctatatcttccttgttctcccctgtaagggtcattaggatatctgaagtcgctatttctttggacttttcagcaacttttctcgtagtaaacgattttgtacttgtgaagaaataatcgtatgttgtgtatagttcgccatacctcacgcagccaattccctcagcggtggtttcgttcttcttgattccagaaccccgaattagaatgcctaattggcttaatctcgaccacttccagtttgctggtaaatcatcatggggaacatcaattttatgagccatttttcctgacttctcataatatgagattacagaactacatttacctaaaaagcgagagcgcagtcaaagtgctcccgctttttagcgttctaccaagttacaactttatcaacaatgcttttttgctcgctggctgatctgcgaagataaatccgtgttgtttcaatactttcatgtcccatcaagtctgctagtaaagcgatatcgttatatttgttcaaaaagttttttgcaaacaaatggcgaaatgagtgcgggtagaccacatttgtatcaagtccatatttttcggcataattcttaagctgttgtgcaatgcctcttgtcgtaatggctgcatcaaatttattcaagaataaatatccagtgattcgattttcagattgcaaccactttagtgattcgtcccgaagtttctttggaatatacaatcggcgaatcttgccaccttttgaataaatatcaaaatatccgacttcgacatgctcaactttaagtttcacaagttcacttacacgagcacctgttgcccctagaaaccagaccacaaaatgccacttcagattgccatcttttttaaggcttcgcttcaagaacaaataatcagcgtgactgataacgtcctcaagaaatgatttctgctgaattttcacaaagctgagtttcaagtgtgattgctctgaaaaatccaggtatttgtttacgccttgaattcgaagattaactgttttaggcttatatttttcaagcaaataacccttgtattccaatagcccttcaagactcatctcataattcttcaaaaagaattctgtcccaaacaaataggaccgtactgtgttctctgacaggccttgttgccgaagatgcatttcaaaattgttcatcgatgttctcctatcattttgatagaaactccaccgcacgattattatattttacaacggataagcaagcaaaataagcacaagtgatgaccctttggaatcacgacttgtgcttattgctcatattatgagaagcttggaaaaatagaagcaaaaatagaggtcccatttgatttgccgaacaattatgtttggaaaaggattagggacatttattacaatgatggtcagacgaagcctagaaatacttttaagtatattgataccgggactatcgataacaaatctcatcagctattaatgggcaacatccggaaaatatcagctacacaagccccctcaagggctaggaaaaaagtatctgtaaattcagtgctattttcatctgttcgcccatatttaacaaatgcagccatttttgaggaagataatcctgacgattatattgcaagtacagcgtttgtagtgatgaatccgattttggtgtcaagccagtatttactttccgttcttatttcaccatttatgatcgaggaaatgaataagaaaagtaccggttcaaattatcccgcaataaacgacactaatttcaatacactccttgttccagtaacgtctaaatctgtacaggatcagatggttacacgattatttgaatttgataaatatatctctcaaattgggtgattttagagataatcttatcttgttcagatcgtccgcaaatcggaagtaaaatatttgttacggttgataaactaagttcttgctgcttcgttgagccggttgtcaagtcatccatgttcatctgtatttcaggagatggtaaatactctaacgtgaaattggaattaatttcatcaaattgccttattactgttacatgtgagtccgcaacgatattggaatatatccctctatcatcatcagtgaaaatgccgattctgcctacagttccttttccagttgagcaccataaaagatcattgtgacgaaccagtcttatattgtcataactcgaaaaatacttaggatctaggaatcttgcaggagataggtcaaatcctgaccattgaatacatttttgagaaataatcggaatctcacttttctcaacatactttggagatttgcctcgctgaatataatgacaaatataattgagctttacccatttccaatgttctggaatatcgaacgggacatcaatgtgaatttgcttatcacctgacttctcataatatgagttatcgtcacctttgtagatgatagattcctgtaaatctttcttcttgagtttgccctcttcaaacaatttctgcttttcttgtcttattttctcaagtaagacttcaaccggctcatcattcggatcttgtggcacaagttttccttgcatagcgtactgaaggatggattttcgcaatttctctggcaactctttgtttattttttcaagcctatcgtgaagtttttggtaatcatcgactttcggcaggccaaccataatggctgatacaattctttcttgctctttttggggtgggactggaactaataatgatgctactttatcactatttaagtttttgactacagcaccagaaattagagccaaaaattgatgataagctacctttgatgaaagcaggtagtataaaaaatctcttgaaaatacttcttcataatttgaaatagctaaccatccatcgtggattgccccgtcaacattcaaaatatatggcctaccaaaactcatcgagttagttaacaaaaatgttcctttagtaacgtatctcgtcttcttaagtccactaggtttaattttctcttttgttgaattgatgaatttgccacctttatcggtatcaccaattttgatccaattaataccgtcatcagcttcagtaataaattctttgattggtctcggtgatcctcctcggacaatagtagatacttcagaaaaacgaacccactcccaagactcaggaatatcaaacgggacatcaacctcttttactgtcccatcagcgaacttctcataatgtaaactatcaacaggaactccccgtcacaacatcaagtgacggggagtattttctattcttccactaattccataatatcagtgatatcacattttaaggcgatgcagattctcaacaaaatatctgttgtgatgttttcactcttacccatcttagcaatagaggcggaactaattcctgtcatttttcgaaggtcagaccgagtcaaattcttgtcgattaggagtttccagagtgggttataactaaatttcatagaatcacctactttcaatatctagcaagaatccatagcgtcctttgttttcatcgtgagtaaatacgatttcatgtacgccatgttcagcatagtttagtttaggtaattcattggtgttctctacaataatcaattgtccttcgctctgatgctcaatgaagtattggaaaagtgactgctgcatgctatcaaagttcctagcattttcaccctcatcaagcccaagtagaggagtatcgatgacaaaaactccgggattaaacttcgcataatcagccagcacttttctgtatgccaatacaactagagtgttcaagaaggagcgatatcctttgccgtggttcacttgcttagggtcaccattgatattcaaatcaaatgttttcttggagaaatatgcatcatgtaaagggcggtaattgcatctctcaagtaatcctttgagaatttcagacatttctcgccagaaggttgcatcaaaatgttccaaaggtttatatgggttgcttgctggtggagattcctcctcaaggtcttttaagtcgagtgaaaacttctgttgcattgattccattgcagcaagctcatgcttgagatttgagtatctatgataatcatcaattgttttttctaactctgctgcacggggctgtagttaagtgtccaaaagtgaatcgagattttgcttctgagaggacaatgaattaattttagatactagagtatcaatatcttctttgctctcttgactagcttctgaaaggtcatctaattgagacataatagtgttgaattcggcacgagctgcttcaatataggattcacgttctgtctcaggtaattcaccattgcagaaagggcaagtgctgttagtcaaatgctctaaatgttcatcgattagtctttcaccatcaacaattagtgttaaacgctctaaatcagatttgtactgggaacgtagctttgaatagcgattaaccaatagataatcttcgtccaatttttcttgatactgaccaatctgttgggtgattttacggttttcattggctgctttcacaatgcgtgactcaacatgcgtcaaatcattaacgagcttatcgacctcaacttcaatatcggcaacaccgagctcatctaatcttttcttagccaaatcatattcttggtatatcgtcattaagttgtcgttgatatatcgagaaatagaagctttacgtacttttcgatgatcagctgattcaatttcttcatagttagttgaatcatttccacttattaagaaaataagtgctgataggtaagcagttttaagtgtattatactctggaataagaatcgggttcgtagtcccaattaatctctcgcttatgagtagactgtgcgagaaggtgcgccaagtaagagtttgagctttgtaatttgagtttttaatgatttggtgttcttcatcaattccgatcaattccagccaaaacttactgatagattcattcggctttttccccggtttggctttcagtgatttgctaccaatggtagtaccctcagaattgatttcactaacaataatctctttatcatcaaaaccacgggaaagtaggaactcccctctatttgaagcaactctcagcaataccgtgtcatatccagtttgctttgaaaatggtggggtgtcatcaccgtacatgaagtctattgcttgaacaatacttgtctttcccgtatttgaaggtccagaaacgatatttagaccttcggtgaaagatacggaagagtcacgtttaccaagaccagttattataatttctttgatatagaattcaggcatgctattctcccttctgtaagtagtcctgctcagttatgagcagtagagcttctttgtcggtcctatcttttaggaagtgctttgctctttcggctacttcaagatatttctctgcatagattgaaacaaacttaggaattagtagctttccctcatctgacaatgaatacataaaaccttgctcgttttgtgatggctggattagccgttgcagaacgagctttttgattgccgcgttaaccaacgcgcgtctagcaatgaactcacttgaatgatacgaattatcaccatttagatttgatggaaaaatatcgaagtcgtgcccataagtagtgatgaaatctgaagcaagtatccgatctgaactgacgggaatgctttgtatggatagggtcaaaagtatacgtattgacacctcaaagggtgtgttaaataaattattcatctttgtaaacccaactaatccgtccatcgtttacaagcatgtggcagattcctttctttgtgctgtttcttatcagtcctggaattgcagtcaatggagagccgttcaaggtaatcatagatgagtgctttaatacttcatttaatcgctcaagtccatttttataggtatcttcgtagacttcttcaacaccgtcaaacatgtcttcttttaatgattcaaaatgctccatgttttcatcaggcgtaaagttgtcacggacaccccggcgaacgctttctgccttgtagtagttcctgcgttgacgttttagtgttttttgatgctcttcgggcaaattatcttcttcgtatgtggaacatttatcggcatcagcaaaagcacaaagaagagcccttacataaaccatctcttctttttctaaagactcaggaacttctaaatctgtaaaaaggtgcattactttgttgttgatagtaaaagaaccatcatcgccaactcgaatactcgctagtgccagttcttcaagtttaaccttctcagattttttagatcgttttttgtaataaacacagtaatttatgaaatgaaaaggattacgtttaagaaaaactagtttttttcatttatttttaccatacatctatatttaagaaagtgttaaggtatatttttctctatgaaaagttttttcagatacaaaaaaaggaagattaaatgagaatttaatagcgtttctattaaaattacaatcgtaatttaaaagtgcttgacattgcatgtgaaatcacttacttttagtgtgtaaaaagattaaatgaaggagctacataatgaaaaagaaaattattgttagtgggatcgtggttgcatttttatgtctaattggctttacaggcacgcgttacgcaaatgaaattattttgtggggtggagagacagatatcgatacaatcaatgagaatctgacacagcttgaccatacgttgacagataaagagcaaacgattacagatcttaccgcacaactagcacaaaaagaacagacattgcaagattcaaaggcagatgtccaagaataccaagcaaaagtaaatgaattagaaaaccaaaaaaatcaattggcagcagaaaaacaaaacttagaaagccaattagtcagcaaggatgcacaactacaaagcaaacaaaatgaaatcaatgcgaaactagacgaaatcaaccaaaaaaatgatgaaatcaatcgattgaatgcaaattggactgcaagactacaagaagcacaagcaaaactttcagaattacaaaatactgtaaatggtttgaaccaaaaaatcgcaacactgacacaagaaaaagaaaatttagaaactcagttagcagatacgcaaaaaaattagacgaagcaactgctgaaaacacaagtttgaaacaatatattcaaaagttagaaaaagcaaaaggcgaagtggaagatacagctgataaatctcaacaaatcgttgaagaacatttgagtaaataatcttttatgataagtaacccttgatcagcaatgcggcgacagcaatttatgctgttgccgcttttttgttaataagtggtccttcatcgttgtaagaaaagttatatgttctttaagaaaaatagctggacaaaaaattacaagataaaaagtgtttcctctttacaaaaaggaatgtatgttcgtataatggtgatgaggtgaaggcaatggagaaaaaatatggaacagtagataaaatccgtacgttgcaggtcagcgccagaccactgattcgttttagcttaaatgaggtcaattgtttgattgcttcccatagtttgaacttcctagctgaagtagacgaaaggatgaaactagttgttacaggatattacaataatagaaagcaattcgttgtgagatcttatcatgtgttaggaaaaccaaaaattgtggtagaatatgagaaaagtctatacccaagaaaaaaggtccaataagatgaaagaatgaacgagaaaaagaaaagcggctgagacaaaaatgtcctagccgcttgttttgaaagaaaaatgcagatgatgggactcgaacccacacgagctaacgctcacatgaccctcaatcatgcttgtctgccaattccaacacatctgcctgatataaaactacagacctactaatagaaagtggcatgtctgccgttccatcacgtctgcataaataataacacaataatgatagcggggttttacatagttgtcaagctcaaaaagtgggaggtcttatgaagatggagaaatatgacggagaattttcaggactggggatgatcctaggcatattgattggccttgcatttggccgttttctatttgggttgatgctgggaattatttgtgggattgcaatggattgggcagcaaatctatggaatgactatcatgaccagtaagttctcagcgcttctctgcgtttttttcgatacttatgtttttcctaaataagtggcaaatttttctaggatggagtatgatattgaaatagtaaataacaaaaaatttggaaagttctaactttttgaaatgagggattggctaagtgatgagagaatttgaaaaatccaacaaattagaaggtgttagttacgacgttcgcggtcctgttctagaagaagcagagcgtatgcaagaagagggcatcagtattttaaaattgaatacaggaaatcccgcaccttttggattcgaggcaccaaacgaagtcattcgtgatttgatcatgaatgctcgtgattcggaaggctactcagactccaagggaattttttctgctagaaaagcaattgagcaatattgccaactgaaacattttccgaatgtgacgatcaatgatatctataccggaaacggagtcagcgaactgatcacgatgtgtatgcaagggttgctagataatggagatgaagtactggttccaatgccagactatccgttgtggactgcctcgattgctttagctggaggtacacctgtccattatatttgcgatgaagaggcagaatggtatcctgatattgatgatatcaaatcaaaaataacgagtcggacaaaagcgatcgtcatcatcaatcctaataatcctactggggcactttattcaaaagaattattagaagaaatagttgaagtagcccgacaaaacaacctgattatttattctgatgaaatctatgaccgcttagtgatggatggcctagaacatattccgattgctacattagcgcctgatttgttcgttattacgctgaatggtctatctaagtctcatcgtgtggcaggctttcgagtcggctggatggtcctaagcggagataaatcacacgtcaaaggctatatagaagggctgaatatgttgtcttccatgcgtttgtgttctaacgtcttgtctcagcaaatcatccaaacggcgctgggcggttatcaaagtgttgatgagctgctcctgccaggcggaaggatctatgagcaaagagaatatatctataatgcaatcaatgatattcctggtctttcagctgtaaaaccaaaagctgctttttatatattccctaaaatcgatacaaaacgattcaatattttggatgatgaaaaattcgtcttggactttttacatgaacatcatattctgctcgtgcacggtggcggattcaattggaaccaaccagatcattttcggatcgtctatcttcctaaaatggatgatttgaaacaaacggctaagaaaatgagagaatttttagcgacatatcgacaaaagtgactttaaaaaaagcaaattttccagaaagagagccacagacaaatatactgaggctctctttctaatggagatctcttaaataactaaagtcatattatttagttgcaagtcttttcttgaagtttgcgacttcctaaagtaaaatacggatagaatgcgaatacgcatattttggggaggatacttatggaaacgttaatcgagtcctttggcacgatcattaaagagattcgaaaagaacaaaaaatgacgcaaaagatgctttcgcaagatatttgttcacaaagtgtactaagccggatcgaaaataatgaggaactgccaaatgtattggtgatgatgcagatttgtcaacggctaggagtaacgattgatcatgtgatgaatctctctcgaaaaactactcggacaaacgataaattatttgaactgttggatagttgtttccaaaaacgtgattatcgcaagttagaacaagtactaaaatcttctgatatttctgagaatctgtatcaagcaactgactttcaacgatattattattatctcggtgtttgtgaattcacgttgcgtcaaaatatttctcagtctctttattatttaaaagaagcattaagctactctagccaaaaagaaagaatccatgtttctgacacagaaatacaactgattagttgtatcggaaaaatatatggtgtggcaggaaaaactgctgaagcccgctactatttgagtcgaagcatccaactgctgcatcaatcagctgatgaacgatcaaaaagtgaattttcgcaaattttttataattatggaaatttcttattccatcaaaatgaaattgacgaagcactagagcaggtgaaccaaggaatctattgggctcaagagaaaaatagttactattatctcaatgatttatttgtgcttaagagcttgatatacaagcgtaaagaagaaccagaaagagcagcattttatgaaggattggcacaagctgtgaaacaaatttcaaaaaatctataaatggtgtagaccattcttgacttcttctctaaataagagtactttagaggtagaaaaacaaagggagagaatagaatgagaacttttatctatgctgacaaattctttttagcgtcaggcgtcaaaaatgcaggctatcttgaaattaccgatgggctttttggtgaatacaccaaagaactacctgagggagaagtcaacatcattgaccaaagcggcaaatggattgctcctggtttggtagatacacatattcacggctatatgaatcatgatgtaatggacaacgatgcagaaggtatcaaagtgatgtctgaaggtctattatcttgtggagtgacttcatttttaccaacaacattgacgtcaagcaaagaacgtttaaaagatgtagctgagacaatcggcaaaatgtatcaggaagcaccaggagctaaaatcaaaggaatctattttgaaggtcctttcttcacagaagaacacaaaggggcacaaaacccaagttatttcggtgatcctgatttggatactttccatgaatggcaagaagcttcaggcggtttgatcaaaaaaattgctttagcaccggaacgtcaaggtgtagaagagtttgtcaaacaagtgactgaagaaggagtagttgtttctctagggcacagtaacgctacgctagaagaagcgcaaaaagctgttgaagcaggtgccagcgtgtttgtccatgctttcaatgggatgcgcggattgaatcatcgcgaaccaggtatggtaggtgcgttattatctttagaacatgtcttttctgaattgatttgtgacggacatcatgtacatccaaatgcggcaggaattctaatggaaaaagcaggacatgagcatgttgctttaattacagactgtatgatggccggtgggatgcctgatggaaattacaatttaggtgaatttccggtagtagtaaaagaaggaacggcacgtttggaatctggcaacttagctggaagtatcttgaaattgaaagaagcaattaagaatgtcgtggattggggacttgcaacaccagagcaagcagtcatgatggctagtctgattccagcaatcagctgtaaaatcgatgacacatgtggaaaaatcgctcaaggacgcgacgcagactttatcgtattgaaccctgatatgacattggaagcaacttatctagatggtgtggaacgcttccacgcataatataatccaagataaccttaaaacgaaacttctcaagtttggttttaaggtttttttgtgttctaatgaatatcactttacataagtttcaaaagtttctttaattccttattgttcaatagttaacaatataaagataaaataaaaaatgttaatacgtattagctaaataaaagcattttttattgtgaaaaaatgaacaaaaataggaggggaaagatgaacttatttgatattttccgatcgactttgacagatatgtcgattgttagtgcaattacttcaacagtttttattatattattagggtttatttgtagaaaaaaggaaattttttctgaatctgttggaaaaatcctatcgaaagttgtcttaacagtggctctaccagcacttgcatttcgagctttcatgcaagatatcaatacagaactcttgatgcaaggaattaatgtgttgatttgggggttagttatttatattattcttattctagtttcaagaccttttttcttaagttataaaggggataagcaatcaacgttgcgtgtcctgacaatctttggttctacgacctttttcgggacaccaatcgtcagtgcgatttatggaccggtcggcgtgatgtattcctcaattttcaacattggttatcggatctttttgtattcttatggatacataaaaatgagtggcttgaagatggaagccaaaaatatcaaagcgatgttcgttaatccaatcatcatcgctacttttgccggccttttcatttggcttttccaaggatatcttccacaagtgtcaatcacaggtgcagaaggagagataagccaagtagcgtttttgcgaattgaccagacagcaccttggctatttcagccaatggattatttagctggtttaagttcgccattggcatggctagcaatcggcgcaacattaggtgaagtaagtttcaaaaaagctgcttctgaaaaaacatcatggtattacagtttagtcaaagtggtatttgtacctgcgttgaatatcgtgattttagcagttttgacggcaacaaatattctaccggtcaattttgaagcactggcaacgattgttatcatgatggctacaccagccgcaactgtggcagcagcctatgctatcagttttgatagggaggcacttttagcctctaatgcatccttactgtcaactatttttgctatagtactgacacctatatggatcgttgtattgcaaatgattcacggcataggtttgttttgataggaaatggaggaggaaagtatgagaatcgcatgttatggtgttcgtccgaatgagatcgatttttttgagcaattgaatatttaccattatgaactgagtctttatgaagaattactgacgcatgacaatattgaatcagctaaggcccatgatgctgtactgctgagaggaaattgtatagcagatgagatcaatcttgcaaaaatgcagaaatatgggattcgctatgtttttacccgaactgtgggagtcaatcatatcaatctacaagcggcagctgattttggtatgacagtagcccgtgtcccatcatattcgccaaatgctatagcagaattatctttgacttttgccatgatgcttttgagaaatacagcgtatacgacgatccgaacatctttcaaagattttcgagtggatgaacaaatgtttagccgtgaaatcagaaattgcacagtaggtatcataggaacaggcagaataggattgacggaagcgattttgtttaaggggctaggagccaaagtgatcggctatgatatccatcagacagaagctgctaaaaaagtattgacgtttcactcactcgaagaattgttagcaaaaagcgatatcgtcagtatccatgtacctcacatcccaggtgaaaacgatcaaatgatcaatgaaggatttttggctcaaatgaaaagaggcagtatcttgatcaatacagctcgtggagagcttcaagataatgcagctattttaagagctttgaaaagcaatcatttagctggttttgcaaccgatgtttttgcaaatgaaacagatgtctttttccgatctttcaagccatgggagacgattccagatcctgctatccagcaactagtagaattgtaccctagagttcttataacccctcatgtaggttcaaatacagatgaggcattgtcaaatatgatttcgacaagcttcgagaacttccgcgaaataatagaaactggaaaaacgaaaaatgaggtatctcttcctaaagcgcgtcaattaaaataaggaaacatgggcacgcaccactaatatgtttaaaaatagaggttgtgacagaagtggtcagcttcaagaaataagaaggaatttacgaaaattgcttctcaaatttttgtgaaatttcggattatttttcgaagaagctacttctggaacaccatttattcggactaatttttctgtctagttaattgtagcctatccagtttattattggtactaagtagtatttttcttttaggtgggtgctcaaattcttctcaatcaaagcttgcagaccttttcgaagaagagcagtcatattatttgtcgaattctccttctgatgatccagaattcaaaatagaaaaaatgaaagatggttctcttactgtttccaatattgataagggaatttctgaaacaatggaatattctgtagaagaaaaagagaacggcttgtatcattaccgaatcgcaaatagcgaagattacggtatattcgatgtactagatagttttacttcggataccaaagatttcaatgttttttttgatgaaaagaacaatggttatgcgtttgtacctgtttcaaaaaatttctctaaaatagactctacgttagaagaggtaaaagaaatttacgatgaagatcctcagtattttgtagcagaatataaacaatagaatgttagtaaagggagccttttcaaggctccttttttatacgattggaaggtgagtaacacggaaaaagcaacggaatttctacagaaatttagtgaatggatccaagatgctaacttgtttagctatatatttaagtggattagcagtaattggattaaaggattgtacaagttggcttccggagtggaagatatcctggatcaagtatttaaggtctttagttttcttgataatgggacgataggtaaaatttatacaagcatgcgggtagtctccctaacggttttgattatcatgattattgttattgcctataaatatattttaaacgagcgagtcgatctaaaggcaggccttttcagggctgtcctttttgtttgtttgggtgttcaacttcctggggtgattacatctagtgcggaatttgcacaaaaagtttatggagaaacaaaaaatctagacacgactgagaaaagcactctttcttatagtattgtgaaagagaatttagcagatttacaatatgcttctaagaatggattttctcgtcttaatagtgaaacaggaacaccaaaaaacaatctatcagaacaagcttttaaaatgacagatcttacggaagtgataacatctgataaattgtcgagaatggcagaaaatgcacaaaataaagacgaagtctcttatttagagtataaaactaaaacagatgaggatggaaaaattactgcagaaaaaattgagtccggtatgtttgacttttataaagagggaaaatttcgctttacgtataagacaggcacgataacattgtcgttattgacagtgtcttttgcttttgtatgttctgcgttcatcatagcaacgtctttgattgagctactatttgcaaagttgatgtttccagttctttctgtttctgatattgaaaccgatcaacgaacaaaaaaaatccttttggatattgggaacagcttgttagcaattatgttgacagggtttagcttgagtatctttaagttatacttttcatttataggtaatcttgatgtcgattttcttccatatttagtactttgtattgttggtgtccgaattacgatcgacggcccaaatttctttgggaaatttctggggttggatattgggcttcgctcaggatggcaagctatggttggtacagcagttgctgcgaaagctgcgacaagcgctgtaaaaggtggagtgaatgctggtagtagtattaaagagcacgccggaaatgcagtcagccgtatgagagtcaataatggtgtacacgaaaataacaatgataaatcgattcagaatcggtctactattccaggaaacaatggatcttccacaaaaagtataaaagaatttgcagcgaacatgcgacagtcgtttggcatgcaagaccaacaagagccggtgacacaaacgcaaggatcgaatcgatcagcggttccaaatgatcagataaatccatcggttcaagacaaggatcaggtttctgctaatggagagctgccttcaggaaccaatctttcaccagaaacaacgcatcaaccaatgaacgcttctgcttcttccagcactgtttctgaaggaaaagaaccagatggaaaaagcattggcaatgtttcagctgaagcgttgaaacatatgggtgaaagtggcaatcgaaccgaatcaccgatcgatcctatcaacggcaatcgtgcgaatggtttggcaacggggaaaacgaccgattcacaaaaagtccaacgaacgaccattccgccgcttcagacgccaagtagaaaagccgccatccaagcagcgactgacaaagtcaatcagaacaacaatatgcaacagtcaaacaatccgagtgcatctgaaggaaatccgactaacactcagagagctaacgatcaggaagtgaaacgatccgcaccagaaacgtcttacggcacttctgcagcagcgccaagtcatctattcaatcgactgaacaagcgcctgaaggagcttctgtggcatttgaacggactacaagtgtgagtccttctacagctgcgatcgtacaacgaagcaatccatcgtctaccagtgctggcactcaaatagtgcaacaatcacctagtagaggaattgatcgatcaacggtaacacctgctagacggagtgagccaaaatcaggttcgatcaaacaatcagtacaaccaacgaaccatcgatcggtgactagccagaaacctgcagaaaaatcaacggcaccaacgtatcatattccaacggttgaatcaaaaacgaaggagctttctacaccaaaagaattggccaccaaatacttgaaagagtcgagtgtgacaccagaaaatgattactatgatatctatcaatccatgaataaagtaaatgccgatgattatatttaggaggagatcttgtgttaaatgtccattgtattgaaggccgactggctgaaagtcccatcttaaagaaaacggaaagtggcacgtgttatacacgtgtcttgctaatatcaaaaagaaacttcaagacaaaaaggacctgggacaaaaatccaaagtccaaccaaaaaaccggcgtaggaaattttgatttcctgcgccggttttatcttatcttttgaaacaaaagaaccccttctgatacaacataagcgacaaaacgaatacgtaaaggagaggttcttatgtacaaaaattataccacagatcaactagttttacctttagatttaacgcagacaatccccaaaaatgatattgcttatcctgttcatcatttggttgaaagcattccagaagaagcctttgaacacttgaaacaccaacgaggtgcatcaagctatcacccacgaatgatgttaaagataattctatgtgcttacacgcaatcggttttttctggccgcaggattgaagcactccttcaagatagtcttcgcatgatgtggttagctcaaggttaccagccaagttatcgaaccatcaatcgttttcgagtggatgaagctgtacagcctttattaagagagtgtttcgttcaatttcgttcgcaattaattgcggaaaatgaaattgatgaagaagctatttttattgatggaacaaaaattgaagccaatacgaataaatttacttttgtttggcgaaagtctgtcgagcgataccatcagaaattagaggaaaaatctttggctgcgtatcacgagttagttgaagaaaagattattcctgccctgcaaacagaagttgaaggaaatttgtccaaagaaaacatccagactatcttaacctcattggaacaaacgattgaagaactcaatcaaaaaatggcggatgagccatgtggtgcgattcgtaaagatctccgatttgaaagaaaagcaccaaaattattctataatcattttacatctcatcaagaacgtgtgcttacgtatgagaagcactatcaaattttagggaaaagaaatagctattcaaaaacagatactgatgcgacgtttatgcgaatgaaagatgattccatgatgaacggtcaattgaaagctggctataatttacaaattgccaccaacaatcaatatattcttggctatgatgtgtttccaaacccaactgacactcgaacactgactccttttttgagcactttaaaaaaggagtatttcccgttgcctgaatttattgtcgcagatgcaggctatggcagcgaagagaattacatgaacgttctagaaaaatttcaatccacaccgttaatcacttatggcatgtacgaaaaggaacaaaagaaaaaatacaaaaacaatccatttcaagtaaataattgggactatgatgaaatgagtaaccaattcatttgcccagaaggacggaaattgaacttcaaatacaatggaattagaaatgacaagtatggattcacccgtcatattagttattatgaatgtgaagattgttcaaattgtccagttcgatcactatgcacaaaagcccaagaaggattcaaccggaggattcaaaaaaattggacttgggaatcctataaaacagtggtcaaaaaattattgcaagaaaaagaaacccaaaagatttatggtcgtagaaaaattgatgtggaaactgcctttggacacctgaaggctattttgtcgttcactcgattatcagttcgaggaaaagaaaaggtcaaaaatgaactcggatttgcattaatggcaacgaatttgaggaaataccacctcaaattcgtcaaacaaagagaagaacaatgcaaaaaaagcatacacaaaatcatttttcagatttttgtgtatgcttttttgttttaaagaacctttttgtcccaggtccttttatttttttagatgctcagtcctccgcggtctctgctttggaaatcattttaaaccaagctacagaatttgttgttcgagtaaaccgatttaattgtttattaaattcttcaatgttattctgcttgaacttgaccagaattacttacaaaatatttatacacttgatcagttccatcggccatataataaaaataatagccatctgctgtagtttcagttccagcatcagtcgcattaggtctacctaactcattgtgtttagctattgcaagttgcgcagcttctaactctgaaatagatgcttgattaggtgcagaggcactattatttgctgcttcatttggcacagttttaaaataatcatcttggataatttcaccattattattcactgtaatgatgttccaagtgataccttctggccctccgtgtagttgataatgaaaagtaaatgagccgtcagaattttgttgcccattttcaaacgcacctgcaccgcccgattgcggaagtttttgtcccagatattgagcagcttcttcaatagaatttaataaatgagtttgtactacttgtagttcttcagaagcattctcttgcaaagtagttacctcactactttctgttgtaggttctgttgatttagcctcttgattatcaatttttattttttctagttgatttttatatgttgtaattgtatcgtcaatttttttaattaatgaatcgagttctgctttactatatatatcagtactctctttttgcatccattttttgagttcatctagcgtagtgatctttttagaaagatctttttcagttgattcttcaagattatccaatgtattctcttttaaatctttatcgtcttgttctttaaaattcgtttggatcttcttcatggagtctgtatagatcttagtgattttctcctctttcttatctaacttagagtaagtattagcttcagtaacaaattttttgtactccgataattttttatctttgtctttttcagctaaaattgtttctacgtttttttctatttttttcgttttgctttttaccacttcagcagcttttgattctgatgctgcagttttacttttatctgttttagttgaacaacctgcgaaaataaaaataaaccctatcacaacaatcataaataactttgttttccaattctttgagtacatatgctttctcccaattatttttttatttaattataacatccctcactaaaaatgatagcgtaaaatattttgtgtaaatagatatttagggtagaaaaaaagaaagtccattctgtaaaattaaagttaccacaaccgaaattttataggaggactttctcatgcccaattttactacagaaattatggaaacactagagagtgtaaaatattttgtgtaaatagaaaaaaaggaagtcccttctgtagaatagagttaccacaacacattcacagaaaagaggacttccatatgaacgattttactacagaaattctaaagactctagcgaacaaaggcgatttgaatgaattattccgtgtccatttggaaaaagctgtcaatacgcttctcaaaatggagttaacggctttcctcgattacgaaaagtacgatcgcattggttttaacacgggtaattctcgtaacggctcctatgaccgtacggtcaagaccgagtacggggaacttcatctccagattccgcgcgaccgcaacggcgagttcaagcaacagactgttcccgcttatagacggacgaatgataccttagaggagaccgtcattcacctcttccgaaaaggtattgccatgtcggaaatcgcagacttgattgagaaaatgtatgggcatcactacacgccccaaaccatgtccaatataacaaaatcatttacagaagaggtaacggcgtttaaagggcggaggctgtgacaaaagtagcttcttcgaaaactaagccgaaatttcacaaaaatttgagaaacaatttccgtaaatttcttcttatttcttgaagctgaccacttctgtcacaacctcttttttatttatttttccatagaatattggcttcacaatacagctgttcttgcattcggatttcatgttttgttttgataccattttcggttgggacttgttcaaaatggctttcgatctcattcccgtactctacttctttatcaaatcgaataattactttttctggaacatgcgtagtcaaaaagtcatatcccaatacatcaatgatccaattaaaatacatcgcattattaacatgctgattactatcgatatcataaaaacgaacacgatatggcaacatgaagcccgaatcaatcttttcaattttttcctgacgcttgatttttttgatcttctcactctcaaaaggagcaatgatttcttcattaacactgctcatttttcgattcacaaaatccatcaatacaaaaacagattctattttgactaattcttccccatcttcatcatggatccagaagttccgataacagaaaaacttattgtactccatggcttgagtcgttactgaaattacttcaccgactctaggcagacgattaatctccatagaataattcgtgatgacccaagtcagtccaaagctattgacgaattcactgcctcttcccaactggtcgctttgatcttcagatgttttgataactactcctaacatcgaaggaaatgtcatcgtttgattgatgtcacactcataatatgaaacttcatgctttttggtatatttctttgccaaaaacacgccctcctcttaaaaactttctagtaattgatctacttgggaaccgtaactttctccaaacatattcaaatgtgccaaaagataatataactggtaaatcggtagtcgatcttcccatccctcttctaatggaaatatagtttgataggcatctaaaaattccggtcggaaaccgccgaataactgactcattgcaatgtcttgttcccgattcccataagaaacagccggatcgacaaaaattggatgtccttgctggtcaaagaacacattaccactccacaggtctccatgcaagaggcgtggagtgatctttttgggttcaaccgatttcaatactcgttctttaaattgcagatacttttcttgccgctgtacattccaacgattcgtttcttccgctaaagaaatctgggcttcaagccgatttttaaagaaaaaaatccaccaatcttcttcaaaagaatttttctgaataagtgtacctagatagttatcttttcgaaaaccaaattgtggcgctgtttgctgatggagtttagctaaagctacagcaagatctcgttgatctccttttcccggctcgatccattccattaacaaataagcgccttcacttgtttcacccagcatgtaggtatctggtacacgtacgaatgtagctagctcttttaacccatctacttctgcttcaaaaaaatctttttttacattcggatggattttcaaaaaataagcacgttgatctgtttttatacgataagtttgattcacatcgccgccaacaactggaatcactttcccatttagtttcagatcagataaaacagtttggatatccatgacttttccccctactcccaattttattctattttgtcatcctacttgtttcatgataaaaggattatttccaatccttatccctttatttagaattatagcacagggatcataaaaatcaggagatggactttatagataaaaaagagctgacttaagccagctctttttatctatagcatactctttattgaactatttgcctatgctaaagcacccattggatcccatggagctagcataattggttcttcattgaacgcatttagttgctctttcgtcaacaaatcttttctgacaacgatttggtacgtatattcgtccatccaagcatcactcataacgaagaaaccgttctttccaactttttcgccccagctgttttcgactttccattttgttgattgtccgtccactaaatcaacgccagtcaataccatcgcatgggtcatcaaactttcaccaaaatccaaacgttcagctttagtcattgtgaaatccgtatcgaatagatcatccatcgaataagcatctaaggccatgatgccactggttctagtagaagattgtcctacatcacaaccaaaccatacagattctccttgttcaagctgagcaatcgctaattttttgaaagtttccatatcaacattcaggtatttaacttctttcccgtcaacgacattccctagcatctctactgtataagaacgattgaatggtttgtcttttgttggtgcattgatcacactaatataatcatctaattttacaccgatgtatttatcataaaaaatttgtggcgtcagtcctcggtcaagatgatagttttgttcttcatcgcggtactcaaaatcgaattcttttggaggtgttcctaatgagatggctaagaagttataaatactttctagcatttcttcttttttttcttcaatagcgtctaatgtttctccttgagcaaccatttcgcgtaacacaactgcatctttacgcagtagtttgttcaagtagttattcaaatctcgagaatttgaactattcgcactttccggcattaccgatttaggcacaacaccgtatttttggaataatgaaacgatcatatcccattgaccgccatcttgttgaggagtagttagcaagaaagccacttttcggctatcaatagcctcttttccagttgcaataatgttttcatagaagtaatttgccttttcatatttatcccagaaaaaagtgtaattttgtgataattcaaactcttttaaatggaattgattcagcattttgtggcggaacgtattcaatgcagcaaacatccagcaacgtcccgattgcatttgattagccactttgcctgtagctaaatcaatagaaaatactggtgtattcgccacatgtgctgaaatattttcagcagaagcagtaatcccgttcttcacgacagcccgctgcaacgcctgctgtttgttatttgcttgaaactgtttgtcaaattttgttgtcatatccggtgtaatagctttcatccaatcatccttccaaatccaagttacacttcgtattttactcttaagaatttagaaatacaatctcttctatgatgaaattttcatttgaatgagaatatacttacaacttcatgaagaaaaatgtcatacggtatacaataattttcaaataaaaaagaatattcctatgagataacgaaaatggactgtataataaagaaaaggtctagaagaacatcatacaataagatagctttcaaaatactcattgaaagaaggaaatactataacgtaagaaaggagaatgaataaaatgaaaaacctgattgctggcggctttttgtttgtgggtggtggcatacttatgaatacagataactttgggaatgtcattccttttcttggtgcagtttgtgctttgattggtgtaggaatgctgatttatttcgtatttagcgatgatgggaagtatggttgattatgagtagccaactctactctttcgtaaagattacaacatacgtgacaaaaacagaaagattgattcatcataataataaaagaaaaagaaacccaagtgattggatttctttttctttgcataagctttatttactccggcagtaggactcgaacctacgacatcatgattaacagtcatgcgctactaccaactgagctatgccggaatcaagtacatgaatataatatcaatttctttcaaataacgcaatactttttttaaaattttttactatattctcgaagaaaccgttagcattttttgttatttttacttttttctaagaattgtttcattagtacaaaaacacatttttttgataaaaaatatattgacaaatacattaatattcgttatcctattatttgtattaatgataatgccgctttagctcagctggtagagcgcttccatggtaaggaagaggtcgccggttcaagcccggcaagtggcttccttaaacagtgcaacatgttggtttaaccatgtgtctgcgctgttttttattttatgccacgaaaatcccacaaaactgtttttattttaaacaaaaaaagaatttttcagttagtctgcgaataaaaaaattcatccaatcgattgctcgactcttattgtcgcgtaatatttaacggctctgcaacatcttcttgaaaaacccctctcttctttctatgaatactttaatttcactgctaattccataatcattacctcttgtttagtttacaactagttgaccattagaaatcatccgtttattattatgggttaaagttctagaaataatattccctctaggtactgaaatacttaaatccgaggtagatataatatgctgtctgccatttacacgaacgtcataggaaacgggccaatttccagaagaagctttagagaaacgataagttctagcaccaactctacccagacgctcaatttcttcaactattaaatgtatttcctctcctcctcattaatataggtcagctccttcatgtccatactatctgataatacgagctcaagtacagttgagcttattttttcctgagcttttacttcttctttggatccaattccttctaaatatttttgttaataaaagtcatgtactcccaaaatcaactgctagttaccttaacgaagccaatgatttacattgatgtaacctggtgagttcttatcaagaaaggcatgttctgagataattacgttagtaacaatataaattttttataggagggaacataatgattaaaaaattagttctatgtacaattgtattgggaagctttgggttaagtatcacggcaaatgcgactactgaatatggtggtactgatcaagcaactctgagattgatcgaaaaagctgaaagattaagtcaaagttcggatgaagatatcttgatagttggcaattatgaagtgtcattaggaggaatacgtccttgttgccttattaggaaacaagcaaattgaactaaatggtctttctaacttccctattcggttatcgaaagattctaaaaccaataaaattactccacaaaatggaaagatttctttcaaagcgccaagtgatccgggaagttatgagtttgttgtgtatcaatttggtttggaaaaggaaatgttaggtcttccgatggttgataattctttcaggatgaccatcgtagtagagtgaaagtccatttattctccaaattaatggaatcacattaaagtaagtgtccctgttgacaaccgatagcggagctacttgctttatggatgtttcagtgcccccgagtactctattgatttaactgatccacaatttgaatttcctgatcgcttattgcttattttccagaatgtttatttttactgcgtaccttttaaaatgtttaaaaaattaggtttgtctaaaaagcaaagccttaccctacttcgtttacttaaaacattagattgcaaaaaacagcttcatacatcacgacttcctaaattgattttatgcggtacaaaagattatgcaaataagcctggagcaaaacggttatataaagtttcaactaatagccgtctcctgtttatcgaaaacggaaaacatgaattgaatagagaaaagccagaaataatagcacaagctatgtgatcatttatcgaaaatagctaatcaataaaaaagacgacaaaatgtgtcgtcttttttatttaccaagttaagaatgttgtcatgtttttcaatgtagctcgattgagactagttttatggatcatggatcaatgaagagaaaattattgtttcatgccagagaatttttctggtcgtaaatcgactaattgtacatggctgtctaaagaaccacttggactttcaagagtaaatacacctagacgtggatctaaagaaagggtcatgtgttcatccatgtacatttttgaataatctttgatataaacttccccaatatcactatctaattgtagtttataatcattttttccttgttctttatcaagaagaagtaaacggaaactagtatctaaagagcacacacccattttagaatattcgcccacgccatcatctaaatctaaaataactgtcgcgccttcatcaatatatttttgtaatctttcttgtgcttgatctgtaattttaagatacatattcaaacgccctctttcttttatttacaaaagcatgctagcatatattaataaaattatctaaagtcctgctcaaaacaaaaagatgtaagaaatatcttttgatatttcttacatctactttttcgccctttaaacgccgttacctcttctgtaaatgattttgttatattagacatggtttgtggagtatagtgatgaccgtacattttttcgatcaaatcagcaatttcaggcatcgtaacacctttttcgaataaatggataatagtggtttccaatgtatcgtttgttcttttgtaggctggtaaagtttgttgtttaaactcaccattacgatctctaggtatttccaatgttaattcaccatattcggttttgattgatcgaaagtaagaaccgtttctcgaattacctgaattaaaaccagtgcgatcatatttttcgtaatctaaaaaagccgttaattcagtccgtaggagtgtgtttatcgctttttctaagtgcgaacggaataattcatttaaatcgcctttagtgactagagtttgcacaatttctgtagtaaaatcattcatagggaagtcctcttttctgtgaattggttgtcgttaactttattctacagaagcgacttccttttttgtatggattttttcatttacacaaaatattttacactctcccgaaatttcgatatgcttcatgttattttgatttcacacttcaaaaacggaacaaatgtgcaatgatacattgtttatttacttgtgaactgctcatcacttagctaaacctgatgtttcttaacacttgaagcaaaagcttcttgggaaaagagcttacttgatagtgcatttatttcctaacagcaatgactcttatttaccaagctatccccgtagttcctacggttcttaaatgtatttttctaaattaacgctcgtattcgtagaccctcgttcagaatattgatgctagcgttaacgtctcaatcatgatgtgtatggcaaatagagcaaatccactctcgaattttgagtgatttcttgctgcctttatatccacattctgaacagatttgactggatggaaaaattgacctattttgataatttctcgtccataccagtctgctttatattgtaaattaaccataaagctagaccaagatacatcagaaatactttttttaacaatttataattacgcaacataccttgtgtgtttaagtcttctatacagataatatcgtggtttttgattatttctgtactcaacttattcagaaaatcagtacgttgattcattactttttcgtacaacttagctactttttgtttttgcttttgataattcttcgcttcaaatagattgattcctttctttttagctaacaacgcacgtcttgataacttacgttgttcacgttttagtttcttctccatcttagaagtttagcaaatttagatctttcatcgtcaatgacttatctacgatattcagttacaaacggtaactctcatcaatcaccaatagaaaaaatccacgttggtatcttcgtaaaagttactggaagcctcttgttatagatttagttgtttttgctatttgggtactgataggcgtggatacattggatgttgggcatacagagacaattactaaaacctttaacattgagccacttactgtctatagctcaccggaaaacatttatgcaaaaataggcaacactaaagatagctacgttaattttgcaattacaggtaaaggaacgtactctgctccgctaacaaaagctaatatccattatgttgaatcagaagggagaccaaaagtcacggttacttattacaaactagactctcctctctcagcatttataggaatacaaggggagattgcagatagtaaaactcgtatagacattcaagttcctataggcggagtcgatgttacaaatacaggtagcacctttgaagagcaatcagtaaacgacttactcaaacaattccctaagtagcgggctacaataaaaaaccctaagtagcaggctagagacatcttttataggtgtctctttttttgttgacatccctatacaatcaggctatgatatacatgtagataagggaagcaagaataaataaaaaatttgagcttacctattgacattaaacaatacaggctgtgcaatagacttgtaagataaaacaaaggaagaaattacaatggaaaaacaaaaacaagtgattacaagaaaacaatacgaggaaattatggcacgttatgacaaggtagactacgctgtcatcgcagggttcattatctttggtacagttatctttggtttcgggggatttgtttttatggctattgttggtgcgttcacgttcccccgtatgaaacaaaaaagcattaatttaatagaacaagactacattgttagagatgacatccaacagtaagcttaattgctgactatggaaattaaaggtgttactataatggtacaaggaggacaaagaaatggcagaagcaaaaaagagctatgctgacatgacagaggaggaagcacaatatgcaatggtactgggtgctagaatcgctcatgcacgagaagggttaggtattagtcaaggagaactaggtaagttagcaggtttcaatcaaacaactatctctttaattgagacaggtaaacggctacctaacttaaagactcttatcagattgagtaagattcttaaaaaaagtttgaaaattacattggaatgaggtagagaaaataaaacagggggagatttattatgacaacgaaagtaaaagaaacaaaatcaaaagtaaagaatggtgaacgtacaccataacttttacacccaataaattttgcggtttatttttctctgttgaaattctttgtgtagcctttaaactgacaattagctcattgggtacatactctatttgagagtcatctaattggctcataatcctttctttttggttagtatctgcagttacttgtttagtatgagccatgaacccaaacatactcaccccaacagccaatcctaaatatattttctttttaaactttttcatctacatctcctcctaatagttttattttagagttagctctattacttatttactaactcaacaacagattatcatacacttgttaatgaaatcacaatatctcattaaaacacaccctaaaatcataaccgttcctatgctcattttttggattttttaatcacgtaaccagaaaaataaatcccctctatttcacgcaaatcaaagaagaactaagtaactaccgtttaaaggtagttacttagttcttctttgattattatctaactttattattcattccccaccctttgcgcagtgagtcttcggtatcttgttttatctgactggtagttcttattatttctccacgatcatctaattctggaacaattggatatttttctctgaacaagtctagttctttcaccacgtcattaaacaaatcttgcttatcttcttgcgtaagattctgtttaatatactcatctaaagcttttctaagcaattcatctcttgtcatattagtctcatacttttctactaaaactctggaagtcgcatttaacaaagtcgacagttttaaaggatgcttggtggaataaaccttatcaaactttctgattggtgcgccaactttttttgttcttcctctactctgtcttttaacattggaggaagtttttatttcttgaacttggtgcacttctaattgcttattttcagatggtgtaattgcttgctgctttttctttgcttctgcttctttttttattttggcgagtcctttgttgttcccaaaaatatcaagtcctttgatgtcagccaattactccacctccgcataccaattctcgtgttcttccaattctttcaaaatactgataaataattcgtggcttttgcgatcccattgttttaagagacctttctttgtcttctccatcgtaatacctgatccgtcgtatcgttttaagcgcgcatttttgagtacaacatttttaatcaaatgttccccataaatctcttgggcttgtttatacatttcctgatctactgcgtcaccgctttccaacatgaaaggaataacaccagcaacatataaatttgtatcaaattctttcacaaaaaagtccatatactcaagatattgcatcgcatttctcatcgattttacttgggtctgtaagacgacgattgcccagtccgcaatgtacatcgcggatttactatatacagaaatagaaggtgggacatctaaatagatgacgtcaaactcatcaaataatggttctagcttttctttcatatatttgaattgggataatgaatcattatattggtctttgatccaatcatcatacatttcaaaggacatgtctgctggaagtatatagaggttattgattactttatagacagcctctttaggtggaagattgtttatcaacacgtcagtcacagtattttcgtaaacaatcggttcaccttctccgcctccttcttcgttagtgaagttcatatgcgttaaattcatcacatcagaagtatttccttgcatatccaagtcaattatcaaggttctttttccttcattaactgctgattcaaaccctaacatttgcgcgcacgtacttttacctacgccacctttaaaattaccgattacatatttcttcgctaccacgttcctacctcttttcttttagcaatattcatttgatactattataacatatttatttttagttactaccaaaaaaaagatatatatgtactaccttataattaataagtaaaaggtagtacataaataaggaaaagctgaaatatattgatttatagctttcctcaaagtaatgacgttatttaatttatcgagaagcagagaatactcgcgactttagtcatgtagacgaatcagatcttcgataaaaaagaagccgtccttcttaagaacgacaacaaatcactagattaattttttcaactgttcataaaagttttcatgcgttccacataacaatactggaataaccttgttttctataatctcgtaagctactctatatgttgtgcccgcatatttgaacccactagaccaaatacctgataaatccccagttttttgttcacccttatatggatcaatcgcaatttcatcataaattaaattcaaaaatttttctttcaatggcttctcttttagcttttttaaatacttaatgacatgttttgaaggaacgatttcataagccaatttctgttgccaactcctctttagtcattactttagaattagtaagtgtatcttcagcaatatctctaaaggaagaatgcattttgttttttctattcttaaattctacaagaatctcatctttatcgtagccttctgcaattatatcagacaaaatatcttcgctaaaatcataaaattctttttgtggttcaacaaattcataaagaataccattctctaccaactttgcttcaacttcgactccattaggaacattaaaatctttaggtactgtcaacatgattgaattgccttgttttcttgtttttgtaatcatttaaatccctcatttctaacagtatgtaattacttagtaaatacattataccacgagataatgtatttacaagtaattactgtgactcgtaatgcgtccttgctgaataaatttcaacggttctgttgcaaagttttaaataaagaataaaatccctggttctgttgcaaagttttaaatctactatcaaataaggtagaataatagaaaaagatagcagaaggaatgacgatgaatcagttcagggcgtatggcgacacaaaacgaaaaaatggtttcaatagatatgcttttgaaaaaagcactccatactcttgtcttttaaggaaaaacgattgcgattataggagtttttcttttccctgcttttgttattattctctcttttcatcagtaaatgaaagtcgctgataaaaaaaatcaggacatttactccttgtcccccttcacaaaacgaacacttgttcttataatggttctaaaggagtgattatccatgaaatatttgaatgacgaatatcaagaccggggtatgaaaaaatgggcgggctttttcttatctgaacacacagctgaacaggaaaaaattcaaaaaggattggctcacatcaattccccaaagccccaaatgtccgaacaagagattggcgaggtgcttcaagtggctagattaaaaaataagtccgttgccatccaaatcgaggccatcgataacgaaggaaattattacgattaatatgccactgatgacggtgatttgatttttctttcctaaaatacacctttgcatgattttttcctcctgtttgttgtttgtaatgtaagtctactggattgaatcagattaagaattgatcctcatcaagaagtggttttccttcgaaaatagtttttcactgcgcggtcttttttgttttactctttcgtataactctatgatagctcctttattgtttttaataattgatgacaaccaagtttgaataaacgatttttagcatgtatttaaaatagataaagctgataatttctgttcagaaattatcagcttttttgacgatttaggctttcgccaagggtaagcttcattccctacagatacaaatttaaaaagctgtagatattcgctcaccctttcagctaatatcatgatgcagtctaataagcaccacttaattccgcttttgttttttcggaccctaacaaccgcaagccgtttaagatgacgaggattgtggagccctcatggaatagtactgctaaaggaagtcccagaacgccgaacatatttaaagtaatcaagctgacaataacagcgatggagaaaatgacattttgaataatgattttatttaatttcttgcttagctgatagctataaaacaatttagacaaatcattcttcactacaacgacatcagaggattccattgcgactgacgagccacttcccatcgcaattccgatatctgcattcgctagcgcgggcgcatcattgatcccatcgccaatcatcccaacaacttcttcttttccttggctttttaagacaaaatctattttatcttccggtaacatggaagaaatatagtcatctacctttacttcctttgcaacctgtgccgcaaccttttcgttatctcccgttaaaagataaaccttgatgccctctttttggaaatccgcaaccgtactcgctgactgcggacgaattcgatcccggagtgagaagtaaccgacgacttcatttcccttcgctacaaatatggtcgtatcgcctttttccagtagcttttcaaactgatcaaatttatcatattgcttaaatgcatccggttttccaactaggattgccccttttttaattcccgaaccagcaatttcttcaatcgattccgcttgattcacttgtgctaagttaatctctttaaaggcagaaacaattgctcttccgattgggtgactggattgttgctccatataaatgacttcttttaacagctcttggtccaaatgataatcgaccacttggaagtcgccatacgtcaatgttccggtcttatctgtatacaaaatattcattgtacttaacgcttccattgcggctccacctttaaataagataccgtttttggctccattacttatcgcgcttaacgtagccggtgtagctgatgccatcaatgcacatggactagccactgttaaaagtaccattccacgataaaatgcttcttctaatggtaggcttaggaaataatatagaaagaagatgaaaataggtatgataattaaaacgccaatcacgtacttactttcaatacggtctataaactttgcgattcgagaaggtttgttttgtgcttcttcaaccatccggataatattggaaaacatggtttgattcagtgtcttgtttacttctatatgaaaaacatttccttcattaatcgttccggcaaaaacttcctcctttaactctttttctactgggacagactcacccgttaaagccgcttcattcacgattgcatttcggtcgatcaagccatcaatagggatttgaccacctttcgataccacgacaatgtccccaataactaactctttcgtaggggtaaccactacatccccattttcttttagcacttgggctgtgtcgggtacttgcgccattaattctgaaatcgcgctggtggatttgttcgttgcataatcttccaaaacttctgcagcagcaaaaatcaatagcaacgccgctccttcagactcaaaatcaatgattactgcaccaactgctgccaaaaccattaataggtcgacatttggtgagcgatctttaatcgtttcaacaacagcatgttttgccgcatagaagcctaaaaagaaaattgaaatataaaatagtatggaactgtatgcatcatttagtgggataaagataaaccctaagattgtaaataaaacaccgacaactaaaaattgtccttgcctactttttgttagatactcaaccatttctaaaacctctttcttattttttgtttttttgcttaccaattattacaaatccatttcatctcatcttttcactcccctttatttagaaatatatatataaaagggcacacctatagaacagaattaactgtcccacaggtatgcccttattatttacatactctgctgccgcaaaaattgcagcccggctgcatggaccttttatatgtccaccgcctgttcagatcacaatgaatataaccaacaaacaaaatctgttatattccaaagctttcattatttagttttaatatgcttcattgattctcatgtgactattataacaaattttttttgaatttcaaatcgcttttccattatttgaacagggtagaatagcaatcgcagccataagctttgtggcggatcgaagtctaggaaatgtatgcttccttagttagttcataaagttttatttccacttttttaaataatttttgatattcttctcccattttttggtaaatttctaataattgcatcaattctttttttttaataaatcacccatgtgttcactcctgttctccctctgttgttttgaatattcataatactttaaagggttctgttgcaaagttttctgataaactgattttaaggtaaaatgaatggaaaagatagcttggaggaatcaagatagatcattttaaaggcaagcaatttcagcaggatgtgatgattgtagccgtgggctactatcttcgttataaccttagctatcgtgaagttcgagaaatcttatatgatcgtggcattaacgtttctcatacgacgatttatcgttgggtgtaagaatatggcaaactactctatcaaatttggaaaaagaaaaagaaaaaatccttttacttcttacgaaaaattgatccgttagcacgaaaaaaagaggacagatcacttgcgtgacgtgttctcttttttcgtcaagcgtgttagttaaaattcgctttgctcatgttgtagattatttatttttttgattaactttcttttggcaatctttgcatataccattcctatgatctgctttagttgagttctcatagaactcatttaatcttttttcaattgaacacatagaacatttttttgttaaggatttacccatttgaccaacctccttattttttcaagtatatttttttattgttagatgtttttcctatcatttctacaatcgaattattcttcgcataatcactaaataatctccctaataaaattcgatcagatttactagcctccttccattctaggcccgtatataaatcaggtaaagtaaattgagtttgtggaggaagttttttaactctttgaattgtatcggctatcaaaagattaataatagtaacctcccttcgttaatttataatctattatgcataaaaatattgacaaaagcaaactttatggataataatatgcatatataaattttttttttcataaaggggaatttaaatggaattaacgagcacagaacataaaattattcatacagcatcaggagcagcagcagcaacagtagcaagtcccataccattttctgacgcagcattattaattccgattcaaacaacaatgattacaggtttatataaagctaatggggctaatatttctcgaggggttgttgatggagctttaaaagcaactatgatctcaagtttaggtaagtcattagcaggaaatcttctaaaacttattcctggggtaggcacatttgtcggtggaactttaaatgctggagtgtcagtagcttttacagaagcattggggtttgcagttgttagcgaattaagaggggcagataatgcggacattattgatctagctaacgtaattaaagatgtctttaaaggattcacaaaaaaataatattattttgggttctgttgcaaagttttaaataacgcgaattgtaaaactaagttagaaaaataaaaaggcatttatggtacactcaaattgtatttccgacgaaagaaaacaaaggagtgtaaccataaatgacctacaaacatcttaccatagacgaactgacaatgatagaatcatattatcttcaacataataagccggttgaaatcgctaaccgaatgggacgtgctatacaaactatttataatgtagtcaataagttcaagcaaggtaagactgctcttgattattggcaccagtataaagaaaataagaaaaaatgtggtagaaaagtcattcaattacctgctcatgaagtagattacattaaagagaaagtcactcttggttggacgcctgacgtcattatcgggcgaaaagaaaggcctgtttcatgcggtatgagaacactttatcgtttattttctaaaggaatatttgatattgacacactaccgatgaaaggtaaaagaaaacccaatggccatcaggaaaaacggggaaaacaacagtatcagcgctcaatccatgatcgacctgataattatcctgatttcaattctgagtttggtcaccttgaaggtgatacgatcgttggcattcatcataaaagtgccgtcattactttagttgaaagattatctaaagtcattatcacgattaaacccaacggccgtaaggcattagatattgaaactgcccttaatcaatggttttctcgcttccctaaaaacttctttaaatctattacgtttgactgtggaaaagaattttctaactggaaagccattagtaaccaacatgatattgatatatattttgcggaccctggaacaccttctcaacgcccattaaacgaaaattctaacgggattctgccaagcatgattaatcttgaaatcccatcaaatgtttgagtcatttctgcagttatcttagcgacttctttataagaagagatatcttgatttaatttttctatatattttttaggataatccattaaataataccacctttaccattaacaaacacaacatattgtgcctgccaatgattatagccctatataaagtgtaattcaatcttgtaattaatttttattctgatacaatgagaactattatcaattaaaacaagggagttttcctagtgttaccaacctctaattcacgctttccaatcagaaggattaccaccctcgctttatttagtgccgcctgtattgttggtagaatcctttttacttggataccgaatgtacaaccaatgacagccattctacttttactcgctttttatggaagttatacagatgctttaatcgttactttagtaagcttattaggcacgaacctttatttaggaatgggtttggacaatcagccaactgatcgccttcagtagtatcgttacggtttttcattttttatctaactgtgccctgattaagcatcacatctctatccaagcaatcattgcatttttatgtggccttctttacggattgatcgtatcgagagttgaagtctttatatatcaactaccttctttttgggcctattattttcaaggattattttttgatatcctccatggaacgggtaatttaatcttttatcttgtattagtttctgtgtttaaacgaattttattacctgctattaatagttcgaaaaataaattaaatagttagatgagtatctaaatcacaatatctcttattaaattaaacctataattcaaataggaagccttgcgtattatttaagatggttctgttgcaaagttaaaaaattaataaagagtttccaattaatttttgattttatgcttagatactcattaatgtattcatctcatgaatcactgaaaagccaaagagacttttgtctctttggctaattttatataaagcgtgtatagtttcaattcctttaattgttgaggaatcagtccttatggactgatataatttgtgccttttcttgatggatcgatgatcctgttcaatgatattattcaagtatttatttgttcggtgttcagtcttagaaaataatccttcagaatgcaattgattaaacgcactacttagtgaaggggctttatcagtgacaagaactttaggttctccaaattgtttgaccaatcgtttaaagaaagcataagctgcttgtttatcacgcttttttcgtaaccaaatatctaatgttatccccgaagaatcaatggatcgatacaaatagtgccactttccttttaccttaatataagtttcatcggttctgttgcaaagttttaaataaagaataaaatcccttacggtatctatgatttaagctggaattcccaataataccttgatttcagtacagaccgaaaacccgaagagagtgccttcttttcgggttttcttatataatcctcgaatggctttgcgtggcgacgtcctactctcacaaggggcaacccctcactacaatcggcgctaagaagcttaacttctgtgttcggcatggttacaggtgtatccttctcgctatcgccaccacactgtggtgttatcttttattgagtaaattttgttcactcaaaactggatttgaagtcatataagttttttgccgagttcttttctttttaacctattggttaagtcctcgatcgattagtatcagtccgctccatacatcactgtacttccactcctgacctatctacctgatcatctctcagggatcttactttcttaaagaaatgggaaatctcatcttgaggtgggcttcacacttagatgctttcagcgtttatcccttccctacatagctacccagcaatgcccttggcagaacaactggtacaccagcggtaagtccatcccggtcctctcgtactaaggacagctcctctcaaatttccaacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtggactcttgggggagataagcctgttatccccagggtagcttttatccgttgagcgatggcccttccatgcggaaccaccggatcactaagcccgactttcgtccctgctcgacttgttggtctcgcagtcaagctcccttctgcctttacactcttcgaatgatttccaaccattctgagggaacctttgggcgcctccgttaccttttaggaggcgaccgccccagtcaaactgcccatctgacactgtctcccaccacgattagtggtgcgggttagagtggccataacgcaggggtagtatcccaccagcgcctccatcgaaactagcgttccgatttctacggctcctacctatcctgtacatgcggtacagacactcaatatcaaactacagtaaagctccatggggtctttccgtcctgtcgcgggtaacctgcatcttcacaggtactaaaatttcaccgagtctctcgttgagacagtgcccaaatcgttacgcctttcgtgcgggtcggaacttacccgacaaggaatttcgctaccttaggaccgttatagttacggccgccgtttactggggcttcaattcgtacctttgcttgcgctaagcactcctcttaaccttccagcaccgggcaggcgtcagcccctatacttcatcttacgattttgcagagacctgtgtttttgataaacagtcgcttgggcctattcactgcggctgatcgtatgatcagcaccccttctcccgaagttacggggtcattttgccgagttccttaacgagagttctctcgctcaccttaggattctctcctcgactacctgtgtcggtttgcggtacgggccgctgttttctcactagaagcttttctcggcagtgtgacatcaggaacttcggtactattatttccctccccatcacagcttgtccttaagaaaagaagcatttgactcctcttcagacttactgcttggacagacatttccgatcgtctgcattccttagcctcctgcgtccctccattgctcaaacaaaaacaacgggtacaggaatatcaacctgttatccatcgcctacgcctatcggcctcggcttaggtcccgactaaccctgggcggacgagccttccccaggaaaccttagtcattcggtggacaggattctcacctgtctttcgctactcataccggcattctcacttctaagcgctccagcagtcctcacgatctgccttcgacgcccttagaacgctctcctaccaatacacctaaaggtgtactccacagcttcggtaatatgtttagccccggtacattttcggcgcagggtcactcgactagtgagctattacgcactctttaaatggtggctgcttctaagccaacatcctagttgtctgtgcaaccccacatccttttccacttaacatatattttgggaccttagctggtggtctgggctgtttccctttcgactatggatcttatcactcacagtctgactcccggatatgaatgaatggcattcggagtttatctgaattcggtaacccgagatgggcccctagtccaaacagtgctctacctccatcattctcaattccgaggctagccctaaagctatttcggagagaaccagctatctccaagttcgtttggaatttctccgctacccacacctcatccccgcacttttcaacgtacgtgggttcggtcctccagtgcgttttaccgcaccttcaacctggacatgggtagatcacatggtttcgggtctacgactacatactcaaacgccctattcagactcgctttcgctgcggctccgtctcttcaacttaacctcgcatgcaatcgtaactcgccggttcattctacaaaaggcacgccatcacccattaacgggctttgacttgttgtaggcacacggtttcaggttctatttcactccccttccggggtgcttttcacctttccctcacggtactggttcactatcggtcactagggagtatttagccttgggagatggtcctcccggattccgacggaatttctcgtgttccgccgtactcaggatcctcctaggtgtcttccacatttcgtctacggggtttttaccctctttgactgacttttccaagtcattcgactatctgaaagaacgaccatattggagtcctacaaccccaacaagcaagcttgttggtttgggcttttcccgtttcgctcgccgctactcagggaatcgaattttctttctcttcctgcaggtacttagatgtttcagttctctgcgtctacctcgaatgtgctatgtattcacacaatcgtaacatcctattaaagatgctgggttcccccattcggaaatctctggatcatagcttacgtacagctccccaaagcatatcggtgttagtcccgtccttcatcggctcctagtgccaaggcatccaccgtgcgcccttattcacttaaccttatcaacctttcggttgggttttgatccttcttctagcgatagaagttagatcaagaaaataagcaattgaacttattaaaaaactcagacaatcaaccaaactctaacagaatttgaagtatatcaagaatattgggaaccactaaaaaaagtgacttcaacttatgcatcctttgataaagacaatctctactatgatttcccctcagtatcaggatttagttcaatgaacaataaaaaatatttactaatgttaacgagattagggtactcaacaagtaacgtccgtgctaaacggaatggtggtacagttattacggatattttgctaagcaaccaataccaagtaattcctaatcaagaaatccagcatcaagcgactagcggtgtaaagattatagaaagcgaagtgagttaaacctcagatattgcttctttttcatttgacgttctagaagtaacaaaagatgagttactttatgtttattttcccgtcaacttggccaataatttgcactatgtgaccaatttggaaagtcgacaatttgatccctgctggcatcaaattgatgctcaaacgaaagaattgttgctaggttgggaagaaaatcaagtagttcgtgatttctcattaaattttattatgattgattactataatttggcgacatcaatgcaacggttcccgaattatggtatggacatagattcattcaaacagaaaagcttttctggagaaattcaaaatgaggaaagcaataatcttgttatacctattctctatgaaccaggttaggtttttactgtggacggggaagagtatccttacaaagtagcttttgacgatttgattcaattgtctaacttaccaaaagatagtaatatgaaaattgctggagaatttttcgcaccaggattcttggtaggcttggtaatctctagtattgcaactgggtgctttttatttttactttttctggattatatcaagaaaactgaggatattccttaggaaaatcacaatctaaatcttccctagaaactatagaatgacaagggggatataagcaaattcctaaatgattaaatagggtgcgttactagttagctccatagtaagattttttcaaaattttcttgaggttggatcaaaaagggctcttttcaattagattaaagacactcatacaaaatagagaaacgaacttataatcgcgttcgtttccctatttaatttattatgaccataaaccaatttgaatttagaaagcaccttctttctttaataaaaagtactactcgtaatctgtcaggattgataagactttttatattagctaaataaagaatggatatattgattagcattcttaaattcaactgtatcgatcagtgtaccttgtacaatcaatctcgttacagcagccaaatctccgcatgtaacaagagtgatcatatttttattaggaatatcatcaatgacttcgactcttgatggatccactttttctttaaaggacacttggtaaatataaatattctttaagtctgttacatatattttttcttttagagaaataaactctaatggggaaaataaaatagttttatctttagcactatgacttgctaaagcgtaatttcgttttcccatctgctgatctggtttcattgttccagccccagaaaggagcgaggtgttgtccaatccgttgtatattggtaaagataattttacattgtgtatagcgataccacctattataggcaaatcattattcttgaattgtgcttttaatactaactcatttgatatagattcaacagaatcaaaatcaaagtttcctttccttttcagattgtcttccaaatctttctgtgaataatttgctatgtcatattgtggacttgtttattcagtaagtaagatcgaatttggaaattaaatattaaaactaagcctataagaaaaaggctaattagaagtaaatttaaagaaagatgcttgatttttttcatcatttttagattcctagaaatggagcaggatctacgaatccagaccaatttgagctagtcgctattccaaaatgcaaatgaactccggttgaatttcctgtagttcccatggtaccgatggtctgtccagcactcactgattggcctggtgtagcaatataattacttaggtgaaggtaatatgaatagtaaccatctccgtgatcaataataatgtaattacctgcggatccatcaaatgacgcctgcactacagttcctgatcttgatgccatgataggcgttgaagaagttccacccatatctataccatcgtgaaaagatccagaaaatccagtaggatcagctcttcccccaaatggacttgtgacgataatgttggctacgggtgcgccccaaccagaagaactaggactttgaatctgagtattatcggaagaactattgttgtcttggtactcattttgattaactgagttcgaatcttgctccgaagtttcatctggtatctgttcttctttctgtgtatcagtattttcttgacctattcctatgtcattggtatcggctagttgtgatacatctttttcctgatcttttataatagatgcggcttctgcctcttgagctgcactatataaaaaatttcatcatagtttcgccctagtcgttccaaagattcgatgacaaaaatatccttcttccttaaaaaatgaagttctttttgcaattattctcgtgaggtcttcttttaactacataaaattgtaaccactggttttaagagtagtgtatcatcccaaatcatataattaattgactgcgattgttataaaactcacggtaagccatataactagcaataaacgaagaaatcgcagtaactgaaatcaacataaacatcacaacaatttggtaacgaatcgcttgaacaggatcaattcccgcaaaaaccaaccctgacatcatacctggtaggctgacaagtccaaccgtttttgtttggtcaattgaaggagccatgcccgttttgacgctttctcttacaatactcatggacgcttgttttttattggctcccaatgccaatttttccaatacctgttggcgttggtccgtaaattttgaattcaaagaccgataggtcactccaatcgcagtcatggcgttgctggcaatcatgcctgtaattggaacgatttgggaaggggaccagtcaatgactcctgaaaaaacaagaatgagtaaggacaaggctgttcctactccaatagccgtcgttgaaattttaaaagagcggttgatcccctcactgcgtgtatgggcgttataagaagcgttgaacacaatgaacaaaaccatcgctaaagtgagaaagttgttatccactcgtaatacgtagctcaatacatatccaataaggaataattgaacgacagcgcgaattcccgcaataaaaatgtcgtttcctaatcccaatttttctttgtaatcaatcaacaaggcaactatcaagaggacagaggataaaagcaaagaaagattactgatttctaaattgtttgtcatttcgattcctccatttttccacctttgatagtaatcagacgagaagcttggtcgatttcttcctggttgtgagtgacggccaacaccgtagtttgttggtctttcatcatgtctcggactaaatcaaggacaatcgctctgttttcttggtccaatgaactggtaacttcatccaggagcaacactttcggttgatacatcaaatttcggaccaatgcaacccgttgtttttcccctcctgatagttccttgacctctttcgataagtaagtttcaggtatttgaactcgttctaacaatttttttgcacgttcccgatcaaatccttcttctcttatgcgggcaggaaaagacaagttctcttgaactgtctcatcgaatagagaagcgttttgaaagaaataagagacttcttttctatactccacaggatcgattttttgcagatccatacctcgataataaatttttccggaagttggggaaagcagcgtaccaattaatttcaaaagggtactttttccacttccagaaggaccagaaaaaacaatcacttcccctttgtttactgtaaaagagatatcttgaaggatttggtttccgtttgcctgaaaaccaaccttctctaattgaaacaatgaatcactcataccacttctctcctttataaaaaagccctgcaccagtggaccatccatacgggtgcagggcttttgtttcatcctagtgtacctcagtgttcgtttggatcgtttttggcgtcttcatgagtagggtgaaccgttccttcaaggtgatctggaccagcataaatggtatacagtctgagcggcttatcaccggtgttttcgatgttgtgccacatgtccgccggaacaaatacggcgtcatcatccatcactttttgttgaacatgtaagttatctttagaaggccccattttacacacgccttctccttcttcaatacggataaattggtcaatgccttcgtgcacttccaaaccgatgtcatcgcccggttgaatggacattacggtgacttgcagtttactgcctgtccaaatggtcgtccggtaattatcatttcctgtggtggcgtcttcaatattaatgatatacggcttcttcccatgatccttgtagtctatttccatcttccattcctcctagtctttgtactgaaacaatgatacctacttcttatttataataattctaattaatggtaccacatctaaaaattctatgcaaaaaattggctttttggagagcgattctaaacaaagaccatataacgcgcaattacaattggtaccccttaatcctcagcacataaaggaaaaaatatggaatcaaaaaataaccgatatgtactctggttatgacttgaatcagggagaatttcagagacgacacatcatacttttttagtttacacttgtaaactaactagcgtacattaagtttatgctcactatcaagcgttgtcaatcctttagactcttatcttgaaagtagaatttgtctatcaatacacatttgaaaccttacaacaatcggaatagcatacggaaagaagttctgcaccttataaaatttgtcaaaaaaactgttgccattccaaatagggaaatataattatctaataggtactttttcagaataactatagaattgagatttatctgtaaaattagctttatatttactgttaattccagcctttttagatatatctcccaattctattaataacttttcatcatttcctaaaaaatgaattttattgtcaaatccaacaatatagatataattcaccaatttgtttattaatatttctggatatttttcgctatctatttttttatagacttgcaacaaaacatctgtaatatctaatatagctttggtcttatcacgcttcattaaactattatacaattcatgaattattttttttgtttccctaatatcaatcatttaaatccttcctccactaaaactaccaaacaaattatctccccaacgtttaaccccttttgaccaagcttgtccccaatttacccaacatttttgcttattacaatacacaccatttccgtaatacgtggcagcttctacatttgttcctattactataaaaccaatcccaatcatgctacaaataactgagcctttaactaatttctttttcattaatattcacctcgaaaataaaaattagaaaacgtcttctatgtagaaattatatagcgccgattgtaaaattaagctagacaactaaaaaagtcatttgtgctacactcaaaatagttccgtccaaagaattataaggagtgagtacaaatgacctatacccatcttacaacggatgaacttgtaatgatagagtcttatttcaaaataaatcaatctgttgcgaaaactgcgcattgcttgaatcgttcaagacaaacgatccataaagtatacctgttcttcaagcaaggaaaatcagccttagagtactatcaacagtataagaaaaacaaatcaaactgtggtggacgcccgcttgttttacctgaggaacaatcagaatatattcaaagaaaggttgttcaaggatggacacccgatgtgattgttggtcgtgcagcgtttcctattcgttgttctgctcgtaccatttatcgtatgttcaaaaaggggctatttaatccttctgacttaccgatgaaaggcaagcgtaaaccaaatggacatcaagaaagacgtggaaaacaagctttccgtcgctctattcatgaacgtgaaaaagattatagccaattctcaaatgagtttggtcaccttgaaggtgacactatcgtaggtttgaaacataaaagtgctgtaattaccttagttgagcgattatcaaaagttatcatcacattgaaaccgtgtggtagacaagcgattgatattgaaaacaaattaaatcattggtttgaatctgtaccgaaaaatctattcaaatccatcacttttgattgtggaaaggaattttcaaattggaaacagatcagtaatgccaatgatattgccatttatttcgctgatccaggaacgccgtctcaaagaggcctaaacgagaattctaacggattgttacgtagagatggtttattgaaatctatggatttcaattcagtagatgaatcttttattcaatctgtcgcatcgaaacgaaataatattcctagaaaatcactgaattatcgaacacctttggaagtatttttgagttacgtaagtattgatgatttgtctaacttaatttgacaattaagatagctattggtatagctttgtaaacgttaaaaaaaagaatttctctaacacttttgtaagttggtatccatcaattccaattatttttaacctgattattgtaccatttcattcaaaacaaatattgccatcaataccttctttttataaaatagccttgatgtatatataaaaattttcaaatcaacaaggagaaatgaaacggatgcttatcaagccggtgtggattttattggtaaaactagacctttgaaaactgaacaaagtaagacaaaccaaatgtgtagggcgtcttgattcaattcaagacaacaaacatttttaacaagcaagcaatatgctagcaaacaaattgagcttaacaatcgtaagattgttcgaactttttatgagagtttgatcctggctcaggacgaacgctggcggcgtgcctaatacatgcaagtcgtacgcttctttttccaccggagcttgctccaccggaaaaagaagagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaatattacggagactacacaatttgtttttactttgttcagttttgagaggtttactctcaataacttttatatataaggaaagggatcagtaaaattactgatccctaaggtaattatttataaagttttttgacgtgaatttatttaggatttaaactaatttaatttcttttttaaagaagtttgcaatttttagaagtgtttcaaggttaggatttgttttacctttttcaatctttgatatttgtgcttgtgttaaaccagttttatcagctaaatctttttgtgttaaatttgattcttctcttaattttgttaattgtgctattatttttactctctgaacaacttcttgatcaatattatatttatctgcaaaaggtgttagtttactaaaattaattttttctgtcatatacaactccctcctttaatttatttacctttattaatattaataaaggctctcctttgaaaatcttcctttttaaaagtttatatcgaaacctctattaaccgataaaaaattatcgacctgtaacttttttccactcttctaactgtttgcaaaaatctttataccgtgcttcagctacatcgtaatgtctgttctctattttttgaccttgtttctttagaaaaactaaacaaacgatataatcctgctcaattttataaagtacacgataatgtttcgtactgattccaaaaaactgtcgttctggcttagcagagtaataagatcccgaagcctcaagctgtaataattgatttgataacttcttaaactctctactgttctttctctcaagtctttttaaatccttgtcaataaaatctgtcactaattttttcataaataaatacctttgattttcaaaggagaattacgatagcttacaaaaaataatatacactattatatatattatgtcaagatatatattaaatgatttctttaaaataatcttctaacttagcatgtactatagaattaatacgttcaggcatgttattagtattacacttaacaaaatcactataacttttaaaactatcaatataacctaaaaagtaaattaaaataataaaatcatcaacatatataccagtaaaagatttataatatacctcattaagttgggaaagcagtttaaataactttttgtataaaacaaattgatcttcacttaaatcaaaccatcgcgtatttaataattttttagtaacaaattcatctggagtttgataatccaaatcttttcttattgatttcaatattttagtaattatacccgaaatcatatcactcattctaatacctacagattcatctgataacaattcttttgcagaagtaaacccactgttttcagcagcatttaaagtcaattcattgccttctttatcaataaataactcaactttatctttctttatcgatagttcatttaaatacttcataaatcctgggagcgtcaataattttgtgtaaatggttcctccctactgtagattgtttctaattctcaatcagttggcttagcatttgttcaagttcgccttcggcctgttgaaagggtgtgtagactagaagaaaacataccaggaggaatttttatgtctaagagaacacgaagaactttttcacaagaattcaagcaacaaatcgtcaatctttacttagctggaaagccacgtgtagaaatcattcgagaatatgaactaacggcttcagcatttgacaaatgggtaaagcaatctaaaacgagtggttcattcaaagaaaaagataatcttacgcctgaacaaaaagaattgttagaactacgtaaaagaaaccagcaattagaaatggaaaatgatattttaaagcaagcagcgctgatattcggacgaagagacaagtaatcgatgcgaataagcatctttaccctatatcagcgatgtgcagaatattaggtctatcacgtcagtcctattattatcaatcaaaaccaaagaaagacgaatcagaacttgaagaagtagtcgctgaagaatttatccgcagccgaaaggcctacggctcaagaaaaataaaaaaagccttatcaaaacgaggcattcagatcagccgacgaaaaattagtagaatcatgaaaaatagaggattaaaatcgagctatactgttgcttattttaaagtacatcattctacttgcaatgaagccaaaacgacaaacgtattgaatcgtaaattcttaagagacaacccattagaagcgatcgtaacagacttgacttatgtacgagtcgggaaaaaatggaattatgtctgtttcattttggatctgttcaatcgagaaattctcggctattcttgtggagaacataaagatgccgttctagtaaaaaaagcatttagccgtatcaaacaacctctgacagaggttgagatttttcatactgatcgtggaaaagagtttgataaccaagctattgatgaattattaacaacttttgacatcaatcgatcattgagtcataaaggctgtccttttgataatgccgtagctgaatcaacttataagtcgctcccaagaaatgaggactacatatgcgttcatcaaaatatactgaacattatacagatacttttataacattcaaggaaattatgagaactgtttctaacatataccacaattgtgaaccagataagattaaaaaccgaagaaatactgatcaactgaagcaacgcgatacagtgattattgcttgtgttatatggggcataattaatggctatactagccaaagagccacgtatagagcggtttgttccgtcttatttccgaatggtgactttcctagtaggagtcgattcactcgcttaagttcaaacttagcttacactatcaagattattcgatactttttcatcaagaagctcaccaaaggtgaactagtcggaattatagatagttttcctagtccattatgtaaaccagttagaaatagacaagcaaaactattgaatcaaatagccaaagttggctataactcaacaaaaaaatcttatttttatggtcttaaaattcatatgatcgttactaagactggctttccgattacttactcaatcacgaatccaggtgtccatgacgtgaaagtgttagagactttatcggaagaagcgaatcttcccaatatcctaggggacaaaggatatattagccataaaatccatgaaaagcttgcccttaagggcattactatatccgttccgccacgtaaaaacatggataaatcagaaaaactagaccacagcttacttggaaaacaaagaaaaacagttgagactgttttttcttccttagaaaaattaggttgtcaaaatttcaactcacgttctgttaaagggctagagagtagatttgaaagcatattactggcttacagtgttctattaagtcgagcacaacgacgttttgaaggaactttgagatattctttaggatattaaaattaactagcaccacgggtcctctattttctatttttagattatagtgaagagtgaaagaaagttcgaacaaagccttgaggactacgagtccctatcaaaaaccgaacttctttactgtcattttagaatcaggtttacgtatgttggggccatgagcccgtgtataggaaattggaatcgaaatgaagcagtaaagttctttcaaaacttaaaaaggaggaaaacaaatgccttacattcttgcattagatgtttcaatgggacacagctacagtgtcctatacaaagacgacacctgcttatttgaagacgagatcgaacacactcaaagaggatttcatgcattactcgaagagatccagcacttgcctgaacgtccattgattgtttttgaagcaacggggatttattccagaccagtcgaaaagttctttcaagatcatcacttttcttactgtttgttaaacccgttagaagcgaaaaaacagatggaagaaagcaccttacgcagttggaaaacagataaatcggatgcccaccggctcgcacagactcatcttaaaaatcaacgtcagccaaaagaagtacaaagcaatttttacttagagatgcgcgatttagcccgtttttatcaagaaattgagaagaaaatcactcgtctgcgcatggatttacacaactgccttcagttgacttttccagagcttgaacagttcttttcaaacaggctgaccccttacgcattgacattgatccgtctttttccccatccagattttgtattggcatctactcggacaaaaataaaaaataaactgatcaacgaaacacggaaaaaaatctccgcgaatcgtgccgagcaaaaggcagatcaaatcatccactatgcacagtgtgcctatccagctgttgaaaaagactgaagcgcagtttttaccgattctagatcaagtaatcaaaaataaattggcattcgaattaaatgctaagagcgcttacttgtatgacaatttagcgttatatgaatatgtcatcgatttatatctttcacgtggtggtaccttgtttagtgttggatcagatgggcattaccttgaacatttccgtttccatttcgatgatctttttgctctgttaaaagcaaaaggtgtgacggaattagcgatttatcaaaaaggaaagcgaattatggttccattaccagtctaaaaaaacgtcctcagcatcaaaagtgaggacgtttttttagatttctttttctaaaatcggacaaatacgatcttgttttcctaaaggaaaatgtttgatcccgatttttttaaatccatgacgttcataaaaacgaatacctgcatgatttttttcataaacagtcaaacgtaaataacgtttttgtttcgttttagcataacgattcgcttcatctagtaaccgttgccctaaccctttgttttgataatctttgagcagatagagccgttgaatctctatagcatctttttcatcattgactttcatataaccaatgagtatttgatgatccttaataccaataaatttactggttgactgtgccaattctactgccaatatttcagttgtcaattgtgtctgtaaatatccttgcatatcaagtggatctgcgccatcgataaacgattcataaaaactgacaacacttacaacttgtaaagcatctagatcatcataatctaaatacgctagtgtgatttgattgttcatctaactcctccttttgacatagtatactataaattggatttgtcataaattgtcatgcttcttttacctatgaaatattttcacgtgttaaagtattcctcgttgaacacaacaaataaaactttttaacgaataaaggagatttttcatgacatcacttaaaactttactttttggaacaactttggctgccggtgctgcattcttcatgggaacgactgctcatgcggacgaagcttataccgttcaatcaggtgatactctatcaacgatttctcaaaaatacgttggtgacaactccttgatcaatgccattgcagaatcaaattcaatttctgacattaacctgatctactcaggacaacaattaacgattccaacagaaggctctacacaagcagctgctgaacctcaagcagccgttcaagaagcaccagtccaagctgaacctgttcaagctgaacaacctgttgtacaagaaacggttcaaacggaaacacaagcagcccctgttgctgaaacacaatctgctacaacagaaacaacggcaacaagcacgaatgctgcaaaagaatggatcgcacaaaaagaatcaagcggttcttacacagcaacgaacggacgttacatcggacgttaccaattagattcttcttacttgaatggtgattactctgctgcgaaccaagaaaaagtggcagaacaatatgttgcttcacgttatggttcttgggaagctgcgaaagcattctgggaagcaaacggttggtactaagattcattgagcttcatgaccgttatgctgctatttatatggacgcaacgtatattccgttaaagcggaaaaccgtcgccaaggaagctattcatatcgcagttggcattcgcccggacggatcaaaggaagtattgagctatgcgattgcaccgactgaatccatcacgatttgggaggaaattttattggaccttcaagagcgcggtttgaaaaatgtcctcctgttcatcacggatggcttaaaggggatggtaagagcgattagtcggttctatcccaaagctcgttttcaacattgttgtgtacacgtttcccgtaatatcagtcacaaagtgcgtgtcaataatcgtaaggaagtctgtgatgattttaaaatggtgtatcaagcctcgtctaaagaggtggcgttggaagcacgtggtgcttttgcgaaaaaatggaaaaccagctatccaaaagtggttgaatcgattctttcgaacgatcacttgctcactttctatgatttccccttggccatacgcaagagtatttattctacgaacttgattgaatcctttaataagcaaatcaagaaatacagccaccgcaaggaacagttccaaaacgaagagtcgatggaacgtttcttagtctcgtcttttgatacttacaaccaaaaattcctaggtcgcagtcataaaggttaagttatccatggaggtttagctcagctgggagagcatctgccttacaagcagagggtcagcggttcgatcccgttaacctccatatgagccgttagctcagttggtagagcatctgacttttaatcagagggtcacaggttcgagccctgtacggctcatatttttgcgggtgtggcggaattggcagacgcactagatttaggatctagcgccttacggcgtgggggttcaagtcccttcacccgcataatttaagttttacatgccggcttagctcagttggtagagcatctgatttgtaatcagagggtcgagggttcaagtcctttagccggcatctttaaacacgcggaaatagctcagtggtagagcaccaccttgccaaggtgggggtcgcgggttcgaaccccgttttccgctttgccaaagcaatcgcgccggggtggcggaactggcagacgcacaggacttaaaatcctgcggtgagtgatcaccgtaccggttcgattccggtcctcggcatttcaaatatgcgcccatagctcaactggatagagtgtttgactacggatcaaaaggttaggggttcgactcctcttgggcgcgtactgaacattttgacttagccaatcctgttactaaagtcgatgatatccccgattatgaaatgtacagtcaaacaatcgatagcttaaataagcgttttggcaatcgtgttttaaaaggcatcgaaatcggttacatcgcttctgaaaaggatcggatcatcgactatttagccgataaagattacgatttaaaattactcagtgtgcatcataatggtcaatttgattatttagatgacgaagtcaaagatatggatcctgctattgtgattcctcagtattttgcacaactttcagaagcactagttgttatagaagcagatgtctttgctcattttgactatggttttcgggtatttggtctatccgttgctgaatttaaacaatataattaagcgggaagtagctcagcttggtagagcacttggtttgggaccaaggggtcgcaggttcgaatcctgtcttcccgataattataaatttaaacacggggccttagctcagctgggagagcgcctgctttgcacgcaggaggtcagcggttcgatcccgctaggctccatttcatttaaataatgaatatctttttcgcggtgtagctcagctggctagagcgtccggttcatacccgggaggtcgggggttcgatcccctccgccgcgatttttaagagcctggacctttagctcagttggttagagcagacggctcataaccgtccggtcgtaggttcgagtcctacaaggtccattgtggcgttgtaagtttcattcatggaaaatggatgaaacgtacatcaaaattaaaggaaaatggcattatttgtatcgagccatcgatgcagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatacggcttttatcaagggacagaacatcgtaccattaaatacctgaataatttgattgaacaagaccatcgtccagtaaagagacgcaataaattctatcgaagtttacgcactgcctctaccacgattaaaggcatgctgaaagtagaatttgtctatcaatacacatttgaaaccttacaacaattggatttggagttatttgactatgtcaattggtggaaccaccttcggttgcacggtacacttggctacgagacaccggttggttaccgtaaccagagattggcgcagcgaatccttgataatgagctcggatgtgctagcgaggcagtctaactttaactgttagctcctgccgaagatcgtcacatccgaggaggctcattgtcaaggacaatcggaatagcatacggaaagaagttctgcaccttataaaatttgtcaaaaaaactgttgccattccaaaaaaattttcgatctgggcaaagaagtggtatactgtaagtggtttagttaatggtccactgagaccgcgtacgcatagtcgtactctgtatgtgccctaaccatagcgtgcatacatttcagaagcttgttcatacaagcaactgtggcaaccttatctttcttagggataggttgcttttttaatttgtagtaataatcgacaatatgattaggagctgcgcgttgctggcgaatcatatttcgaatggtgaagaaaataattttccgtgctttgggattaccacgcttattgatgcggtcttggccagtatacttacctgacggttccgacgggaatcgaacccgcgatctcctgcgtgacaggcaggcatgttaacccctacaccacggaaccagtgtttttagtttttaaattgcgggagcaggatttgaacctacgaccttcgggttatgagcccgacgagctaccagactgctccatcccgcgataatatgataaaggaggataagggattcgaacccttgcacggttttacccgcctgacggttttcaagaccgttcccttcagccggacttgggtaatcctccatagtacaaaatcttattggttttggggaagtactcaagtggctgaagaggcgcccctgctaagggtgtaggtcgggaaaccggcgcgagggttcaaatccctccttctccgtttcaatattttgttttacctggcccgttggtcaagcggttaagacaccgccctttcacggcggtaacacgggttcgaatcccgtacgggtcattaaattcaatataattttactaactggattaaaaggatatgggactgattgttttgaacatgcctatcctcaaccaatgagaacttacgacgaaatcatgttctagaaagaaatttctatccaataagaattccaaatcatggacactattatcaaagaagctttaatagataaaatattcaaagcagattctaaaaaagtcgattccacaaaatatacatgggttctgttgcaaagttttaaatctactatcaaataaggtagaataatagaaaaagatagcaggaggaatgacgatgaatcattttaaaggaaagcaatttcagcaggatgtgattattgtagccgtgggctactatcttcgttataaccttagctatcatgaagttcgtttaaaacggggccttagctcagctgggagagcgcctgctttgcacgcaggaggtcagcggttcgatcccgctaggctccattaacaacattagttgttaaatttgttcattgaaaactggatatttgaagtaaatgtaagtaatacaaaccgagaacaccgcaatgggcctaaatggactcgaaccatcgacctcacgcttatcaggcgtgcgctctaaccagctgagctataggcccataaaaactaaaagcgggtgacgagaatcgaactcgcgacaacagcttggaaggctgtggttttaccactaaactacacccgcataagcactggcgacacaaatgatcaaaaaagccgaaggctctccttgctttttgttgtaccaaacgttccctgggattggcgcactcacagccgctttattgctcggtgaattaggagatatcacacgatttaaaacccataaacaattgaatgccttttaaaatagccgcagcttctgcttcttttctcttttcctctgctatagctttaagctctttctcccttcttttttcagcttcttgtttttgattttcaaatataatagatgcggcttctgcctcttgagtaaacagtgttcaaaagcttgcatctgcggtaataagcccaaccaaacaaaaaatatgaggagctatttttgtttggctgttcttattacttgatgcagaacagctttttcacaacctctccacataaaaggattttttatttttctttttccaaatttgatagagtagtttgccatattcttgcacccaacgataaatcgtcgtatgagaaacgttaatgccacgatcatataagatttcttatccagctcacaaatcagcctgtgcggcaaaaagatcgatcgtctcataaaatcaaagatttcatggtcgtccgcctattttgcttcaggctaaacaatttg

SEQ ID NO: 43-45 - skipped (3 entries)
